United States Patent 12,576,115 (BACTERIAL COMPOSITIONS FOR TREATING AND PREVENTING HALITOSIS) - sequence listing, part 26

SEQ ID NO: 46 - DNA, 2546955 bp, unidentified (residues 1-1,273,478 of 2,546,955)
  source 1..2546955: mol_type = genomic DNA; note = Lactococcus cremoris
gtaattttaaaaatacatgagttcgtcaccaatcaaaactcttttttacttcttaaattctttcaatgggaaaccaaagttctaactcctctggattttcagctgaaatcgaatgatgctcctgtacggctccaactagttccaaatcctgttgagccatgaagttttctatctctgaatatactttgtgcatttcataagttgctgtttcaacaactaaataccgaaagcttggaaaggtccattttgtccaattttcaggagttttcgtagtattttcaacttcagcacctgccagataaagtccaccatcggaccaagcgctaaaagttcgtgcctcatcagacatggctccccacacggcaagaggttgtttaactaaatgagcaatttcgtcaaaagcatttgtagcttgctgccagagcggcggaatccaaatgtcagcttcttgcgatttacctaagccttcttttccgataaccgagaaagatgacttttcaacttctctgatgttcacttcccctcctcactcttttgaaagtatcgtataatacttccttaactaggactacaaacgctttactgaaaacgctataaagtcattttaccactttataataaaaataaaaaaatatttcgcttaaaaaatgatagaatagaattagaatttaaaataaaggaggagatacgacaaggctgacttttatcggctgagttttgtatcatatattttatggctgaagtagaatcttttcaattagatcacacaaaagtacttgccccttacgtacgcttaattggtagcgaaactggaccgaaaggtgatgttattactaactttgacgttcgttttgtacaacctaatgccaatgccattggtatggctgctttacatactatcgagcatagtatggcaagtttgattcgcgatagaatcgatggtatgattgacttttcaccatttggttgtcaaactggtttccacatgattatgtggggtgaacatagttccgaagaaattgcgaaagtgattaaatcttctctagaagagctttcaagtgatgaatttggttgggacaatgttcctggtgttgcggaaaaagaatgcggaaactaccgtaatcactcacttttcggtgctaaagaatggtctaagaaaatcctcgctgaaggaatttcaactgacccttacgaacgtaaagtcatttaaaattcgctcacttaccgcacgaagtaattttaaactatcaacgtttttagattacaacacttaatcatttccttttgtaaggaatttaataggttaatttttactgacagttctgtcagtaaattttcgtacgtcaaatctacttagaaaggaactgaattcagtgagtaatttacttgctgaatcgtatttaatcttatgggaaaatatcaacttgataataagggacagaaatctgtcggtaaatttcatgaaaaaaactcaacggtaggcggaaaaggcatcaataccaaaaatgctactcaggctaaaatcgaagccctccgtgccaaaatggagaataaaaaatatgacaaaaaagcttaatattgcttatgttggttttggtaaatcaactaatcgctatcatatcccttacgtgaaagaacgtgagaatattgtgattaaacgaattgtcaatcggactttaggaaaacgtccggaacaagctgaattagaagcgactggaactttattttcaactgatgtcgctgatattatcaatgatgacctgattgatttagtcgttatcgttacaccagcttttgctcattatgactacgctaagcaattgctattagcagggaaaaacgtgctctgtgataagcctcttgtggaaactttagaacaagccaaagagttggtagatatcgctaaagaaaaaaatcttttcttcatgcctttccaaaatcgccgctttgatagtgatttcttgactgtcaaaaaagtgattgagcaaggttatttaggtgatttagtggacattaccgtcaatatggatcatttcagacctaatgatgctagtcaaggtggaaattttgatggcgcttggtatggtcacggcgttcatttagtagaccaaatggtatcgctttttggaactcccgaagaagttcaatacgacattcgtgcgaccagagattatgacagtgttgatgattacttttctgtcaatctcatgtatccaaacttaagagcaaccgtcgctgctaccgaagttgctgcgatgccccaccccaaatggattgtttatggaacaaaaggaactttcatcaaaatggatgttgaccaacaagaaaatgatttaaaagttggcatgttcccaggtgatgaaggttttggccaagatagtcctactgattttggtaagcttacttatttcaatcaaaatggtgaccggattgtgaaacatatcccaactgttgccggtgattatggaagagtttatgattctgcttatgaagcaatcatcaatggcgctgacaagttagtttctgatgagcaaatgctagctgttatcaaaactttggaaaatggtttttctaaataataaaaaaaagactgatcaactgatgagtctttttttgctgacaacttattttttcttcgtggttttttgtaatttactgaccaaacctttaaattgcccttcaaaagtaagaacattattgaaaatatcctcaccatcattgagcattttgacggtcacccaacccaaggcttcagtaattgttgtggctactgtcgcattaattgctccacctgcaattgttcctactgctggtacaaatttcaagacatttcctacgaggctgcgtcccagaccaacgactactaattcctttgtgactcccttcgccaaagcttctgaccaagaagccccaaatattttataaagtcgcatcatcatggtcagttgaatcggaacaagcaagacggcatccgaaaaaggaatgggtgaaaagccaacaatcgctgctgtcaaagttgcaaaatgaatcgtttcatgacattttcttcgtgtttgactgtccactccgactaaaaactcatcaaaaagctgatcaaatttttgagaattattagccaaaaactgttcggccttggcctttgaaaccacaaatgaagattttattattttagcagaacgagctggcatatttttgagaacttgattgaaaaattcatcaaagccttcattttttgctattttatcttcctttgttctatcctttaatttcttatctgattttctaatcatctacgctcctttcagcctatttttaactcattataacaaaatagtctcttaatacacgaaaaaatcaatcaaaaatttgattgatttcttttattttgcaaattgtgaattgtacaaacttgcataaagtccttcttgttttagtagactttcatgattgcctgtttctacaatatttcccttgtccatgaccaaaatctgattagcatcacgaatggtcgataaacggtgcgccacaacaaaacttgtccgcccgattcattgccgattgaatcaagcgctcagtccttgtatctacgctagaggttgcctcgtccagaattaatatctcgggatttgccacaaaagcacgcgcaatggttaacagctgtctttgtccctgagaaatatttgtagccgtttcatttaagacggtttgataaccttgaggtaaagtcgtgataaactcatcagcatgggccattttagcggcctgaatcacttcatcatctgttgattcaagacgtccataacgcaaattatccatgattgttcctgaaaatagccatgtttcttgcaagaccattgccattcgacttcgcaattgttctcgttttgtttcccgaatgtctttaccttcaagtaaaatcttccctgagctcacatcgtaaaaacgttctagcaaattaatcatagttgttttcccagcaccggttggtccgacaatggcaaccatctgaccgacttcaactgaaaaattaacatctgtcatgagtgtttgattttcattgtaagaaaatgccacttgttcaaaatgaataaaatcagtcctttcagcagtttcaaagttactgacagaatttttgggtctttcgtcagtcctttttttcttgctgtcagtaactttttcaatgtccgttatccgctcagtcatttctttttcatctaatacttcaaaaatacgctcagccgatgcgactgttgcttgaatggtattaagcatgttagaaatattcgtaatgggttgcgcaaattgattggtatattgcaacatggcttgaacatctccgagattgactgactctgaaatcactttaagcccaccaatcactgccatggctaaataatccaaattattgataaaacgcatggttgggtaaatcaaagtagacacaaattgtgctttccatgcggatttataaaaatcatcatttcttctagcaaattctttttcagctgctgcttcatgattaaaagttttaatgaccgtgtgccctgagtaattttcctcaatttgatcatttaataagcccaaattcttttgttgttcagaaaagaatttttgcgataaaggagcgacaattctgacagtaatcattactaaaggaactgtgataaaggcaactaatgccaactgccaagaaatcgtcagcatgaagtagatggttcctacaaattgcaggatacttgtaatcagttgaatcaatgtttggtttaaagtccccgaaatattgtccatatcattaatcattcgactcatgatatcgccattattatgactatcataataagaaatgggcaactttttcattttatttttaaattcgcggcgcaaagtataaaccgttcgctgtgaaattcgagtcatgatgctttgttgcaagactccagaaacaaatgaaattagataaatgaccaagacataaagcaaaatagattcaacttttgccatgtcaattcgaatagcttgatgattttttagactttttgtcactccatcaaaaatcaccgttgtcgccgtccctaagattttaggggcttgaactgataagatgactgacagaccagcaattacccttgaaaatatcaacccccacaaatcgcgacgcatatatttaaaaagacgaataatggtcggaaagaaattttcagctcgccgtcctttttggaaacggtcagctcccttccccccacgattaagataatttcctctcatcattggactgggcctcctttgtcagttgaatttgtaatcgaaagacccattttcaccaaatcctcatctgagagttgtgattgcatggtttcttgatattgcggacatgatttggccagactttcatgtgttccaagacccacggcaagtccattctccaaaactaaaattttgtcagctgacatgactgtggcaatcctttgggcgacaatcactttgattttatcatgatgtttttctgacttgttaatcgcctcgcgaagtttccggtctgtagcgaaatctaaagcagaaaatgagtcatcaaagagataaatttcagcctccttaatcaatgttcgagcaatggcaattctttgtttttggccaccagaaaagttggcaccattttgttccactgccatctcaagaccaccttgttctcgaataaaatctgcagcttgagcaatttctaaagcttgccacatttcttcatcagtggcatcacttttcccaaattgtagattagaacgcaggcttccagaaaaaagaactgctttttgttgagttaaggcgaccttctcatgcaaatcatgtttagacatttgccgaatatcaatcccatttatattgacacttccacttgttgggtcaatcaatctagcaatcaaattcaaaatcgttgatttcccagaacctgtcccaccaataatcgctaaagtttgaccagctttcacatttactgacaaatctgacagtgcttgtcttttagcctcatcaaatttgaatgaaacctgatgaagtgctaaagaattactgacagactcatttagctccttattaacttgctcatccgtgattttgtcttgtctttctaaaatttctcgaacgcggacagccgaaacttgagctcggggcaccataacagcgactgccgacaattgcataaaggacatcaaaatctgtgatgcataagtcaaaaaggcaaccaatgagcccatttccatcatatctttaccgatgagttgtgcaccaaaccagacaattccgatatttgtaaaactcaaaataacggtcatgattggcattaacatggcaatggtggttaatactactcggctagtatgcgtcaaatctcgatttgcttcatcgaatttatcaatttcatattggtctcgcctaaaagcacgaatcacccgtactccagttagtccttgttgaaagatgagattaatcttatcaacttttgtttgcattgaacgaaagcggggcatggcaattgcgatatttatcaccacagccaaagtcaaaataggcaaagaaattaaaaaaacaagcatcaaatcatgtgataatttccaagccataaagattgaaccaatcaacatcatcggtgccataagcatcatccgaagcatcgtctgaaaaacattttgcagttgagtcacgtcatttgttgttcgggtgattaaagttgcatcaccaaaatcttgaaaattacgctcatccataaataatactttattaaataagtcacgacgtaatttcatccccaaaccttgcgattgtttggaagcaaaataaacattcccaatcgctgaaatccagctagcaagggcaacgattagcattattaaacccataaaccagatatatttcatatctgattgaccgattcctttattaataatgtccgctgtaattgttggcaaccaaagattagtcaccacttgaatgacaagcaaaaaaagtgcccaaaaaacaggccaaaaattcaaatagcgtcggccgattgttagcatgctttctccttttttagcgaaactacatttagtagtttttctttatttttattagttctcatcgtcaatattatattatttttatttcaaaaattacgaaagaaaaaatcactgacagaaattatccaatctcttgctgatattttttagaaattatcatttgtctactaaggcttgtgattaatcctatattcgtctctaaaataaaaaagcactctatcatcatgagtgcttttttataacgaactttcctaagcaatggttaccgcagggtaggcttcaacatattcctcgccctgagctccacgataagtaacaatccttttctcaaaattagcttcatagtcaatcacaccagcctcccaagttgcacttaaaaactcaggaaaagtcgttttacccgcttggtcagctcgtaaagctttaatcaaggcttccctatcaaaagttgcaacttcctgaaagccggtaagcattggcgcattagtcaggctaattactccagcaaccgtccaaaaagtgctctgtcccgctggtaaggtccagacgtttttcaaaacaccagcttctctcaaacattcggcaagatatggaaaaccgcccacttttggacgaatggtctcagcttttttcatggctccttctacaagttctattgcattcattttttcacctcatttcgcttatttgatgattaattataacaaagttcaaagaaaaaaatgctgacagaatttatcagcattcatattttttcataaataatgggatttcttcaatcaatcgactgggtaagaccacataagcttttttagctaaatgacttgctattaaactgtgtaaataggttgcagcagctactgtttctcttgtttctccatgaaattgggccaaaaatccgccaatcattccagccaacgtatcacccattcctcccgttgcttgagctgggagacctatttttaaaataaagttctcttgatttggactgaaaattcgcgtttctgaggattttgaaacgataattgctccttcttgattaacaaaatcttgaagagcttctttagtttgctgaccaattttcaaactagaaagtcgttctaactccatttcatgcggtgtgaaaatcgtattttgcggataaggcaagcttaactgttctttagcaaaaagagtcagtgctgaaccatcaatgaccaacttttgtttttctgtcagtaaattcaaaaattctgtcagtaaatcaagtctctctaaacccagtcctggaccaatgacaatgacgtcagcagattttgctacttctcttagagctgacaaatcatcaaaatcaattgtcattgcttctgggagtcttgcatgtaaagcgccatggttctctttagccaatgctacagaaactaaaccagctccagaataaactgcacttgtcgttgccaaaatagccgcgccgccatattgagcatttccaccaatcactaataaacgtccataagttcctttataagaatcttttttacgttttttaatcaattttcttaaaatctcatcagtcaattcaatcatactgctattttaccgcatttcgtgttaaaattaaaccatgacaaaatcagcaaaaacatttgacgttatcgttgttggtgcaggcccgtcaggaatgatggccgccatttcagcagcagaaaatggagcaaaagttgctcttattgataaaaataaaaaagtcggaaaaaaattattaatgaccggtggcgggcgctgtaatgtgaccaatagtcgctctgttgatgaaatattagcaaatgttcctggtaatggacgctttcttcattcggccttttctcagttttctaatcttgatattattaacttttttgaaagtaatggtgttaaattaaaagaagaagaccatggacgcatgttccctctaactgacaaatctaaaacaatcgttgatgcgctcttcaacaaaattttaagccttcatgtttcttattttccaagtcaagctgtcagccaacttatcattgagaatggggccatcgttggactagaaactgatagtgaaagctatttaagtccaacaatcgttctctctacgggtggtcgtgcctatccttccacaggttcaaccggcgatggttatcgcttagcccgctcagcgggacatacgatttcgcaactttatgctaccgaagctgcgctactctctgatgaatctttcattttagataaaagccttcaaggaatttctttacgtgaaatcaagctgtcagtcgttaatgctaaaggaaaaacagtgatttctcatcaacatgacttgctcttcactcattttggtttgtctggtccggctgctttacgctgttcaagtttcattaaccaacttcttgaaaaaggtgaaactcctgtcatggtcagcttagaccaattcccagataaatcggctgggtttttaaaaaatgaactgaccaagctagcttcaagtgataaatcaattaaaaatgccttctctgggctaacccaagaacgcatgcttctctttattcttgaaaaagctggcattaatcctgccttaccagccaaatctttatctgaacaacaaatcgaaaaactcgttcaactgtttaaaaactggcaaatcataataaataaaactctcccaattgagaagtcatttgtcactggtggcggtgtttctttgaaagaagtgaatcctaaaagtatggaaagcaaaaaaacacaaggcttatttatgactggggaactgctagacattaatggatatactggtggttataatattacttgtgcctttgtcacaggttttgtcgctggaaaacatgccgccgaaattgcttcttatttccaataaaaaatcagccctagttcatacttgcacaattaatctagaaatggtactatattaaagtactgttttgcggtggtggcggaattggcagacgcgcaggattaaggatcctgtcgggaattttcttggtgcgggttcaagtcccgcccaccgcactaatattaactcagctaaggctgagtttttttattgcctttttatagaaaataaggagtaccaagaaaggtactccttttaataatcttcataatgctcaaaaagcacctctaaatctgctatttcacttagcaaagtttgcccaacattagtatctttgacccgctttcgttcgtcaacttccgccactaaacgtttcaagctaataatatctgttcctttttcgaccgctgctttgactgtcgaaaaaggttggtgagcaaccaattgaatgccaaaactattgtaaagaagagtatacccagcgatacctgtttctttttgataggctttagcaaaacctccatcaatcacaatcaactttccatctgccttgattggattctcgccatttttttccttaattggagtgtgaccattaaccaaatgtccattttcatctaaaccaaagttttctaagatttttgtaatgattttaggttgttcacgtaattgataatatggatttttcttttctacatgagtggatttatccttgatataataacgttcaaaggttgtcattgctgttttgccaaacaaggaagaacattctcccacccataagtaccacatcaaatctgttgctaaatcctctgattcttcaggatgagcaagacattttctaacctcactgtcaaaaaaatcaagtaaatctcgtccagcataagccttcttatcaatcgtaaatgatttaaaatctccattttcatgtaagggaaggcaaccatgaatcaatagattgccattgtaagaaagatacatggcccctttttcttgcaagaatccaacatggcgcttgagcttatctgaagttttaaaattatttaacaagtgagcaattattttttcttcttcctcagttagacttgcgggctgttcaggattaattataggcgcctgaaaatcaattaaatcctaagtttcacctgctaattctattttattttgtgagaaatcaataaaatggaggaggtcccgatgttcaagttggaaatctggccgtctttcaattagttgactttctaacttaaattgtaaaatagccgtggcttgctgtaatttattaaggagtactttttcatcagctgacaagcgaaccccatcaactaatcgtggacgaaatgcctcacttggttcataataacgttcagcatattctaaaatagcacgcaaattaatcccataagattcttcaagaatatctaaattcccgtaacgggcacaaattcttatcacattcatcatggccaaaggtgagccactaaaagccgccatccacacaatatcatgattgccccactgaacatcaactgagggcatgtttatcaaacgatcaataattttgtctggatatggtccgcgatcataaatatccccaacaacatgtagatggtcgaccgtcaatctgcgaattgtatctgcaagtgcaacaattaagcgagtaagttctcccagattttgtagttgcgaaagaattgaatcaaaatagtcctgtttgtcagtcgtcgaatccacttcattgattaactcttctaagatgtagcgaaatttttctggaaaagctttacgaacttttgaacgcgtatatttttgtccaacaaatttaactgttttcaatagatagactaggtttagacggcaatagtgctcaaaaagctttttatcttgaagttgacattcagagtctagtttttcttgtggataataaatcaaggttgccactgatgaaatttctgctgacgaaaattgtggaaaacaatcccgtaatttttctttgatactgccggaaccatttcttaggacatgattaaaagcatcatattcaccatgcacatcactcataaaatgctctgttgcttttggtaattcacaaattgcactcaaattaataatttctgtaagtacagcctcctttgaagaaagctgcttttttaataactgataatattttttatccataataaaaataaaataggtttctatccctatctcaccaatctgctttctatttaaaaaaatgagaataattaagcttatgcttgcattttatcatatagaaagcagatagtaaagcgctcacatttttaaattactgacaaaaaatcctgtcagtaactgacagactattttttgattttaataaataaaactttaagataatttccttctggaaagctgtcagcaatctgaaaatcagctggtagtttttcttcttgaaaaatggtaaatttcactcccttatttttgagagattcttcaaccatttgacggaatttcttatcagaaacatttgctgcattcgttgaagcaatcaacgttccattatcttcgaggatatccacagcttcttccacaagttccccataatttttggccaccgaaaatgtctttttaccattgcgagcaaatgacggtgggtcaagcacaacaatatcataagtcaaattctttttcttggcataattaaaatagccaaaaacatccatcacataaattttttgactgtctggttcaattccattgaccaaaaactgttctcttgttttatcaagtgatcgttttgccaagtcgaccgaagtggtttgacttgctccaccaacggctgcagctactgagaaagcccctgtataactaaacatattcaacaaagttttaccagccacaaggccatttacaagcgctccacggacatttttttggtcaagaaaaatccctgtcattaagccttcattcaagtatgtcgcataagtcaccccattttccatgactaataaaggttcttgcgcttcttcaccgaacagatattggctttccaattgactgtcagcaaaacgcagcttttcataagcccctttaatgtcaggaaaaaccacttggaaagctttgacaattgcttttttttgactataaataaatggattataccaagaaaaaacaacaaaaccattataaaaatcaatggttaagcctcctaaaccatcaccttcgccgttaaacagacggaaggctgtcgtcaactcatcttggaaaaaaggagcacgtaagcttcgtgcttgaacaaatttttccacataaaaatgatggtcaatttttgctgatgaggtactcaacaaccagccaattcctttattttgctttgaaagatagcctgttccaagagcttgagctttttcatcaaaaaactgtgcaaaatcatcctctgaaataggtgaacttaaatcttctgccaccaaaagtgggtaacccgctcgcagtttttttgctgcttttgtccgtactgtaatttttttcatcttttaattatagcatagccagttacacgaaacaatggttcaccttactggtcctccccatcggacaatacaaaaactgacagctctgaaagctgtcagtcaataggataaaaattatttacttaggttctgcgaacatttttcaaagctagaacatttgcaagataaagcacgacagcaaaaacgaacataatcaacaaatcgaaccaaattcctgaaaaacccattccccttttaaccacttcttgcatggcactaatcccataataaactggaatgcagtgggcaattccttgcagaattgttggcatcgtatcgacaggaatcaatcccgaaaataaaaattgtggaataatggccaaaggaatcatctgcacaaattgaaattctgtttttgctaatgtggataagagcaagccgaacaacaaagcaatgattgcaataaagaaattaatgacaaaaacccaaccaatatttccattattatgaacccctaaaatccaataggtaaaaataaccatgagtgccgtttgaatcatcgcaagaattccataactcaaagtatagccagtgacaatctcacttcgtttaacaggagtcactagcatccttcccaatgttcctgatgttcgctcattcactaaggaaattcctgaaattagaagaactaaaaagaaagcaaaggcgccaactaaaatcggtgctaaatcatcaaaagtagcatttgtactcgtcggatttccatacaaatacttgcttcttatctgaaactgctctgtattaacgctcagtttggttggagcactttgtcctgatacttgagacaatttatccatcaaattttgcaaagcctgctgagtctcttctttagtcgctttggcttggttttcttgaattacttgcgttaaaagcatttttaccgcagaacttgttccatttgactgattggcatagctaatctcaatatttttccctgaaatgctgacaattgcactcaaatctttctcattcattgtcaagcgattatttttagaaacatttaccacttccaaatgagctttatcatctggcatattttttaaagccttcgttaattctgtattatccgactttaagcccactcgataggcagtatttgatggcacttgaaagagaaagtacatgagtgtcaaaataaatattggcgctaaaaacatcattgcaagtgtccttgggtctccgcgcctttgaagcataattcgcttgaaaatggcaataattctcatctcaccacctccttagctttcatttctaaagtttttcctgccacaataaaagcctcttccaccgagtctacttgatatttttctttaatttccttaggagaaccttcgtcaataaacttgccatttctaagcatcaatacaatatcacaccgttctgcttcgtccatgacatgagttgtaatcaatatcgttttcccctggtccgcttgatttcttaattcttcccagatttcttgacgtaattctgggtcaatcccgaccgttggctcatctaaaagtaagattggagcatccgtttgtaaagcgatggcgagtgataaacgacgttgcattcctcctgaataattagcaaccgattgcttaagatgacttgtaagattcactgtcagtgccgctttttcaagtttttctgtcaattcatttttttgattccttggagcgaaccaaaaaactctaaattttgttttccagtcaactccttaaataaggcgtcttcttgcgccatataacctaattgtcctaaaatttttctatctggtattttgacttcaagaatttcaacacttccactatctaatttttgcattcccacaattgacttaataaaagtagatttaccagagcccgaaggcccaatcaaacaaattatttttccactttcaaaatcataagataatcggtctaatattattttatcgccaaatttcacgctcatacctttaacagttattggtgaggtcatattcttctccttcaaataaatcttctctagctttaatcttaccctaattctaacacttcccttttgaacatcaaatcaatttgccctctagaaaaactgtattattctgcattcaaaaacaactttctttatagtataataatagttaactttaagttttaaataaattcaaaaatctaacctgtaattatgcttagtatttattaataacaggctatttatcacatttataaaggagttcttatggcctgtacaacatttctcgtaggtaaaaaagcctcattagatggtagcactctaattgcacgaaacgaagatgggggagataaacctaatccccaacgtttcgttgtcatcaatcctgaaaatcaacctaagcgctatcgctctatcgccacagcttgtgaatttgacttaccagataatcccctatcatatacttctacacctgacgcggattcaagctatggtatttgggctgcagctggaattaatagtgagaatgttgccatgaccgcgacagaaacctccacaacaaatagtcgaattttaggattggacccctacgcggaaaaaggactaggagaagaagatttcacaacaattactcttccttatatccagagtgcgcgtgaaggtgttgaacgagtaggacaacttttagaaaaatatggaacctatgaatcaaacggcatggcattttccgataaagatgagatttggtggttagaaacactgggcggacatcagtgggccgctattcgtatccccgatgatgcctatgttattgcacctaatcgtcttaatattgattggtatgattttgaaagctctgacacgatttattcaactggtttgaaagaatttattgatgacaacaatcttaatccagactttgacggatataatcttcggcatatttttggttcaagcacgattaaagacacgcgctacaacaatccacgtgcttggtatgttcaaaactatttttctccagaaaccacaggaaatgatgacccttttaatcaagatttacctttcatttgccaagccaatcgtaaaatttccattgaagaaattaagtttgtcctgtcaagtcattatgaaaatacagcttatgacccttatagtacaacttcaagcgccgcagaacaaaaattgattcgaccaattggactcaaccgtaatctggaacttcatgttttgcaaattcgagataaggttgctgaaaatattgctgggattcactggcttgcctttggtgccaacacctttaattgtctggttcctttttatgccagagtaagcgacacacctgcttcttatcgtgatacaaagctggattttgacccaacaaaaatatattggttgaccacaatgactgctgtccttggagacagtaatttccaaggctatgtcgataaaagagatgattttgacttaaaaacaatggccaaattaagagcattgcaaaatgaaactgacaaaggaagtgaccaatcacttgaagcagtgaacgaaaaacttgcacagattgctctgactgctcaaactgaacttcttggtaaaatggttatttctggttccaatcatatgaaacttcgctttgattttaatgattaaaaaaatacggatggttatccgtattttttagatactatcaatgaagcgtcagcatccattgatagagtagtccagcaattacagcaccaacaatcgaaccagttgctggaatccaagcatagccccagtcagaagttcctttatttttgattggtaaaagtgcgtgcattattctcggacctaagtcacgtgctggattcatcgcgtaaccagtagttggtcctaaagaaaaaccaactgccataatgagaaaaccgataataattgtaccaaaaccaccttcaagacgataatgtcccattgccataatcaatagcatgagcagcgccccgtcaaaagcttctcctaaaaaattggaccaagaatgacgaatagcaggtgctgtggcaaaacttgccaagattagagaagaatcttttgtttcttcccaatgaggataataatgtaaccaaacggcgacagcacctaacatagcacctaaaaattcagctacaataaaagcaagtgctaagccaatctttattttccctaagacaagaaaaccaatgaccagggctggattgagataagcgggcgaaaagaagccaactacccagacggcgacagcaacggctaagccccagccaattgcgatagtcacccaacctgcattttccgattttgttttacctaaaacatttgctgcgacaaccccatttcctaataatacaaggatgaaagtgcccagaaattttcccaatatttgtaatgtcattgctctaccttatttttctatcagcattttttctaactgctcttttattgcttcaaaagttgctcctgcttctaagagagcactcgctgtgtaagctccctcaatgaccgggacattaaaaatggttaattctttgtctgtcatttcagaaaccaaatctagattcattcgagcgcttcctaaatcaaaaaatgttaagagattgtctgcctcattttcttcaatagcattcataactcggtcaaaagaggtacctatttctccattttctaaaccacctatagcagttagtgaaatatctttagcaacttcacgaattaatttttttaatcctgaggcaatctcagaagaatgagaaacgattacaattccataagtcatgctactacctccaaaagtgtttcaaataaataagcacttgattgtgttccggggtcaatgtgcccaattgagcgttcaccaagataagaagctcgtcctttagtcgctaaaagtcctgcacttgctttaacaactttttctaaattttctttggaagctgaatctgtttgcaggtcttttaaaaatgctgaccagatatcaaccatcgttttttcaccgacttgagcttttcctcttttttgaatagcttctaatccagcataaattaattcacttgtatccaaagtttctgtggcagccttactcatggctagaaaggctgaaccatacaaaggaccagaagctcctcctacttttgacattaaggtcatggccactttttttaagatttctgagacactttcaaagtttgaaccttccaatgctttcattgtttcagacatcccacgagccatatttgcaccatggtccccgtcaccaatcggtccgtctagttcgcttagataagctttattttcttgtattttttcgttaaatttccctaaccattcaatggttgtatctattgttaacattctatctccttatccccaagaaatagttttcacgtcttcattaagatttttgagccattggtcatcttccaacttaatcattgtaagtgacaagcctgccatatcaattgaagtcatataattaccaacttttttaaaaagaacttctattttttcttctgtcagtaattttgcaacatcattcataaaaatgaattgctccatcagtggcgtcgctcccataccattcacaagaattccatatttttgaccagctgcaaatttgaattcttctttcaatttaccaaccagctctgttgccaactcataagaagttttcattttttcccgacggtatcctggctcactatgaattcctacgccatattcaatttcatcttcgtcaagaacaaaaccaggttttccaaattctggaactgttgcggccgacaaagctaagccaatggtcttaatattcttgacgaccttatcagccaaatctttgatttcatctaaagaagccccttgatgggcagctgcgcctaatattttatgaacaaggactgttccagcaactcctcgtcttccttgagtatagagcgaattttcaacagcgatatcatcgtcaacaataatttgttcaactttaatttcttccatctcagccatttctcttgccatttcaaagttcatgacatcgcctgaataatttttgataatcaagagcacaccagctccttcatcagctgctttgattgcttcaaaaatctggtcaggagttggagaagtaaaaacagctccacaaacagctgctgacagcattccttccccaacaaagccagcatgagccggttcgtgtccagaacctccacctgagactaaggcaactttcccacttttaggacttttacgttgaataatttcaaaatctggaactttttcaatcaaatccccgtaagcataggccaatccggctaacatttctgagatcacatcttgtggttgattaataatttttttcatcgctcatcctcctgagtttcttatgttatacttagtataaaataaaaatttgataaaaataagggacaaatcgcaaaatgtgtccgctttcttttaaaatatgaaaaaatcaatcattacacaaaaaattattgctaagtcctttaaagacttaatgcaaagtaatgcctatcaccagatttcggtcagtgatatcatgcaagtcgcaaaaattagacgacaaactttttataattactttcaaaaccaagaagaacttttatcttggatttttgagaatgactttgccgaattaattaatgataatctggattattatggctggcaaaaagaactcttgcttttattacgttacttagatgaaaatcaaattttttatcaaaaaatttttgttattgataaaaattttgaacactttttccttattcaatgggaaaatttgcttgataaagtgctttttgaccaagaaaataagtctgactatcattggtcagacttagaaaaatcatttatatgtcgttataatgctgcagcaatttgtgcaataactaaaaaatcaatcattagaggaaattctttagaggacctttatcctcaaatagttaaactcttacttactcaactgaatctttttaaagattgattaccaggcgaaagctccagttggagcattcagatagtccaaccatttaaaatctttgacagaacaaagtgttaatgaaattcctgacatatcacaacttgtcattaagttcccgactttacaaaacttaatggataatccttcaagttctaaaaggcgcatgacatcgtattgaaaatgatagagttccattaaagtcgttgaaccaagaccatttacaagcaaaatataatttttattggcttttttttgccaattaatttctgcttttaacttatttactaattctacggcaatacgctcagagccttcaaatttttcaacacgataaccgggttctccgtgtattccaattccaaaagaaacttcatcttcagctagaacaaatgaagtcttttgatgaggaaaatgaacaggtgctaaggcgacacccaaagtataaatttctggggaaagtgacagagctaattgttcaatttcatcaatacttgccccttctttggcaaaagcaccgagaattttatgaagcaaaaccgttccagcaactccgcgatgtctcttatgaaaattataagtatttaccgaaatatcatcatggctgacaatgtatctgacgtcaattccttcagttcttgcctcttcaatcgcttttttaaactcttttaaatcagcttcgaaatttttgataatcacaaaaacacctttgcctgaattaacttgacgaatggcttttaaaatatttttagctcttggcggtacaaatagagggccatccacagctgcagcaagcatcccatccccaacataaccaatgtgagcgggttcatgaccacttccacctcctgaaataattggaactgccttattatcgaatgtattatcatagagaattccagtttctgaaagataggacaaatgagtgtgagttaactccactccttttaacatttcttctggaatttctgtcgttgaagtatagaatttcatataatcaaattatagcacagatacaaaaagagcttgattttaaaaaacaaactctttttatttatctcaacagaaaattttgatcttgtgaagctgctaaaaagttaagagaactttgtttaatatttttttattagcaattttgataattcttgtaaatcatcagctacaaaattatcttgaaatagattgggcaaagtcgcattgccttgtcgtttgataaaagcggtatcaaagttttcactttgagcgcctaataaatcccaaatatgacaagcaatcatgcaatatttttcctcaaatccaattaactcacgaactcgtctataagtggctggggctggtttatactgctgaacttcttccacagagatgacattttcaaaatacttacgtaggccagagcgttcaagcgaaacctgactgctaagcgtaggtgaattagtcaaagcaatcatacgaaaacctgattgtttcaacatttcaagtcctttttctacctctggataaggcaggagctgtccaagcaactgtttgaactctaacaaaactctatcatttaaagaatgattatggagttcagcaaccatttgcaaaactgatgtcgcaagttctccaaaatcataatagttcctactcaaggttagagcctgactgtataaaatttgttcagaaaaccactgacgtagacttttttatcatcaaaatatttagcgaaaaaactttctaagctttcgaaacttagcaaggtttcattgatatcaaaaacaagaatagggtattttcctgtcatcttaatctcttttcattgtaaagaaaaagcttgtcagagacaagctttttttaattcttatttttcagtcaaagctgcaagtcctggaagtactttaccttcaaggagttccattgaagctccaccaccagttgaaatccatgagaatttttctgcataaccgaggttgatagctgctgctgctgagtcaccaccaccgatgattgatttaacacctggttgtttaacgatagcttccatcaatccaacagtacctgcttggaagtctgggttttcgaatacaccaactgggccattccaaacaactgttttagcgccttcaagttgtgtgttgtagtcagcaattgttttgcttgctacgtcaagtcccatgaagcctgcaggaatgttttggtcagcagtttcttttacttctgtgtaaccagcaaatgcgttagcaactttgtggtcaagtggcaaaatcaattttcctgctgctttttcaagcaattctttagcaaggtcaagtttgtcatcttcaacgagtgaagttccgatttcgtaaccttgtgctttcaagaatgtgtaagccatcccaccaccgatgataactttatcagcttttgaaaggaggttttcgataacaccgattttatctgaaactttagaaccaccaaggattgctacgaatggacgttctggagcttcaactgcttcttggatataagcaatttcgttttcaagaaggaaaccagcaacggctttttcaacatttgctgagataccaacgtttgatgcgtgagcacggtgagctgtaccaaatgcatcgttaacgaagattccgtcaccgagtgaagcccagtatttaccaagttctggatcgtttttagattcttttttaccgtcgatatcttcaaaacgagtgttttcaacgagaaggatttctccatctttaagttcgttgattgctgcttcaagttctgctccacgagtagttcctgggaaaacaacgtcttgaccaagtttttcagagagagctttagctactggtgcaagtgatttaccagctttatcagcttcttctttaacacgtcccaagtgagagaagaggactgcacgtccaccttgttcaaggatgtatttgattgttggaagcgcagcagtgatacggttatcatttgtgattacgccatctttaattggaacattaaagtcaacacgtacgaggacttttttgcctttaagttcaacgtcttttacagtcaattttgccatttggaaaaattctccttataagataattttgttgagattgaaaaagcaccatgctgattcaattcaaatcgataggttaattatatcacaaattcggatattttggctttgagaattttacttttagcttgtaaagggttacttttacaagattcttgattttatttttactgacagattttttgagctttgctaagcaacttagagtgagctatcagtaatatatttttgaattccataagctacaccatcttctgtattactttttgtaatcacttttcctatttttttcaaatcatcagaagcatttgccatgacaattggtagaccgactgcttttaacattgacaaatcattttcattatcaccaaaagctgcaagttctctttgttctaatcgttctctttgagcgataaattgaactgctttagctttttgagcttcaagatgtgtaatttccagatatgtttcccaagttttttggattattatatctggaaaattcaacttttctaaatgtcttttgatttcttctagctttatttcgtttggtgtaatcaaaagaattttaaatatttctagtcttggccgctcagttaccaatgcttccaaatttactaacttgggaacttgtggagtaaattgcatttcttgtttgatgtctgcatcaatcttttcaacgtaccaatcgcttaaactgtacagggatagatttatttcaggataatcttttttgattgtcttaatcaatttttgagtgctagcatgaaccaatggatttgttttaatgacttcatttttagcaaaaataagcccaccattaaatgcaacttgtgcgctttttaaattcaactgattaatcagttcttccatcgcttggggcgctcttgctgaaaccagagaaaatggaagattagagttttcaatcacctcttgagtcttttgggaaattttaccttggtcatcaagcaaagtgccatctaaatcagaaaaaatatgtttaatcttagtcattttatccccctttaatctccattttaacaaaatttactgacagctttcttagtaaaagctaataaataaaaaaatcactgacagaagtcagtgattaaaaattctaattagtattttttacgtttacgagctgcttctgatttacgtttacgttttacagaaggtttttcgtagtgttcacgtttgcggagctcttgaagagttccagcttttgttactgaacgtttgaagcgacggagtgcgtcgtcaagtgattcatttttgcgtacaagtgtttttgacatagattttcaccccatttccagctcgagagttcgtggtctttcacacgacctttctattatatcaaatggatatagccttgtcaaactagactagctttagctgcagcttcttcattcatgcgttcttgatgaatatttatttttttatccaaataagccattgatttttccagttcggctaattctttttccatttcctttttacgaacttttaaaacctcgataatcatctcatgtttgtctgtattggcaaaaacttctttaatctgtgctaaactcaaaccggcacagcgataatggcgaatggcattaattcttgattctgctgcttcatcaaagtctcgaattccagctttggtgcgtggaaccgaaatcaaaccttctttttcataaaatcttaaattgtaggctgaaatccctgttcttcctgcgactgtcgcaatagtgaccatttgttctcctttgaacttataaaacccatcttttgggtcattttacattttttattcattaattaataaaaagtcaattttttctcttgacttagagtaactctaacttgctataatatagcatgttgatttcaaagtgtcaaccaccgcattttgaatctttattttaatatagaaaagagaaaaattgaataaaatacaagaaaaacgctcgatacgagcctttatgctttccaatgtcatggcaggtttggaaggctcaattgtggctactgctctgccagcaatgatggcagaattacacggcatcaagttgatgagttgggttgtaactatttatatgctcctcatggctgtttcttctcccatttggacaaaactggccgaacgttttggttataaacaaatgtttgtgctcggcacgcttttatttaccatcggctctctcggcgagggattggccgtcaatatgttgatggtcattgtcgcccgcgccctcatcgggcttggtgctggtgtgatgattcaacttccttttgtcatctatggaatgatgtatcaggctgatgagcggagacgcgtgattggaaatactgtcgctgcttattcattttcaactattgcaggaccaattgtcggaggtttgattgtaaccttacttgactggcgctgggtctttttcatcaatattccgattgggatttacatggcttttattgtttggaaaaatttcgatcttaaaactgaccatactaaaaaatcaattgattttgctggttctgcttctctatccattgccgtcattgccattatgcttctttttcaaatgatggggaatgcggtcattaatcttcctttgttgattgctttattagtcatcagtttgctctttttcactggattttattttgctgaaaaaagagcggttgaccccattgttccgcttgaacttttcaaaaacccttcatttatcgctaaaaatgtcatgtttttcatgcaatatggtttctttggtttttatacaaactatctgcccacttgggggcaaggcgtcatgggcgcaacggcattagtcggtggaatggttttgattccatcagcaatcatgctagttatcggaacgagaaatgtcaatcatctcattcaaaaagtcggcgaaaaaagaacgatttatatcggttttgctatcatggttttaggtgcacttttcttatttagtttgcctgaacatgcctcaattcttatgctctttgtggcaacagcaattcttggcaccgcctttgggattgtcaacattaccttgcaggttgcagttcaagaaagtgtcgctaagcatttgattggtgcagcgactgccgttaatgctttactaagaacaatgggaacaacacttgtcttatctggcttatcaatcgctctcaaccgtacatttactgactcaactgcacataatccaaaacttacgacgacacttcttaatcaaatttctgatgctcaagctttaaaaaatattccaactgcactcgttgcccctttgcgtcacaccttatttaatggtatgcacttgcttgcgcttatctccggcttacttcttttcattgcgctttttgtcaattggctcgacccttggaaaaaaggactagaataaaacaaaaaaactgctgacaactctgtcagtagtttttattttactgacaagacttctgtcataggatagccgtttgcgctttagcgcatttacggatatgctagtatttccgtcagtaatttttcaaatcattataagagccaatagccttttctaatagttgacgtaaactttccgtctcattttctaaccattcttcccatgctacactgtatattgcacgagccaaacgaaccgcaagtcttgctgttctttcctcataatctgtcagtaagtattcgaccaagagtccctcaattttactttgtttaaggagttcacgctcttccaaatcagggtggctggcaattattttttgtcttttgactgttctttctcgatgttcatcaaagaagtctgcagcatagaaataaccatcaagtacgataaataaaggatttgtttcttttgattctcgcattttattcagtaacatttcgctgtattgctcgcctccggcaaagaaaatatccgctttatttttaaatttgcgaaagaaagttcgctcagttaggccggctttagttgcgatttgtaaaacggtggtattgtcatagccttgtgctgtaatcagctcaagcgctgcttcatataatttttcttgacttgattttttcattttttcttcctaaacatatccaaaaaccccaaaatgtcagtttatgacatttttcttgacaattactttccaaaggattatactattctcaaatgtcagttactgacattatataaaattaagactgaaactgtcaagagaaagctataaaatacgatttcatcagtcaagtcagcacttgaagccaaagtccaacgttttatttttgcaagtacaactaatgtttatctcggaaatacgcttaatcgcccggccacagaaaacgatgaaccgactggaaaagcgacttatccagcaagtaaaattgctgccgaaaaaggacttcacagcttattagctgggacagctaccgaacttgtcattactcgctttggcttagtctatggggataaggaccctcatctgaacgaacttgccccttatctgacagaacgtcatcctgataagctaaattcgctggttcatcatacagatattgaccgcgcgctcctccaaatcgttcacactaaagacttgaaacatgacctttacaacatcgttgatgattctgaaacttctatcgctgacattttatccattgaaaatattgctcaagaacgtccaactgacaatgaccacaacaaatgggagtcggtttcttcaaatcatcgtttgaaaaaagattttgacttcaacttcctctatccgtctatcactgacgcaaaagacgccaatgccctttaaaaaatagaaaagagaacaagtatgaaaattacacttttaggttcattaggaaacatcaatcgacattttatccccagattaatcgctgacggacatgaagtcactgtcattacttcacgtccagaaggagctgcggctattgaaaagctcggtgcgaaagctgcggttggattaaatactgacctcgactttctcagccgaactttcactggttctgatttggtttatctcatgattacgggtatcgctttttcgtcagcaacatcaatgtctgatttggcaaaaatttacagtcaggccatcaaaaaggctgatgtcaaaaaagtcattaaccttagctcagtcggtgcccaaagcccagaagctgggattctctacgaatatcatgccatggaagatgggcttgatgaactcactggtgttaccgttaaacacattcgtcccgttggtttttataccaatttactgacagaaattgcgctacttaaggctcaaggaaaaatttttgaagccatcagtcctgaaacaatgcgagcttgggttcatccaagtgatattgctgatgctgtttacaatcgtatcaatgatttactgacggacaaagctgtcagtaaaataaaatatgtcgtttctgattgggcaacaggtactgattgggtcaatgccttgggaactaataacatttctgcccaatatgtcactatttctgtggaagatttgatagaaaactttgtcaaagcaggtcttccaaaagttgtggcagatggatttggtcaaatgaatcaatttcaaaggagaaaataaatggttaaagcactacaatacaaaagatttgggcaaccagaagttcttgaactcgttgacctcccaagcttagaacctaaagccaatgaagtttctattatagtcagtcatgtcggacttaatccaatggattgggcaattatgggacatccagaagtcgcaccaaattttggagtcaaacttccacaaacttttgcttatgattttgctgggcaaattgaccaaatcggtgcagaagtgaccgacttcaaagttggcgaccgtgtttttggaacgacgatgaaaggggcggccaccgagcaactcattgcttcaaccaaagaacctgggctctatcacacccctgattttatagaaaatgatgttgcctctaccctcgctgtcgccggtcttacagctgccgtcgccttacgaaaagcacatgttaaaaatggagatactctcttaatcggtggagcagcagcaggagtcggcattttcgctgttcaacttgctcaattatggggagcaaaagttatcgggacagcttctgactcaactgccgactttttaaaggagcttggagctgaacaagtcgcttatggcgaaggtttgactgaccgtctaaagggcaaaggaatcactgccgccattgacttacatagttttgaaagtttaaataccgctcttgaattaggagtcaaagctgacaaaatgtccactgtcatcatgtacccagagcctccggctggtgttccaacggctacaggtggcgaagcgattccttctgatatggagatggttttgactgccattggtagccataattaactgtcccaatcgctgctaaattccccatcaatgactatttagaagcagtcaatttacaaatgagccgtcacactcacggaaaaatcgttctttacttttagataaataaaaaaagctgtcagattactgaccgctttttatttgctccaatcaatcggactttgacctgtttgaaccagaaaatcattggtttttgaaaaaggatgcgagccaaaaaacccacgacttgctgataaaggtgacggatgagccgcttctagtatgagatgcttacttccatcaattagtttggctttctttctagcaaaacctccccaaagaatgaaaacttttggtcgctcatcatctgaggcaattttgataatttcgtctgtcaatggttcccaaattttcccagcatgggcatttgaagcaaactcgggtacggtcaagaccgcatttaaaagcaatacgccttgctcggcccaagccgtcaaatcactatcttctttagaaaaaccttcctcacgcaattttttttggatattaacaatcgaatctgggcgattcactttgaaagtcgctggataagagaaagccaaaccttgagctttccccggctgaggataagggtcttgtccaacaataataacctttgtttgtgccaaaggagtcagttcaattgcccgaaaaatttgattttctggtggataaattttcccctcttgataagtctgattgataaattcaatcattttagggaaataatcttccgctaatcggttgcgtaatggctgtgaccaatctgtttttttcatttttcttgtcccttctccacaaaaattcggactgttgttttcaatttttctgctgctgtctttctaaaatcactgatataaatttctcgatgatgaaactctttgtggatagcttttaaatcatgtttttcagcataagcaaaaagcttctcaaaagtttctccctcttggtcaaaggatccgacatgaagtgcttgtaaacataagccatcttcaacttttccaaattcaagtcctgataaatccaagccttttttaacttcaaccaattttttcgctttgtcaatcacttggtcattgacaaaatcaggcattctaagcatcaagcgccaaataaagtcctttttatctatttttccatcaataggttcatttttacttgtccacaatccttcaagtggaggaaccacaaaaggctgaaaatttttaattgtaaaatttgaatttcgataagacattgaaaacatataagctgtcgcatataaaagggcaatggcttcttgaaaagctggacttgttggtgctcctttaccatctatcatcagataattcagagcaggcagctcaattaaagaaattccttttggtaaataatagtttttatcactttttttataatcaatttttgggctagacatgcttttattatatcaaatttataaataaaaaaaactgcctttataacagattttttctcataattagagatttgccacgttgtgataaactttttgaacatcatcgtcgtcttcgagagcatcgataagtccttcaaaaatttccaaatcttctggtgaaagttctacttctgattgagcaatcatttctagttctgttgttgagaattcagtaattccagctgctttaagggctgcaattcctttgtgaaggtcagttggttcagtgtaaacaacgatatttccttcttcttctgtcacatcacgaacgtcaacctcagcatcaagcaagatttcaaaaatatggtcagggtctgttccttcaaaaacaatgactccagtattgtcaaacatgtagctgaccgcaccggctgctccaatatttccaccatttttatggaaagtagtacgaacattagcaatcgtgcggttaacatttgaagtcaaagtttcggcaatcaccattgaaccgtttggtccaaatccttcataacgtccttgaacaaatgtttcatctccgccacctttagctttatcaatcgctttatcaatgacgtgttttggaacttgtgcttgtttagcgcgttcaataacgaattttaatgatgaatttgattctggatctggttcaccttgtttggcagcagcatagatttcgacaccgaattttgcatatactttagaagttgccccatctttagcggtttttttagcaacaatattggcccatttacgtcccattggaatagtctccttgaaattttatttaaattattggcagattagtgatctacatgattttttctatcatattatatcacaatttgtaaaggctcgtctatgagaaatcgaaaaaatcccgtttttacgctttcaatttaagcaagtcttttttatttttctcttttaataattggttttcgcccaaaattttgttctttaaaattaacatttcctaattgatagatttcatcagctttctgcgtcagctcatcccaaggtttttgaccaattttactgatgatttttcctctattttgagctaaaatttcttgtccagcttttgaaaaaccaagaatatgaatctcttttggtaaattaaactcttttggaatatttaacaaaatatatgttaagagcctacgaacacgcgctttggtataacgtttagtatatacaagttctactaattcatcaaaatttttagcagatttgaccgcattttttaagcgaacagaaagttcttgatttacttggaaaatattttccaagtggtcatcaagcctgattttatattgcaaaagtggaaaataagctgcccaattggtttttggacttgcataagtttctaaaatcactgatgggacatgattttttattgctgacaagtctaagatcgcaggtttttgactgaccgattgatgagtttgctctgtcagtaaatttttcctttctgtcagtgaaaacaatgactgacggagtgccgtcgcgctggcaaatccctctgtcagtttggtcgaatggaattttccaacacgtttaatcgcttgcaaattaatatttttccccgcagcagcttttgcataagcgagagcaagaacatgattaggcgtgttcccatcaaatttaattcctgtaaaatgttgccacatcatttgtgttttttcgggataagagagttgctcaggcaatgctttgataaaactttccatttccgtctcttttgtttcataaatatcagcaatctcattataatcaattgctgattctgaaccaaaagcaaggtcagtaatgccaagattttttaagatatccacagccccacttgcaaaaaaatcggcagcttgcacagaaacagttactggcaattcaacgactaaatctgcgccacaagacaaggccatctctgctcttgtccatttatcaaaaatagctggctcgcctcgctgcatccaatttccggacatagcgacaatttttggaccatcaatttgattcaaaagatactcatgtcccttatgaaaaggattaaattcagcaataatacctgtaattttcgtcattttatacctctaaaaaaatctgtcagtagctgacagatatggatttactttactttttacaaacaaaaaaccaacgtgcgctctctttgctaggtgcttcatcagtaaaatctgcacagactattgcttctttaaagcctgccgttgctagatgcgcgagataatcatctatcggataagtccgttcttcatgaacttcgtcttttcttgtaaagcgtccatcctctccttgaatgaaaaagctcaactcatggacgattgaatgaggcacttccccttcaaaagaatcccacaagaaagcgaaatcttccgcattttcatggtaagagtagttaggaaaaacttcgtctacttgatgagttgaatgaacatcaaaaataaaagtcccaccctcattgagtatttcaaaaacaccatcaaaagtagcttgtacttcattcaaattttccaaataacaaagtgaatcagaataacaagtcactgcatcaaattttccaagaccagaaaggtcacgcatattaccagcagtaaactcaagtttatgacctgcctgacgcgcttttttactggctaaagttaacatttcttcagaaatatcaagaccagtcacttcatagccttcttgagccaagcgcactgataaagccccagagccgcaagctaactcaaaaactgattttgtttcttttggtagatgtctttttgtaaaatcaagccattgctcataaagttcttggtccatgacctgatcatagactcttgaaaaatcttcgtaaaatgccatttcagccctttcttgaattagagacagtcctttttgcctgactgtcagtggataaaaaataaataagagctctgtcagtaaaaccgacaaagccattaattattcagctataaatccagaaatatcaaccattggtgcatctgaccagagtttttctaaattaaagtgtccacgttcatcatgtccaaagacactgaccacgatgtccccaaggtcaatcaaaacccagcctgtttttgcgtcgccttcaatatgacctgatgcttttgctccagcaagttcagccgcttcagcaatattatcagcaatggcatctaactgacgactattcattgcttccataatcacaaaataatctgcgacaaatgtcacatcagacatatccaaggctacaatatcaagtgcttttttatcatcggctgcttttacaaccacttcaagtaatttttttgaatccaattctttcctccgagactatttgtctctctttattattaaaatcttttttaagatttttattcatttttctgagtcatttacaatcaaatcttatcagctgtaaaaactagacccacttattttaacataaaatgtcacagcaaccaaaagttgcttgttatatccattatttttccagaacttttaaaaaacgcttctgagaatgattactcgtatatccttggtgttcataaaattgatgagcctcatgcctttgcactcctgagttaagtcggataacattaatccctctagctttggcattttcttctaaagcactaagcaattgtgcaccaatcccttgcccttgcccttgctcttgatcatcaacgaccagtcctagaacattgaacatgatttccttgctataaaccgtatcataagtttcagcttcaataaagcccaccacttgatttccattatcaaaaacaagaaattcctgtttttcatcgttcaaaatacgactcatattattctttacaattgattcagaaattggataaccaagtacgccagcaagtcttgtgatgtctgaaacatctctcatctcaacttttctaatcatgaacttttcctctatttttactgacaagcctatcagtaactatttatcaagacaaataagcaataaaagcattataagcttcaaaagtttggggataaatggtcaaacgacgttctgccaaatactcaaccaaacgcatcgtttcaaaagcaaccgcctgatttaaatcttgaacagcgactgcccgggcttcaatgactccaggaaatttccgtccctcttcaatgtaatctgccacatacaataccttagcaagaccagacatttctttatctccgaccgtgtgaatctcaatagcacgcagaatttcttcgtcttcaagcccaaaatcttcacgtattttataaataccgactttcccatgccaaatattattatcccaatttttcaaatcagcatccaaatgatatttgtcaattaaagccagaaaaatctcatcgtctacctctttacaataatcatgcaaaagtccagccaagcttgctttatgtgggtcaacctcatatttttcggctaaagcaatcgctgctttttccacaccaagcatatgtttaaaacgtgattctttgactgcaccagcaattttcgctagcaaatcttctcttgataaattcacttctggataaaaatcaaacatataagccttctttcaagatataatctaaaaccttcggtgccaaaagaaaatgtggtttaattccacgatgcaattgttcccgaatcaaatttccggaaatatccatcattggaacgtccacccacataatcggataagaagtccctgcccgatagcggggtctgcgaatcccaacgaattgaactaattctaatagctcatcaatatgcgcccaatgagctaaaccagaaatcatgtctccaccgataataaaataaaaatcacaatctggattttcttcatgaagctcaagcaccgtttgatagatatcagcgccatctttagctttcagacgacaagcatctacttctaaaccaggacaatcttcaatagctgcggtcagcatggccgcaacgtgcccatcagtattgtgttctggcaaaaagacaactttttccaaattaagttcttggcgcacttggtcagaaattgtcaaatggccaacatgaacaggattaaaattcccccaaaaaagcccgattgcacgtcgtttctcgtcttctttagtttttaattctacctttgtaaaaggagtcaataaatctattgccattcgttcacctattattttttactctttgattattttttgaatgaaaccattaatagttttttattttttaaaatttatttcacaatattttttacttcaaccgaaatcttgcgattttctttacggtcagaaactttgaaaacaataagatttcgaccaatgatttggaccacatcaagtcccatttcttctattgcttctgctacatcagttgcgacttcatctgagttttgcaaaatactgactttaatcaactcacgtgcatcacaagccgtacgaatgctggtcaaaatttcattagacaagccacttttcccaatttgaacaattggtttaatattaactgccaaagcacgcaagtatcgtttttgttttccgtttaattccattatttatttttttccgtttctatttttttaactaattttgctatttttaatcactttaagcgcaagatgtgttttacttcatttctcattaagagaaacaaagtaaaatgatatcatcatcaaacgaagacgttcctttgatgaaataagattgagaatgaggtaacgattatgtctattacagcaactatcgcagctggcgctacagcactaacacttttaggagctggaggcgcagcagcagtaaatgccgcaacccctagcacaaacactagtccaacaacaacggcaactactgccacaggctactattgcaaaaacaaagacagcagcaggtgactacggcggaccaaaaactggcaatggtgtcggcaaaggtcccacagttgatcgatctgacatgagttccgctcaacttgcccaagtccaaaaagacgaagctaatggcgcacctcaacaaacaggtggcccctcaacaaatactttggttgccaaataaagaaaaccatagcagagaattcaagcgtcatgccttagattctctgttttatttttgattttgaaaaattaataaatattttaagtctgacaaccaaatctttagcaaattattcatattggtcatttctaaaactcattcaatttccaactcaattcaggcgcaatcaatcccttaatctgataagcattttcgccctcaaccaccgattgaaccaaggcactctttcttaattcaggcaactgataagctttttcataagggagttctaactcaaaagcttcaaaaagctcatgcaatttttctaaaattgctgttttcagccattgaacaccattctcagatttaattgagagttgtaaacttggcgacaaagttggcaagaagtcacttggggcaatatccattttattataaacattcagcacaggaatatttgtcagcttcaaatcttccatgattttcaagaccgtttgttcatgaatttcatgatgaggattgctagcatcaatgacatgaatcagtaaatcaacatttgcagattcttctaaggttgatttaaaagctttaatcagctctgttggcagattttggataaaaccgacagtatctgtcagtgacaccgtaaaatcttcaaccaattgaacggcttttgttgtggcgtccaatgtcgcaaaaagttcattttgctcatattgttctttatcaagaccaactaaagcattcataatgctggattttccggcattggtgtaaccaattaagccaatccgaaaaattcctgattttgagcgtttttggcggatattttcccttgttttttcaacttttttgagggctttatcaatgttttcaattcgagtgcgaatataacgtcgatctgattcaagcttggtttcacctggtcctttagaaccaattcccccaccttgacggctgagcataattccttgcccgaccaaacgcggcaaaagataattgagctgggcttcttccacttgaagcattccttcatgtgagcgagcccgcatggcaaaaatatccaaaatcaattgcattctatcaatgactttgacgcccaaagcttcttccaaattgacattttgtcttggggatagacggtcattaaaaataaccgtatcaatttcgcccacttcaatcgcccaacgcatttgttccaattttccagaaccaatcattgtccgactatctggacgttctcttttttgagtaaattggtcaatgaccaatccgccagccgtttttgtcaattcagccagttcaaccattgatgactcaaaagcctgaaagttttgggctgtttctactcccgcaaggagtactctttcttgtttttcttctagatctatcaaatttttagtaaaattttcctttttatttttgtcagctgagtttagactaaaagtattataaaactaaactctatttttgtatttattcatttgtcacaattcttttgacttgagaattcactgacagatttgcaagttcgtcagcaaagaagcttggaaaagccttgtaatttctgtaatcagcaatcggaatccatttcaaaaattctttgctaccgtctgtcccaaaactctccgatgttactgccagattttctgtcagtggtttcatcagaaaataaaaactcaattcatgacaatttacctcattcaaaaaatcattttcctgacctgtaaaaaaattttcatggataaaagctaaatgttcaatttcgagatttaatcccgtttcttcacgaatttcacgcagacaagcctcctcggccgtttcacccagttgcacggcaccaccaaccgaataataatagtcattgtggttattgccaaccattaaaacagcatcatctttaataataattccagctgcccgatagcgaaaccactgattaccacgcgtaaaaccaatatcctgactcatatcttccattttaattctccaaaattttaatgataaggctgtcggtagtttttttaaatattattcattaaaaagtttctttacaagtcaaacaaaaatgattttacccaatcaaagccttacgcacaactacatccacaccctctggcacccaagcggcaacgactgctttttgtggcacgcggacccaaccaagaccagaaaagacaatatctgacttgtcagtaattttaaactcgcgacgaaccaatttggcaccaaccaaagcaggagccaaaagctcacctttatgcttttcataaaattcagtcgcaccttcaagtttcgtccgatgaacattgatttcattgtcaaaataagcagtcattccttggcgctcaccacttataaagtcaaaacgtgccaaaccaccaaagaacaaagtttgttcaggattgagttgataggttttcggcttaatttctttacgtggtgatacatatttcaaatcctctggttccaagtaatgagccatttgccctcgatgaataatccccggtgtgtcaatcagtgccgagtcttcatcaagcggaatttcaatcttatcaagagtcgttcctggaaaacgtgaagttgtaatcacatcctcagaacctgaagctgacttaataatcgcattaatcaaagttgatttaccaacattggtcaccccaaccacatagacatcacgcccacgacgataatgctcgatagcttccatcaattcagccacatcatctttgttttgtgctgaagtgatgaggatatccttaggtttcaaaccacgagaagccgcttgttctctcaaccaagccgtcattttcccaacttttaaagattttggcaaaacatcacgtttgtttgcgaccattaataaatcatttccaccagtcaatttatgaaggttaggaatcaaagacccattaaaatcaaaaatatcaaccacattaacaatcaaagcattatgttgaccaatttctttaagcaaacgcaaaaaatctgcatcagtcaaacttgtcggtgcaatctcattataatgacgcaagcggaaacaacgctgacagtataaatcctcatcgttctttatttttttcttcaaagcacccgcaggcaaaaagccaagtgcatttttatcctcagtttgaatttttgcaccacaaccaatacagtacaaatcttccattgtattttcattttcaatcatattgcctattataccacatttcatcagcatttttagccttttttcctaataataaagagctatttttgtcagctttttactgacagatttatcagtaagttaattttaaaataaaaaagagaaggacaacttgtccatcccctttttctactgacagaattatcaaaataagataattttcttgtcagcaatttttattgtacagaatagttaggtgcttctttagtaatttgcacatcatgtggatgtgattctttcaagcccgcaccagacatttcgataaattgtgctgaatcatgcaaagctgtaatatcagccgcaccagtatatcccatccctgctttcaaaccaccaagcatttggaaaacgatatctgtcgctgttcctttataagccacgcgtccttcgattccttctggaacaagtttatttgcttcattaacagccccttggaaataacggtctttagaaccttttttcatcgctgccaagctacccattccacggtaagttttaaacttacgaccttggaagatttcaaattcaccaggagattcatcagtccctgcgagcattgaaccaagcataactgcatctccaccagcagcaagtgccttaacaatatcaccagaatatttaatcccaccatcagcgatgattgttttaccaaattcacgcgccacattagctgcatcatagattgctgtaatttgaggaacacctaccccagcaaccacacgagttgtacagatagaaccaggaccaatcccaaccttaaccacatcaacaccagcttcaaacaaagcacgagcaccttcaccagtagcaatattaccagcaatcaaagtacggtctggaaaatgattacggatttcacgaattttacgtaaaacaccagctgaatgtccgtgagccgtatcaataacaatcgcatcagccccagcagcgaacaaagcttccgcacgctcaaaggtatcagaagatacaccaactgctccagcaacaagcaaacgaccttgctcatctttagcagcatttgggaattcaatcacacgttcaatatctttaattgtaatcaaaccagccaatttaccagcttcatcaaccaaaggtaatttttcaattttatgctcttgcaaaatacgagccgctgtatctaaagttgttccaactggagctgtgattagattttcagaagtcatcatatttttgatttgttgattataatcagtaataaaacgcaaatcacggttagtaataatccctaccaatttacgattttcaagcgtatcaacaattggtacaccagaaatacggtaagtcgccatcaagttttcagcttcttcaattttatgatttggagtcaagaaaaatgggtctgtaataacaccagattctgaacgttttaccttatgaatttcttcagcttgttcctcaacagacatatttttgtgaaccacaccaagtccaccttgacgggccattgaaatagccatttttgagtcagttacggtatccatagcggcagagataatcggaatattcaaagtcaaatttttagccaactttgtcttcatactcacctcattaggtaaaacatgagactccgctggaatcagcaatacatcatcaaaagtaaatccttttttcaaaaacttagtttcccagtttgacatcgaaaatattcctccattatcgcgctatataaagtatatagctatatttctatggccatcgccaattttttatttttactattctaccactattccccaagcatttcaacagtaggaaatagtttaaataggaaaaaaactaaaatttagccaataattaccttattatttcataatctcaccttaaatatggtaacatatattatacatggtaaaattcaatggttaaaaattacattttaactttaaaaataacaattatatttgactgataattattttttgccaaactgaaataaagactgattcttatcattgtaaaatattaataagaaagtttatttattcctcccaacacaaagaaagctataaattagaaatgaaactgaaaaaatcccacattatttccctaattctattttccggattactacttgtcgaacccgtactagccgaagataatgtcacctctgacaatcatccgatgggctattttatcaagcaagaacaggagcaaagtcaacaagcttctgatgaaactagcattctaccacagatgaaactccaaatattagagcgcgctcatttgcagcagttccggcagcaagcgccccttccaatctctcttccactgataactcactccctagacaagatgctgtagatatttcagactaccaaaactggatggttcaatctgattttaacgctttgaaatcagaaggggttaaaacagctattatcaagttaactgaaggaacaagttatcttaatccaagtgctgcaaaacaaattctgatggcaaaaaatgctggactgactgtagctacttaccactttgtatatgatccaacaaagattcaaaacgaagccgccttttatgctcaaagcgctaaagcactcggtttatctaccaataccgtgatgattgaagatgcggaagccccttcacaatattacaattggacagccgtatcacaagttttcaaaagcactatgaacaaagcaggcttcaacaatattcgctattatacttcacaaggttgggtgagttcaggtgttatgaatgcttcaactcttggagccaaaaatttatgggttgctcaatatctctatggaaaaccaagtaatcaaaatcttaaaaatacagactacggttcttggcaatatacgagccaaatgtattaccaaagcactccaaacttaagaagtcacaatctagatacttcaattgattataataatattttcaatgcttcacaaggacttcaagacgtttaccgcttgtataacgcaaatacaggagaacacttctacactctcaattttgctgagaaaacaaacctgcagaacgttggttggagttatgaaggaatcggttggctatcttcttcttctgggtcccctgtttaccgcgtctacaaccccaatgctaaaggtggcgaccattattatacaatgagtaaatgggaagcacagcagctggtcaacaagggatggagatgggataataatggagcccctgccttttactctaatggctcaaaaaatctctatgtagcttataatccaaatgcttattctggctcacacaactacaccacaagttcatatgagcaaaacagcctccttagaagtggctggaaatatggtgcagttgcatggaaagttaattaaattaaattaaataaaactaagaaaagcttttcttagtttttttatattcagaatttgattgattactttaggctaagactttagaattaagtaaaaattccaaagttttcatttggaatatcttttacttattttaaaatttcaatatcgtaaataatgtatcaaaaatcaaaagactgtttgagattattataattaccgccgaagacaaagcaactgtcttataagaaatgactttcagctcaaaatgctcatttcccgcaaataatggaagtagaaaaagcatcggtgtaacataacgtccctgaactccgccaattgccccattgatggcattcgtccctgaagaatatcctgtaaagaaatttatataaagagcaactatgttcaaaacaaaaagccccaaagcaccataactaattaatggatctttaacaaattttgtttccacaaaagcagcggctaaaattaatataaaccatacactcgtaagccaaaaaggcatcatattgtgcgtagctaatggctgaacaagaacggtgttgatatcctgaacattaatattaggattaaagttatatgaaaaattcataaataatttataaataactaagccaaaaccaccatatctacgagcatataaaattccaccaattaaaacaataattagaacaacaatacttgtcgtaaacctagcccgtttagaaagtcttctaataatattttttgttttccatctcataaatatagataaaataattatcgggaaaataagaattaaaagtttaatattagtttttgctgcaaagtacacggcaatcgaactaataatcattgggagtaaattaaaaggtgttatcttccctttatccaccatattaatccccacagctacaagaaaagccgcaagaattaatgttaaaccatcgtaagaaagactagagaaagtattcattacaacaggactaagccctattattgtaaatactaatttcccccttctaacatacttgatgataaaaaacaatattaaagtatagacaaacatcgacaaaagtcgagcgcacacaatcatcatccccattgaaggatagatatgataacccaaccaaacccctgcggcaggcactatgtgacctaaaaaattgtaggataatactttaggatattcagtagagcgaggaagtttattcattggcattctttgaacttcagtttcaaagtattttttaaaataatctccattctgataggctggtttttgattaacaaattgattaccaaaccattttgaattctcgccgtagactgttatatctgtggtcaagtgcacaatattactagaatttacaaaatgataaacaccatctggttcgttaaagaacggcattccaatggataggataattccaaagaaaagagcaattgacaaataaaatttgtgaactttcttttctattacttctgcattaaatgatattttagatttttcactatgtcttttttcattatgtcttttgtttaagtgataatcatttcttctatatctaactgtatccatattacactaacctcactaaaataccaccaataaccacaattcctaaaataaacaataataatgggaaaattattgatttcagagcactaaaatgaacctctttttgaggagtgacagctaaaatattgtactcatttgtccctgcaccatagtctggaataagaccatttagtttaaatgattggttgcttgctgtcttcatactagttttagtaagttggctaccattaggcgaaactacattttctgaaaaaatagaaaaatcaatgggtgttttatcaacagagtagttagtaggagcggcaacctgataaaggaagtaatcttttccttctcccaaaccaaataatttgattaaagattgattaattttggtatcacgttcataatcataattgaatcttgtattattcaactcaattggagatacatcatcatcaccaaaaacatattggttcccacctcttaataaagtatagcttgtaggagaaactgtagacaaatcttgaatttcgctccatttcccttgactatcatatagatactttttaccacccacattcttccctaaaatataaacagcatctctaaccatcttatttttatttgcatccacttcaacaaaatttataccagtcgtattcaccttgggagcagacgaggtaatctgagttccagttgtctgagaaatcacattcgccgtcattccaaaattattgtctggggagttgaaagctttaattggaacattcatttttgtagtattcgtgcttgttccttgttgaatagatacattatttacatagacaacaggagaaagatgagcttttatatcaatagaaacatcactatgtgttggtggaattgtcagttcatacatgttaatctgccaagaaataagaacgctacctatcgtatccgcaattttacttagttgttcaggactagctaaagggtcaaaagttactcctggattaataataggcggtattaatgaagttactgtatttggaagtgatgtttcatcaataacaatatttgcatcaggacggaggtcaatctttgtaggtgtagtagggtttaacatctttttgcttacttttagtttataatgtaattcttgatttaactccactgttatcggctgactacttttagaattacctgaagcaaaagaaagtgaaatccctaaactatttgtgtctaccttaacttcactcatatctggagtgaccataattaactttataatacctttgctactgccatctacaatagctgtcagtcctgtggtcacctttgctgatgctcttccttcaagatctgtcgtttcatttccgccattaggggtatgaaatctgacaaaattgctaggagggttaaaagacatgatgtctgttccattatttgtttcgtttattgattgaagaagtgtaaaatttgtactaaaaagcgttgaaattatcgtttgtgcttcattatcagtatgtttactgccttccccaacagttaatccagcaacaactatcacgtgttctgtattttgcgatcctcgccaagcagaagagtttgtcacttggttagaaaatttcccctccataatagcttcatatgcggtttgataatttcctgccaaaaatgcttcattttgaatgggatctcctgaagaagtaactttgattgataaattcgtagtcaaagttttatccgaagcacttacagtatgtccttcatagaaagtaaagagtaatagccccatcactccaataagagtaactaagaaggttacctttttatacattttattctccaatcgtttagtattagggttattttttacttacaatctttttgacttcaataaaaagactggatttcaataagatattaagaattatatatattatagcaccaatcaatacttgaaatataagattatgcatattcatcttcaaagaattgtttaaatagaaaacagctccaaacatcactgcaccagatataaagtatttccagcaagataaaatcattggaattatctcaaagtcatttctcaaaatataaaattgataaatcgtcactgaagcctcggcaattactgtcgcaatcattgcaccagtgagtcccaaaagaggaatcaaagcaaagttaagtaaaatattaagaactgcaccaattgttaccgaagttgtgaattctctcatccgatttaatggaagaaggtactgaattcccaaaacattactccaagcaatgaatataataattggggcttccatcattagcaaaggaccgacagctacccatttagggccgaaaaagaatcctgcaaaattgagtgctattcccataacaccaaacattatcggtacagcaagcccagtcataaggacgaaagatttttttaaagtctcttggacttctttaattttaccttttgaaaaaagatttgaaacatgtggtaacatgactacacctaaagaagtgacaatgctcaatgttactttaatcagactatccgattgactaaaaaatcccgatgccgttttcccatcaaaaatcccaatcattgttttgttcgcaattgtataaatctgtgtagcaatttgcggcaaaaaaagtaatagtgtgggttttaaatgatgtcctaatgctaattctttccatttgggggcaaaaatttccttgcgcaaatatggccaaagtgaaagatttccaatcaataatgttccggtaatgattaaaacataaatgggcaaatcctttggactcttaataaaagtaaagatgaaaataactgaaataatagagacaataaaattacgccctactgttcgcttgaaattttctactcccataaaataccaagaaatatcaaaagccgcagcgataatagcgatactctgcaagagatatatctcaaaatcctgtttttgaaaagctaagaaaatacagaaaataagaaaagagagagcaatggtacaaaatctcaaaaatgaaatttcccaaaaaatttggcttctcttttctttatcagattgatgatatgcaatctctcgatttccataagttgttatcccaattgaaccagctaatacaaagtactgaataatcgcataggtaaatgtatttaaacctatagccgttgtgccaagcaccctagaaatatagggaattgtgataattggaataatcacaatcaataattggtaagagctattcagaagatagttttttaatactttcaatctttaaattccttatcgacagcttttaaagctgcattaaagacttggtccatatcataatactgatagttacccaaacgaccaccaaatattactgttttttcattatctgctaatttacgatatttcttaaagagttctgagtttttcgtatcattaacagggtaataagcttccttcgtacgatcccaatcttgaggatattccttagtgatgattgttttattttcatcaccttttttatcaaagtgacgccattccatcacgcgcgtaaacggagtctcagcatctgtataattgataacagcattaccttgtttgttgtcagtttcaaaagtttctgattcaaatcgaacagaacgatattctaattcaccaagttcataattaaagtattggtcaatcattcctgtataaacgattttaggaaattctgctaaataatcttctttatgtgagaaaaagtcagtatttacttgaacatcaatcaattcagagtccagcatcttatcaaaaattgctgtgtatccatccactggaactccttgataacgatgattgaaatagttattatcaaaggtataacgaactggtaaacgacggataataaaacttggtaattctgtagctttacgtccccattgtttttctgtatatcctttaatcaattttgtataaatatcagtaccaattaaagaaatagcttgttcttcaagattttttggaataccagaaagaccggcagcaactttttgctcctcaatctttgcagcagcttcttctggagtcttcactccccacatttgatagaaagtattcatattaaatgggagattgtagagttcacctttataattagcaactacttggttaatatagccattaaactcggtaaattgattaacataatcccaaacttctttattgtctgtatggaaaatatgtgccccaaaatcatggacattaatacctttttctttatgggtatacatattcccaccaacgtgcgcgcgtcgttcaataatcaagttacgctttccacgtttagctgcttcatgtgcgaaaattgcaccataaggtcctgcaccaacaattaagtaatcatagttttttgtattatatttcattatttattctcctcaagaactttatctgctttttttaaggcctcacttaaaaaataacctgaacggatttttttacccatcttttgaacattgattaccatttcattataatcttgttctgaaatttgtgaaagcttttggggtaattcttctaaattatctacaacaaatccgagattgttttctacaataaaagaagctaatgcagcttgcttccacattatcactggaaaccctgccgctaaataaagggatgctttatgtggattattatatttttgatattgtccactaagccctacaccacctacaacactgtcaccatcccagaccagaccgtaagaaccagataattctgttaagatctgattacttggataacttccgttataatggatagattgtaaattttgtaactcatcacttaagccagggccatataattctaactttatatccgaaacttcagccaatttagttagataagctgacttttcttttctcaaattccctgctataataactcgattgccaaattcccccccttttcctagtggaccattgtgcaaataatcgaatatttcaagatttactattttagaagcagcaatatttttttcaattagccactccttcatcttgtaattatgagaaattatacagtcggcctccgtaagaaccttcgtagaagcagtttgagataaaagattattttgaagttgataatttggatcccttaattcttctaaatcatgtataagtataatattaagtgatttattttttttcttagttttattaaccttattaatcacataactttctcccaattgattaggagggaaattttctacaaaggttgattgttttaatggtaaaaccttactataaccacttattatagtaaatatggcatttaaatatcgattagcagataatcttttcccagctatcttaattttcttaaaaccatatttatcaaatattaggtttgcatcctccttagcttttgcacccgcagtattattttctttataattaaatccaatataatattttttcatattcaatccttttgttgttcatccatttaatttcttttataaagcatgagggattttctcatctataattcataagaacttttttctgaaaatttatccgctaatgcttgatttagctgtgtttttactttctcaaaattttcagtattatccgtatcattaaaacatataagtttaatatcagattctaagatctttttatagtctacagtatcatttatttcctgataaagcccaacttttttgatattgcatggataaaaccgtccagtaatttttaaatagtcttccaacagcaaaattgaaatatcttcgtgagttctaaatttattctgtgatgttttgtcaaaaggttccgatacatactctcttaactctctaaaggcctctttttttagagggcgagctaagtgagtagggtaaaatccaatatgcctttttaaaagtgctatcaaaggtgagagatagatgttaaatagtaccgcttttgctccatttttgatacttaagctttttttagtaataaatttcttattgattggcaattgatttatagttaatgaattgttaaaaataacactattaaaggcatcaactggtaatactggagtatacatatattgatataaaggcagattatttttaaaaaaatctgagggttctgttttagaatttaaaaatatatcatcattaaaataaacaaaattttccgaaagacctggaattctatccaaatttagatctaaaacgttactattgaatgttggtagatactctttaggaatatagtcatcatgttttacaatgttaattttaggattagtcgtgtctagccattctggaacatgcccccaagttactaaatgtattttgttaacccacggagcatatcgttctattgctcgaaaccaatattgaaaattatccatatttcgataacgtgcttcactgtttcgtgaatccagattttcaccactatatttggctctttcttcctgccatttcttatctgtactatctaaataagttactacaaaatcaattttttctaaagttttattcattaccagactctgttccaagtatatgctcccattcaatcgcaattttttctaatgaaaaatctttagatctctctttagattttttactccaaaattctctttggttcttatctgaaattaactgcatcaatttatctgagatttcttttatattcccattttcagcaacaaggccatattgttcatttttaagaatttcatcacttcctgtttgtgagaatgcaattataggaagaccatagttcattgcttctaccaatactaagccaaagctttcaaatcttgatgtcattaaaaaaatggagctatttaaataatgatttgttagttcttctccatttttcggacctacccataaaattttattcgtaagcctatttttttcaatcaattttttaaatcttttgttgtcccttccggaaccagctactctaatttcccagtcgtcaggcaaaattttcgctatctctattaaatagtccaagcccttatgcaaaatatcaatccgtcctacccatgatattatttttttattcaagtccacaactttatttgtatcatttaatgtaagtggattatgcaaaacttgaactttttcaaatccgcggttttctagaacatttttttcctcttgagttagtacaatcaaccgatcacacaccctaagaccatttaaaaattgatttttgcttttcgcaagatgataagtttcataatggttgagatccagatgcagccaccctattaatttcatttcaggaaacatttgctttaatttttcagcataaataatccattgttcaactaatacaattgtagaatatttattttctctcacatactttactagattttcaaaatgtttatcattggggcgtgtaatcatatcaacagttcttcttaaaatatacttgttgattcccgtctgtataagtaatttttgaaaacgccaattattcaaagacttttcaggaaaaataacttttttaaaaagaggatagtaactttctgtttctctaaaagaaaataaatcgatgtcgtggtttcttctgcttaattcatttacaattacactttgaactctagccacgccaccaattcttaaatctccaatagcaaataatatcttatttttcataattatctttcttcatagtgagccgtcagttaaataatattagcttactgattttagtcaaatttttctacttattttcaagtctaaatagaatcgaaaaattaaaccttataaatactattttttcatccttttaacagtattcaaaagtccgcgctctacaactcgccaagttttatttgtttgaacaacattacggaatttaactgcaggatttatgatttttccaccagttctaaccagcagtctgctcaatgataaaatttcaggatctttatcgattccttcagctcttaaatagtttgtgaaatttaaagtttctttttttcgaacgtctttttctggaattgataagttaacaacatactgagcaagaatgagttctgaaaatctttgtttcagcactttttttactgctggatttgtttcttctggtaattctttaataaaactccactcatgttttagcattgctaaatgcattgcacgatttttaaccatatttccaatcgccatgctttgtgtcccagaatttactcgataaacatagactggaaaatccaagtatacttgcgttttcacaaaaggcagtgggaaagtgatatattcaacgtcaacatagaacattttttcatcaatcttaatctcgttattttttaagagttctgtcttataagtcacagtgtgcattggtgggattttaattgacgctatgatttcttcatattcattaatctgatgactctttatgttcaactccatcattaaagtctcatcttttgttacttcatcatgctcaaaatatggattattaattaaatctacatctgtttttttcaagaaatcaactaattttacaagattctctgtttttacccagtcatctccgtctactactttaaagtatttacctgttgcttcaagaatcccacgattaatcgtggaaccatgtccaccattctctttttctataactcgaattgtctgcggatatttttcatgccatttagttgcaacttcaaccgtcttatccttagagccgtcacttacaacaagaatttcaatgtcatcgacaatcgcattgtccagcaaaaaaggcatacattcatcaatatatttttcagtattataacttggcactgtaattgtcaatattttattcatgtttttcctttttttctccatcatcaattttctttttcaacaaggataactcttgtactaaattttttatttctttttcagcagatatcagagaaatttgatatttcaaacagataaataataaagcacctaccaagaaatataaagctaatgaggttaatgttccaattcccaacaggtgtgcaatacttgtacccaaatctggaataatcgaaccaatcagcaatataagagctaaaatgaaccattttaacatatgtcttatttctgctctatctttacgaaccaaacgaatcgtatagataaagaagaaagctgccaaaataattgctaagatacgaagttgaataggcattacttactctcctttcctaataacgagctcgcaataatcgctaaagatacgcttatcatataacttattccttttaccatgttaatacttgaaacacccgttgtccgttcaaacatttttacccccacctctttgacacgaatgttcttagagaataaatgcatataactttcaggctctggatattgtcttgggtatctattaacaaattgctctatcactttacggttacctgcgcgatatccactggtaacgtctttgattttaatttttgaagacatataaatgagtgaagataaaatttttattcccatttgacgtgattttgaagacttaaattcagaattactttcatctaaaaatctagaaccaacggtaaaatcagcttcatccttcaaaataggttcaatcaagtttggtaaagaatggatatcgtgttgaccatccccgtcaaattgaactgctatatcgtaagcgttttgtaaggcatacagatagcctgtttgaacagctccaccgataccaaggttttgaatcaattcaacgtggttaatgttgtttgctttcaaaatttcttcttcgttatcagtagaaccatcatttatcactacgtagtctaattgataaggacaactggcttgatagtcctctacaatttttaaattttctaatattccctcaccttcattgtaagctgggataattagtaaaattttcatttttttgtcatcggacactgttccaagttctccttataaataaacattaattttgtacttctttatgtacatttttctaatataaattttaccacaaatttacttattttttttacctattttcaaacggtaggcgataattactttaattttcttaaaaatcattttaactaagtcgcgcaacttcgtttgtgttaggtcagtttcgacggaacgcaagagtctatttgccgaaaaattagcaacaaatccattatttgtttggatttgagaaattcggaaatcatatccatttgcccatgaagtataaacaagtaaacgctcaaaagcgtgtaaaatactattgtagggaagaggttcttctgggaccgctgcttcaatatcaacttttagtaagttattcaaagcttgtggacgataccaaatcattgttccataactcatgacataactatctttttgtttcaagtctctcggattttcaaagttaattttcttccatatttcttccatatctggccaaatatcacgttcagtaatataagttggtccgtaaaaatgttcgaaaaatgagggaacgtccgcaatcatcaagccaagtttcggatttttttcaaattcttgaaaaattgcttgtgctggtttcagcaatgaatattcgatatctcttcgccaagattctcctacaatccaatcattatctttagattttttggtatgaaaatgtccgcaaaggtcataatctgccattaattctgaaatttccatccacggcagaacatctcgccctttatttccagttaccaaaacttttttgatttggtttagcggataagactttatgatttgttcgtatttatcttttgtatctgttgtgataaaaaggtcataattttgaacatatttatcaaaataatcaagatattctgggattaaatcaaggtaaaaagcatgaaggtgaatcgcaattttcaagttgctttttttgtttgtttcggtagtaagtttgagtgttttttcttccaacatgtactcgcggtctggataatcaacctctgtcatgtgattaacaataagttctattggataagtcgtttcttgttttaagcgctcaattactaaaggagtataaatattatctgcaccataactaaaggctttgatttttagaaaaggaatgtgacgttttaacagttcaggtaacttgaatacggaaaaatcatggacaagcatacctgcccactcttctttacgtgtatcaaaaattactcctgatttaaagccagcatcttcaaaatatttcgtcattgctgtttcatattttacaatgacttctacaacatcatctaaaacttcaatatttgtccaaaaatcttcaaaagctttactttttacaatgttttgtttgtaattaacaaaataactttgaatatgatctggtaaaacaattgcttcacggtcttcccatggttttactttatgacttcggttattagtaattccccagaaatcaacatttgaatctttattaaacttagaaaaaattccttcaaaatcataaactggtccaaaacaggtatcattcatgattgtcaccgaatcataggatgcaagtttttcaaattcataatgtttcatcgcttctgaccaagcaacaaagtcatagcccttattttcacgttgcataaaaccgtcaatgagattttgccctgtcagtgtagctaaggcattttcatccattaaactatttgaaatgaagaaaacttcatcaaaattttgtcgtaaatgtttcaattggtaaataacgtggtcactcaactcgttatttcggttaaaatgtacgtatagtaataatttattgttcattcttctttcctaaggggtgtatcactttgtttattagccgatatgcaaaagaattagtaatttcagaaatcactttttcttgattagcaatatgggtatctttgtcagctattgtttttttcatcgcttcttcttgttcaagatactcttgagctttatcagcaagttgtctgtctctatcaatttgtaagttttgataattatctacccaaagtagtaagttgttttggagcgcttctatcagttctgacggaatttttttactgtacttattggtaatataaaaatacgattgataatagttttcccaatttcctctttgactcaaggattgttctaaaacgcgataatttaattttgtgtttgaaacaaaaataggttttgctccattattaatgattaatcctaaccaaaaatcataatcttcaagtgttttattgtttaaagattcatcaaattttatgtcagcaatttttgaggtcctaaccaatgacgaagcatcaatcagatttccctctagttgttttttaaagctatattctaaatctgggcgaagaaggtctttttgagcattaaaatcccatagctgacaataggcaatatctgaatctgttgctaacagctctgtcagtaacttttcaacatggtcagtattaagaaaattatcactatcaacaaaaagtaaaaaatcgcctgtgctcttacttaaagcatcatttcgtacaaaagctagacctctattttctcctgaaaaataatgagtttcagcaaatggtgattcttcaagcacttttgaaattactgcaccagaatcatctgtcgacccatcattaaaaactagaagttcaatgttctgatgagtttgcgcaaaaatactacgtaagcattcttcaataaagttttcgtgattgtagcacgtcactgcgactgatacttttttgtccataattcacctacttaaagatataatgttctattcctgaacgatattcatccatcggaagttgtaaatggtaagatctgagcattgtaacactcaaattcaacacaagtgccatgacactaaccgaaagaacaattcttcttagccaagctccggaagtttttactgaaactttttgggctaaaagagttaaactaggagccaaaagtaagataaagactgtaaagtatcttccttgcggtccggtaataacatgttcggtaaaggctgggtcaagtgcaaatttaaataatacaccaaaaaaattgattaggttgattaataagcctaaccaagcaaaccaacgaggaacttgctcttttgtataagataagaacaaaagaattaaagtgccatactgaataggataaaaccaagctggaattgctactgttgaagtcccactaatgacttgcgtggttaatacagagtagtaaggttccataaaagtatagaggaacttacttatcactaagcgtaattggtcatggtatttgaaaatatagagcaagattcctaaagcaagtaaagcaccaccgccaattagaacttgtaattttgtcaaactaatttttaattttttagctataatgactacaaaaacagctaaaacaagcaaataaagcaatcgcgaattagcctttgaaaaataaagggctactgacggaagaataattctcaagaaaaaatcttttaataaaatcggcttgttttctttcaactccaccgctagattaattaatgttgcacttagccaagcaaaagcaacgtaattatagcagtcatagcttaaacttgtagcaaattgaattgcgataggagtaatagaaatgattgtaaaaatcatttggtaagccttcagctttttgatgatgaaatacatcgaaatactaaagaaaattaaattaaaaagtctcgcaactagaaccattgacccaattgatggataaatcatatgtcccaactttatcccaagtgcagggataatgtgcatgatatctttataccattttgttcctagagctcgtttatctgccaccttacttttggaaattactggaagcttggtttcaaaaaattttttgaaataagttccttctttcatcatcgtagtgactgttgtaaaaggaagaggtgcagattggtaatcctcagcaggaaagccaattttgcctctatcaacaactgtgtttgagagataagaagatttatcaaaatgataactagagtctggttcaataaagagtggttgagcaactgtaaaaattaaaccagcaacaagagcaatcattaaaaaaagacgttctggtttgattaatttctttgtttgattattttctttaaccaaaattccaatctccattcctcaagagtaagccacttgctgaatctttagcactgaggtcatcttttggaatgtcaaggcgattaataatgatgattttttcatcggtgtcataagcaaccatttcatcttttgcattccgcacagaaacttgtagcttgagctttaaattattaacttgatcgagtttgcattcgtaaacagctcgtttttcaccttgcccttcggtgaggtaatccatcgagttatcattgtaaatccaaatattacggtctgcatctgtcagagaaaaggccacataggtttgaatgtcttgttttacattataagaaatttcaaatttaacactttgttctggagttgtttgtacaggtgaaagtaaattcactttcaaatcgctgacaaattcttctacttcttcactactgtcttcttgtgttgctttaagtcgttttaagttatccagactgtattggttagcaactttatctacatttcctgcaactttaatcaaaccgtcttcaataagtactgctttgttacaatatttttttacggcattcatatcatgagtaaccaagatagttgtcagacctgatttttttctttccaagaaataatcattacatttcctttggaaagcctcatcaccaactgccaaaacctcgtccaaaacgagcacatctcctctggctttaatggcaacagagaatgctaaacgaacttgcatcccactagaatagtttttgagcttttggttcatgaattcatgtagttctgcaaaatcaacgatttcatcatacatttcatcaatttcttgagttgaaaacccaagcattgcaccgttcatatagacattttcacgtcctgtaagttcaggattgaaaccaacgccaagctcaatgaacgaaaccaatttaccatttacggtcactgttcctttttctggaacataaatttgcgaaatgatttttaaaagtgttgattttcctgaaccgttacgtccaacaattccaaaaaaatcacctttttctacttcaaaatcaatatcttttaagacatgttgttctttataacctttgattcctctaaatctgttgacaagagttgtccgaaggcttgtgctcgcttccgttggaagacgaaaatacttacttacatgatcaatttttactgctagttcagccattttgtctccttaaattaaataacttctgcaaacttcttagagtttttagtaaatatccaaagtcctaatccaaaaacaagaacaggaaggatataaggaataataattacaaaaggattatcccacatttgccatagcgttggattggcattgttactaaaagtcaaaatatagcgcatatcttgaacgatttgagccattggattaagcatcaatattttagcaatttcaagatgtgaagttgagatttgtgttactggatagatgattggcgttccatagaatgctgcttgcatcactacttcccagattggacctaagtcacggaaataaacaaatagtgttgaaagaataaaagcaattcccattgtaaagagggttaactcaaaaaggagaggcactgcaaaaattacagtccaactcatgtgcacgccattgatgagagcaaagataataacaacaactaaagaaatcatcaaattaatgaatgcattggccacaacagaaaagataagtacgggtttagaaaagttgacttttcgtaacaagtccccgcgactaacaattgagagcatccccatgtttgttgcttcactgaaaaagttccagattgtaatcccgagtaagagggcgactgcaaagtgagggattgcttccccaaaacgcataaatcgtacaaagacgagatagagaatcaagaagagcaagataggtttgaggatagaccataagtaacctataacacttccttggtaacgaagtttaaagtcagttttaattaactctttaagtagaatttgatttctacggctgaagaaattcatttgttttttcctttgtatgcaaattttgtgatgataagtgtgcgaaaaatacttgtatgatagtttttgtttttacgcaaatcatatcggtcaagaatctgacgacgctcagcttttgattgatttaaaatattgacatagtctgtcactaacgccttgtctgtttcagacagagctgacagattttctgtcagtaatttttgagcttgtttttgacttgctgtaataagccaccaatatttttcaaaccacaagttagggtgtatccattttcttatgcgctttgcaagagtccttgctcccagaacatttgaatcatgctgacgataaaggtgagtgggttggtcaatataaaccagttctccaagtgctgctgccactatcgctagataccaatcatgcatgataatgtcatttgttgtttgccagagtttcgcaagttcatgattaatcacactcgcaccaccggtgaccgtattttctgtcagttcttggacaaggcttgtattagcatggtcagattgactacgaatcattgattctgatgtgacatttaaatctttatccgtcactttcaaatctgtgtaatacatgactggaattgtattatcgtgcttcttagcttcttctaacattattgtcagtttttctggcaaccaataatcatcttggtcagcaaaaaaatagaaatcagcatcattattatttattacgagttcatgaaaagatttaatgaccccaacattttccgctcgaatcagtttgattcggctgtcattattaataaagttttcaataatttcgcaagttccatcttttgaaccgtcatcacgaattattaaattccaatcagtatatgtttgtttttgaatactttcaatctgctcagcgacgaacttttcgccgttgtaggttgacattaatatattaactctcatctccgcctctggctaggttctccattttcgtttcagactcagtcttatcggtagaattaggaaagaaaagttcctcgtattggtcacaaatgtgttcccatgtatatttttcttcgatgatttcatgagctttgttttgtaatctttgtcgttcatctcctgtcaaattttcaacttccgacagagtggtcagtaaattttctttatcaaaataaatgacagaatcacccgctgttgttcggttaaaattcactcccaaaacaacattgacagctgttgaccacatggcctcaagcaatccagggtttgtccccccaacttcatgaccgtgtaaataagcaaatgcttgttcacgtatatatcttaattcgttttggtcatagaccgttccgacaaatttaatacgagaatctttatcaaattgtgttttttcacgtaattcttcaaagtaggcatttccttcatgatttgtaataatcacaaggtcacgtgtcgttttgctttgcatgaaagctttgatcaaagtttcataattattttctggcacaaaacgcccaacaatcagataataatcattaactctatattttaccagagtttccgattctgtcaaatctgacttgaatttttctgtcccataagcaattacttcagacttaacttgcccgtattcgctagtgagatattctttaattcctgtgttatccgaaataatcaaatccgcataacgcaccatttttttctcagaaaatttcagataagaacgcactggggccgcccattttgttcttttccactctaatccgtcagggttaacgaacaatttcccgccaagtttgtgaattttcttggcataatgtccaataaaaccacctgccgtatttccaagaatataaaaaattggtgcttcaattttttcttttttacaatatttaagcgccgcattaatagctaaaatatcataagcaatcacgcgagctggaccgattttgggtaccttaataacaaaacagtctgctccaagataatcaaaatgttcaccaggtagtgccatgtctgaattctcactttgacaagctacatgatattttatatttttattattttgatgtttgacgagttcttcaacaaatgtctcaaaccctccatatttcgctggtaagccacgactcccaatgataaaaacgtgttttttcatgtttttccttttatcccactgacttttttagattatcaataaatcttttttgattcagtggtttttatttagcctctcaaaatgagaattctgtcagtactgacgagcttgtgcaggtcgctgacagaattttcaattactttatatttaatgacaaagtcattattttttactaatctcgccttttaggccatctttattttcacgtaaatcgcctttttcaagcatacttgctaaagcatcttgccatgtaggaatgacaaaacctgtcgcttttgctttttcaagactcattgttgaattaaatggacgtttggcttttgctgggaatttactagaatctacaggcttaacaagcacatctgtatctttcaaaatttctttggcaaaatcaaaccaagttacgtcttcgccaggtgcagcatcatttgttaaatgataaaaaccaaagtcagctttttcattaactaaataaaccataaattcagcaagcgtacgtgtccatgttggacgaccatgttggtcattaacaacggtcaattcaggaaaacgagtcgccaaattttgcattgtaaagacaaagtttggcccatatgaaccaaaaacccaagcagtacgaacgatataatgttttacaccagaggcaacaacagcttcttcaccaaggtgttttgtccgtccatattcagattcaggcgcttttggtgcatcaactggccattcttgaccaattggcaaagtcccaccaaaaacatagtctgttgaaatataaaccaatgttgcacctacgcgtgcagctgcttcggccacattttttgtgccatccacattgattttttcatcaagcttgcgaccttcatcttcggctttatcaacagctgtataagctgcgcagtgataaacaagttcaggtttgtttttgtcaaagaatgtatcaaccgcaactttatcagtgatatcaagttctttggcatctgttgctgtataagccatgccacgttcgtcaagtaaatgacgcaactctgttccaagctgaccatttccacctgttattaaaatcatacattctccaattcttatttttgctgacagaaagaaactcattattcaaatctactgacaaacctgtcagcaacctttggactatgtgactctttttcctcataagatgaccttcactaattttgtagtctacagacatcttaggatttcatcagcaaattttgggcactctaattagaatgaatttttatttatccaaaaccttttgtgtttcagcatattttgcttcaacagcatctttttcggctttccaccagttttcgttttcacgataccagtcgattgttgcttgcaaaccagattcaaagtcagtatgttttggagtccaaccaagttctgtacgtaatttgctattgtcaatcgcataacgaaggtcatgaccagcacggtcagttacgcggtcgtaatcgtccttatctttgcgcatacgagtcaagatatcttcaagcacttctttgttatttttttcaccgtctgcaccgataagataagtttcgcccatacggcctttagtcaaaattgcccaaacacctgatgaatggtcttctgtatgaatccagtcacgcacgtttttaccatcaccataaagttttggtttaattcctgaaagaatgttagtaatttgacgaggaataaatttttcgatgtgttggaaaggtccgtagttatttgaacagtttgaaatcgttgctttaagaccaaatgaacgtacccaagcacgaacaattaaatcagaagccgcttttgtcgaagaataagggcttgatggattgtaaggtgttttgtcagtaaatttttcaccttcgccttcgccatgacctggcaaatcttcacgataaggtaaatcaccataaacttcgtcagtagaaacatggtggaaacgtaaatcgtatttacgagccgcttgaatcaaagtataagttccgataaagttagtttggataaattcatcttgagacttaagtgaattatcattatgagattcagccgcatagtgaacaattgcatccgctttagaagccacttgatcaacaatttcagggtctgcaatgtcacccaccacaagttcgacacgtccgctgtcaaacaacatattaatgttgttgacattccctgcataagttaatttatccaacactgtgatatgcacatctggatgattgttataaacatagtgtacaaagtttgagccaataaatcctgctccacctgtcacaacgatatttttaaattcagtcatgttttttcctttttcgattatttattagtaaatcttgaaaattaatccactcgatattctctgacaaattttgcttttggcacagcttttaaatattttccattgaaaaccaaataatcgccaataggaactgtcattttgagtaaacccccgacattttttactgacagcgatttgtcattccaagaaaagcccccgtcagtaaatgcttgattagcccaacttggtctgtcagtatttttttcaactttccaaaattctaaacgttttttagttcgtaaatgtaaagcaaacattagagttcatcagccttcaaagcttttacatcttttaataatggatgatttttatcagcttcagaaacttcagcattttcaacatcttcccacttaattcccaaagttgggtcagcataattcacaaaagcgtacttaggtttaagttcaagtgcccagtaatcattaactaaatagctataagaaactgtgtcagacaaaacttggaatccattagcaacaccacgtggaacaaaaattcctttacttgcatcaatgactgtttggtaaacatgaccaaaattttcgccttcgcgtaaatcaacccatgcgcctaaaacacttccgccatcagccacagaaatatacttatcccaaggttcagcgtggagaccacgcaaaacatttttacgagaaaaacttacattgttttgtaatttttcttcggcaaagaagctttctggaaagccaagtggcatcattttttctttttggaaattttctttaaaccatccacgattatcaccatgaactgggatatcaaattctaacattccaggaatttggctgatttctcgtgcagccaatgttttttcaaaaaaattatcagtcatatttttctttctaatcactattttcaaagtttattcaagaacaacgctaacttcattcagtaactcgtcttttttcgcttttgcattgatgtgcgatttttgaatgtgttcgagcgttaggttattaggtacatctggatgatgttttcgacaaaggacataaagtccatcagctgtgcgatgaagtccaattcgatgacaacctggtgcatgacattttagtcttcgccaaacaacagcaaagacaccaaaaagtggcaaacagctgaaaaacccgccccaccacgctgaccaacctgcgtcagtcacaccagtaaaccacaaaaaccattcccaaatattttttagcattgattgtccttcttgtactttgacaactttactttaataatgactttttagtcttttccaatcaaacgaagcaagtattgaccatactcgtttttcttaagtggttgcgccaatttaagaacatcgtcagctgtaatataacccatacgataagcaatctcttctaagtttgccacttgcatattttgcatccgttgaactgtttcaatatattgtgcagcttcaagaagagattcgtgtgttcctgtatccaaccaagcaaaaccacgtcccatcaattcaaccgacaaatcgccacgttcaagataagctttattcacatcggtaatttcaagttcaccacgaggtgaaggttcaatactttttgcaatttcaataacatcgttatcatagaaatacaaaccagtaaccgcataatttgatttaggttcttctggtttttcttcaatagaaacagcattcatatctttatcaaattcaacaacaccaaaacgttctggatctggaacatgatatccaaaaacagttgcacctttttcttttgcagctgcattttgaagaattttagacatgccaggaccgtgataaatgttatctcccaaaatcagcgcaactgaatcatcaccgataaagtcttctccaataataaaggcttgagccaatccatctggtgaaggttgaacagcatattgaagattgataccaaattctgaaccatcttgcaagagctctttaaaacgtggcgtatctgttggtgtcgaaataatcaaaatatctttaattccagccaacatcaaagttgacaatggataataaatcattggtttatcataaataggcatcagttgttttgacgcagcacgtgtaagtgggtaaagtcgtgttccagaccctcccgctaaaataatccctttcatgaaaggacctccataatcataattaatcagtatacattataacacaaaaactttctcaatacacaaccttctatggccatttagcggttaaaaggttgataaataagcgtttctaagtcttttattaaacaataatgacaagattttacctattaaataagaaaagtctctaaataaatagagactggcatatcttatcttcttggttgggctaccaaagccgattggatgttaaattgacgtttcaagagccaacgtactccgaaagctacagccccaacaataaccaaggctactgcaggaagttgtaaattgattgaagttggtataagtccagagaaaatcgttactgcaatccaaaggagtactgaaagagtcgttgctgcaaaacctttccagttccaacttctacggctgttgtcagctttaggacggtaaaagtaacgatacatcatgtacatcacaagtccagcaactgcagctgaaagaattgttgtaatcaatccataaaccggtgctttagaagtaataagtgcggttactccatttaaaagagaaataaatcctaagaagagtaagctactatcaagccacatcaaaactggattttcatttttttcactgacaggtctgtcagcgactttaggttgatattgagaaacaaattcagtcggtgcacccaataacttacgagcaataattcctgatttttgaccttcaataatctgtggaagaatatcattcaaaatttcttttacttcttcatctgattttccgaccaaaatcagctgtttcgttaccgaatgaatgtattctttatttttagcagtgagttcttcgattaaattttccataacctcattttatcagaaagcccgaaaaaaaacagcaaaaaatggacaaaagcttgatttttttatttgaaaaatgttataatcaacaagtatgttgtttttaagcacataaaaattctaatgggaggtaaatataatgtctaaagaatgttattttactggtcgtaagactgtttcaagtaacaaccgttcacacgcgatgaaccaaactaaacgtgtagttaaaccaaatcttcaaaaagttacaattcttgaaaacggtgaactcaaaactgtctgggcttcagctaaagctttgaagaaattgccagcaggcgtagaacgcgtataatttttgttttttgcaaaacacaaaaatatcctgtcatctgacggggttttttatttactgacagctttatcattaaataaaatcgtcactactaaattctgtcagcgctgacaaatgataaatttcaaaaagcagttcataagagctgttttattttataaaagtatgataaaatgagtaatgatatttaaataatatggaggaaagtgccgtttgtcagtcaatttttctttatttacaagttttgtaaatatattgacgacggtacagctatgaaaatgagtgttattatcaacaaccaacatgggaatgtcgatattgctaccgaagtcattgcaacagttgtaggtgcttctacaactgaaatttttggcgttgtcggtatgaccagcaaatctgctgttaaagataatgtacgcagcgttttgcgtcaagaaaattactctaaaggagttgtagttacaacggctgacaatgaaacttctattgatgtttatgttgtcatttcttatggtgtaaaaatcagcgaagttgcaaaaaatattcaagaacgtgttcgcttcaatatcgaaaatcaacttggaatcacagccagtagcgtaaacgtctatgtacaaaatgtgaaggtggttgaggattagtgtcaaatatcaattcaactaaatttcaagaaatggttcaagcagcggcaagccgcttgaatgaacaagccgaatacgtcaactcgcttaatgttttccctgttccagatggagacacgggaacaaacatgggcatgaccattactaacggtgccaaagatgtcgcttctaaaccagccgaaactgttggtgaggttgctcaaattctttcaaaaggacttcttatgggggctcgcgggaattctggtgttattttaagccaacttttccgtggatttgctcaatatgttaaagattatgaagaaattgacggaattcatcttgcagctgcccttcaaaacggggtagaagtggcctacaaagccgttatgaaacctgttgaaggtacaattttaaccgtttctcgtggtgctgctgagttagcaaaacgtaaaactgacgaaactgatgatgctgtggaaattatggaagcagcacttgaaggagccaaaaaagcattagcaatgactcctgatatgcttcctgttcttaaagaagttggggttgttgactctggtggtcaaggtctcgtttatatttacgaaggctttttgatggcacttaatggtgaattcgtaccagaaacacctgttgccgaacttggggcaatggaccgaatggtcaatgttgaacacgaaagtgtcgccaacgtttcaacagcagatattaaatatggttactgtacagaaatcatggttgagttaggcaaaggtccaacttcccgtgaaagttatgaccatgataacttccaaacttatcttgcaggaattggaaactcacttcttgttgttgatgatgaggaagtcgttaaagtccatgtccacactgaagatcctggtttagtcatgcaagaaggtcttaaatacggacgtcttgtaaaagtcaaagtcgataacatgcgtctccaaaacgaaggcgttgctgaaaaagaagcgaaatcatcaaatgtttcaacttctacttctaaaaaagactggggcttgattgctatcgctgctggtgaaggtttggctgatattttccgtgaaatgggtgttaatcacgttgtttcaggtggtcaaacaatgaatccatcaaccgaagatatcttgactgccattgaagctgttaatgcagaaaaagtaatcattgtaccaaataataaaaacatcttcatggccgcaaaatctgctgccgaagttgctgaaattcctgttgaagtgattgaatctgcaacagttcctcaaggatttacagcattgttgagttttgacccaacacgttcaattgaagaaaataaagcggccatgaccagtgccctttcagatgttcaatctggttcggttacaacagcaatccgtgatacaaatgtcgatggcattgaaattcataaaaaagatacacttggaatgttgaataacaaaattgttgtgtcaactagaaaaatgaatgatgctatctttgctgtcttcgatcaaatgattgatgaagatagtgagattgtagcaatttatattggtgaagaaggcaaaaaagccaacgctgaaaaaattgcgaaagaacttgagaaaaaatatcctgagattgaagttgaaatccatgatggaaaacaacctgtctatccatatctcttctcagttgagtaaaatataaaataacaaaaattctgatgtcaaacatcagaatttttcttttgcttataaaaagttactgacaaaatacttttcattgttttgagtttctgtcagtaacttttttatttaatcagcggaattatgaaaaatattttatataatctccgtatccttctgattctaattggtcaaaggggataaaacgcaaagctgcagaattgatacagtaacgtaagccccctttatctaaaggtccatcagtaaaaacgtgacccaaatggctgtcagcattactagaacgaacttctgtacgctccataaaaagagacttatctcgtttttctttgaccatttttttgtcaattggttgtgtaaaggcaggccagccacatccagattgatatttatcaagacttgtaaacagtggttctccactgacaatatcaacatacaagcctttttcaaagaaatcatcaaactcattagtgaaaggggcttctgttccattttcttgagtaacacgataagcaagtggactcaatttctttttaagttcttcttttttcattaactttcctttcttgtaagtaattattgattgtcaacccttttgacattggtgtaaactaagttgacaaagagtttacactgctgagttttcagcgcaatcaaaccctataaaaatcaaaatcactctttgagtaagcaacataatatcaaaaaaataggcttatttccattgaaatcacttacaaatccctccttctttctttttttaaactctaaaatataatgttacttttcagaaaattattgtatcgtactttaaattttgatataatcataaatgtaaaatgtacttgacattttctgtaatcatttgatcccaggaggtaaaatgagaactcttaacaatacccatattgggcaaatttactatattcataaagttattggcaaaaatcaaagtaaattacgtgatttaggcctgatatctgataaaaaaattacacttgtttctgctgatggtgaaaattcaatcatcaaaattgacgagatgcgtttagcattaaattcttcttttttagaacaaattttcgttaaagaagaacgttctagcgaagaaattattggcttagctcatttgcaagttggccaaacgggtactgtccgtatgatagacgccacttctgatatacgccgacgtttaatggatatgggaattacccgaggaacaagcgtacatctgcaaaaattagccccgcttggtgacccacttgaacttcgacttcgcggatactctctttctttgagaaagacagatgccgaaaaaatcaaagttgttctcgaacaataatgttcaactcaatctatttcacgttaattttactaaaaacatctttctttaaagtacatctttagtaaatgataacagcccttaataagaaattacaataatatgaaaataattgctctactcggaaatccaaatagtggaaaaactagcatttttaatcttttaactggttccaatcaacaagtaggaaattggccaggcgtcactgttgaaaaaaaatctggaatctatcgaaaagataaaaatgtttgtattcaagatttaccgggtctctactccctctctccttactcgcttgatgagcaagttgccagagattttttggtcaaaaccccacctgatgctctaattaatatcgttgattcaaccaatctggaacgttctctctacttaactttacagttgatggaatttggaattcctatggtactcgcgctcaatatgagcgatttattagaaaatcagggaaagaaaattgaccttgaaaaactttcttacagtcttggtattcctgtcattacaacctcagctattaaaaacaaaggtttagatgaggtcattaaagcagcactcagaagtcctgaagttcaacctttagattatgaccatcgtcttgaaggagccttgtcagaaattagcaaagtcactggttttacaaatcgctttgaacaaattaaagtttttgaaggagaccaacttttactgacaaaattatcagcagaacaactagatgaagttgaggaaattgtcagtatcactgaaaaattaatgactgatgaccgagagtccattattgtcaatgaacgctacgacttaatcggtcactttgttcagctttctgtcagccaaactgaaacaggaaaagtcaatctgacagaccgaatcgaccaaatcatcactcacaaatggttgggacttcctatctttgtttttatcatgtggctagtttactttatttccattcaaactgtcggaacagcggcaactgattggcttaatgatgtcttttttggtcagtggcttcctgacttgattgccaatggaatgaatgctttagcggtcactccttgggttcaagatttagttttgaatggtgtagttgcagggattggtgcaattttaggtttcgttcctcaaatttttgtcctctttttacttttaggaatccttgaagattctggatatatggctcgggtggcctttgtcatggaccgtatctttagaagatttgggctttcgggtaagtcttttataccgatgctcatcgcttctggctgtggtgtagccggaattatggcaacgagaaccattgaacaagaacgggaccgaaaaattacgattatggtcacaactttcatgccttgttctgcaaaattaccaatcatcgccttagtttctggtgccttttttccccatgcttcttgggtcgctccaagcgcttatttcctaggaatgtccatgattattctctctggtattattttgaaaaaaacgcgaatgttttctggagatacatcagcttttatcatggaactccccacttatcacttaccttatgcactgaccgttttaaaatatgcttttgaccgtgccttttcttttgtgaagcgggccggtacgatcatttttgcgatgaatgttttgatttggttcacttctaattataattggacattagcccatgttgatgctggtcagtctattcttgctgatgttggtaaagttgttgcagtcgtctttgctccacttggttttggagaatggcgtgcaacagttgcgacgattacgggattaatcgctaaagaaacgattgttggaacaatgggggtgcttttcgctcataattctggcgacagtcatcaactttggtcggctgttcaagcaacttatactcctctttctgcttattctttattggttttcaatctcctttgtgccccttgtgtcgctgcaatttcaaccatttataaagaaatgggagatgtccgatggactttacgtgccgttggtttccaaacattagtcgcttatagtatgagtttcatcatttaccaattgggcagttttttcagctcacaaaactttgatgtccttagtttagtcgctctgcttgtattgttggttggtttatattttattttcagaaaaggaaaggatgtttcctatgaacttagctagtatcgttatcttagcaattattttcatcattactggatttgccatctttaaaactgttcgcagcaaaggggcatgtgaagactgtaatgttaatacttgtccagttaaaggagccgcagctctgcccacgtctaatcaagcttcgacaaataaaaatacagagtcaaaacatgattattgtaattaagagatagcttttgtcagcaaataaaaaaaactccaaacataattattggagtttttttatttaaaatctaatcaaactaataaagagcaataaaacctgaaccagttggaaaaccattagaattttgacggaacagataaaagtttctcttttaacttgtttttgaagataaggctttgcaaattttatcattaaaggaacaatcaataaaatcaaaagcattatcggagaaagtaatcctaaaattactgatacaataatagcgataaaagacaaaattaaagccaaagtccaccaaatgagtgctgcttttttcccaatataatgcacgattgtaaaacgatgattggcttcatcttcttctaaatcacaggtgttattcgctaacatgagattagcgataagcaatgtattgggtaaagcaatcaagaagctagtcgcaagattagcagatgaccaaacaaaggcctgcgaactattaatatatacacaaatgagaaagatgatataacccattgttaagcctgagagaagctcacccacaggaagggatgacaaaggttttggacctcctgcataaaagattccaacagcgtaacaaagaagacctagccaaaaaactgcccaacccgtcatcaatgccacaatgattcctaatgctaaacttccaaaaaagaaaaaagcaagtaaagctttaattaaagccattgacaggttttcacgaccaataatatttgtatttttttgataatcattggtatccaccgcgttatgataatcattataattatcccaaatatcaacaaaacagttaaacataaacatggcaacaaaataaatacttaatgctaataaattcagtgaatggtaatggtaaagcgagtacgaaaggcccagcagaaacggaaagaccgaagccgttttagcttttaattcaatgagttcagcgaatattttaaaattcattatttcctctttaatgtgatttattgacttttttgattgatagttgaactttgaataagtgataaacatggttttaaagtctcattctatcatattttaatataaaacaacttaaatctcctaattaattttattaactaataatatcattaattaaaagaaaaataaatcaccatttctaacgtttttactttttacattacttcataatacaagtatatcagcaaaaacaagggtcgaggttccgtttttaggcaatttcgtgctaatttttgtccaaaaatatgccctaaaaacagtgttgcatttgtcggtagatatcatttctaaacttatagaatattgtcttagcttttttcaagccaatatcttcaattccttcgatatctaaatattgcattacttggtaccagtacaagccagcatatccactatattttagctcaataactcttttttcatcaggaatcaaaggcttaaaccagaagtctaatatctctagttgctccttaagtttaaggtattcttcgtcactctcaagcttttcttgatttataacatgactcaactgttccgaaccaccagaataagctgtacgaatgcctaagttatcaactttttgcttataaagatatctgctttcaattgattttattctggcttcaagtctgccattaacgtaatctccaataattctatctaacttatctgccattcatcaaattctccttttgtggtataattaagttagaaaacttcttgccgaagcccattgccgtgggcttttttgtttaattaattaatttaaaatataatgatattagaaacgcaatcccaaataatatattaaaggttgcagttccaatacttattggacttcttggctttccaattgcgtaaggtgtaatgaacaggccaataatcattagtaacacgtaggctatgataattatatttgcaatcatttcttttctcctttaatccctgcgtcagtaacaataaatgtatcgttatctcccatatagactgaaatcttatttccagttttattatcggttaaatcaactttacgaccagacattttataagaaaatgaacctgtatattcataaaatacatctcccttataatctttaataatgatagtacgctgttgattcatatcatattcaattttgagattcttcttggccatgttatatgacgatgaattagtataattatgataatatgatgaaccggatagtccaactaaagttaacgctactaaagctactaaaacaaaaactccataagcgacattattttttctgttttctcgtaatactgaacctagaataaacaatcctaaacctagtaatactccgattacccaaataattgtccagataatccatgacgttggtgttggtgtgatataaaacatttcattttccctccagttgagtttagcgagttcctagctcagtatgatataatacgtatgaccaaaaataaaatgaaaaagtattattttttacatgcgaagctcgaacctggtcaattcgggcttttttgtttacttaatatcaattccaagttctttagccaactcattgataagaaccgtattatcttcaatattttgctccaacaaagggatgagcgttccaacattaatcttaacggaacattttaaaactcctcccaagtttaattcaaattttgtatccgtagatatatgattatttttaaaatcatctaaaacaatcttttgatttctaacatgatgaatcaatttttgaagcctatcaattttagtttgtgttttagcgatttgttctgaaaaatcaacagtaatttcttgtggcatatttctcctccagttgagtttagcgagttcctagctcagtatgatataatataactgaccacaaaaaaatatagaaaatattttttatcacacccgctcgaatttggtcaattcgggcatttttattttggaataaattattggtctgtgtgctataatggtgatgaccaaaaataaaaatcgaagtaatcttcagtatttcgctcaagctaggtcagcttgggctttttttcattcaatccctccccaccagtcattgaccagcgatattagtttgtcggtcattctcaaacctccccagtgctaccaaatccgcctgtacgctttccatttgcgttgtcatcgtctattgtaaggtatttgacaaacaccccttgcattattctttgacctttagaaatggttacaggctcttttgagatgttcataaataagcctttaaattcttgcggatagtaatctgaatcgataattcctactgaattaatcaatgcaatgccacgcttaactggattacttgaacggtcgtataatttcaatacttcatcatctccaagttgaacagctagcccagtgcttaccattttaatttcatcaggttgaatcgtaactgtttcacttgctgaaatgtcatatcctgcgctatgttttgtcgctcgttctggaatagtcgcatttccgtctagttttttaaatcctcttgtcattctccgtcctccacaggcacatcagttctcaagtatcctacttcatcacaccattttaagaattgaactcttagctcatctggaataaaagcaagggtgacaactttatcactagcagaccaagaataaacagcactaccgtttctttcagcatctttttgcatgttttggacagtcgctcgaagaacatcttctgttataactttccgtttaaggctcatcatcccgtctttatttattgttgttaaataaatatcatttgaaatagctgcatttgctataacaatatttttataaacttcgctcatttttctacctccacaggcacagcaaactgccagtaacgctcatcaattgacttgatttcttgttctgttaattttaatgcataatcttttccttttgtaaattctgagattattccactttccgcttttgatacgaaggttgaatcgctggttgaatcgcttaatccaaaaacttttggtaaatcaatatagaacagctgcggtttttcgactgtgtagccgatatttcgagcaataatatatttttctggattatttttaacccacaatccggcttcttttaaatctttatcattagcagtgaatatatccttcaaagtttctgctatgctgttatcaatttgttcatcccatgcaattgcgtctgccacacactcaggcacgactggcagggcttgctgttggagtttcagcttatcttcaagaaggaatgcatattctttccattcttttaatgtttgagcaccttctgtaaattttttagctaattcagtgaaatctacatctcttttagaaaatgggtcaatatatgctttttttggtctttttacttcttcttcaaacttagtcatttttcgtgtcctccaaataaatatttaaatcgaattgatttttaatttcagtttttttgattttatggaaaaggaaacttgcagaaaatacttcgatatcatctccaaatttaaaacggataatcatatttccatagcaatcttttacattaactgtcattccttctgaaattgtttttagtaaactttcaactgtcatttcttatctccttccaataattcagggttctcatagatatttccgatgacttcataattcaatttatttgtactcgcccagaattcttgccgatataacctatttccttcaaaaataattgaatatccatattttggagaatattcaagataaccgattttgtcatcaggagctaagaatatagcattcagttttaaaatgtcaccttcataaatttcaacgccatttttatcttttaatcctgttgactgcataaattcaacgtcttcatcagcgccagtacagaaatggtcaaaacgataattaatgctatcgtcgaaatattcaacctctccataactcatacgctcatcttgtttatcccaagctcttaattttggtatcatctagctgctcctctcccataaaaaccatatcaacggtttcgttgtaaagatcgactccagggctattgaatggaaattcatcacattcaggacaagagatactatctactaaatcaggaattgagtcagtgaattcaagtgcagtaataaaagttggagcgttgatataatatgcttcttctccaccgccttttatttcagcttgataatattcttcactttcataagcacctaaacttactgggtgaagttgttgagtaaagtaatggcaatttacatattcaatttctttgttgcaatttttacacttcatctcatccctcacttcacaactctgtcaaagagttcacatgcatggtatcttccatttatttttacaattctaaaatcatcacgcttaactgattttttagtgaactggtctttttcaaccgttatgtatttgtcagtaacttcgataacttttaagaattttgtgtcgcggaagcatattttatctccacgccttatttcatttttgctgaacatattactacctcatattttagcttctaagcgcttttgcctagttcgtgataaattttatccatgaaacagtttaagcgctcaatgtaaccgtaattttcatgaattatagctatccaaacacaactaatgattctgtcagttgcttatccataaaattaaacagttgattcaagtcatatcttttccgttgttgaaaacagatttaatatctcgataaatttcaaccagctcatgacttcctttagttctaactgtgatataaaccgaattacttccataaccgtcatatcttgctttcttagctaagttaaacaatttaacagttggtatgattctgaatgctgtcattcaaacctcctcgatatcaacttcaagacgataagcttttgttccagaaagtccgccatattgatattttgtaaatttaactacttcgtgattatcatctgaccaaagccctgattctgtaaagccgtccataatcgcttttaaggtcggttgtaagttgtctgggtcacttcttcgtttggttggtgtaaagactgtcagcgtaacgctacaagtccgtgtgctatcaaataacggcaatttctttaagctgtttaatggatttcgcacttgattaaaagtaattctctttaattcttgaattattttcgctttttggtggaaatgcatcctgtcattagaattcaaaatcaattttttactttttggaacatcttttgatttactgatagcccgatataattcaaattcaaacttcactcgcttctccaaatctaacaatttcaggcatctgagccatgcgattaagaataaaaataatctcatgctcagatttctctgccagcttctgctttttaattcttccgagtgggtaatgttcgttttcccactgctcaatgattattgttttcattgcttctcctagaatggcaactgactaacacgcttatctttaatattttcaaaattgaatgctttttttccaatacctctgaacaaacggctatatgtcctgttatgatatttttttcttatttcatcactttttagattagtggtaataatagtcttagtccttgcatccaaaacttctgtcagtaaagacatcgaccattctgttattttctcgcttccaatatcatcaataactaataagtcagtatttctaaaaacttccatgaagcattcagttgaataaaagctgtctttattatcaaaactatctttgattaagtgaagaacctctgaccaacttgcaaaaataacggttaaatcagtatgctgcaaacaatcttttaagatgctcatggctaggtgacttttccctgttcctgctggcccgcttactacagtatttccctcaccgccagtataataatattcagatacttcttttgcgaacgccaaagctctcttttcttcgtcagttactgcattaaaattttcaaaacttgctttttttattgtcatatctctcacaatgctattgcgattaagccttttgacaaactcagcttttttcctacgtttaatcacttcttcagtctcacgatagacaacatcggcataaccacagttcataatcaaaaaaggttcatgtccactcaatgctgttttttcgttattatcaaatttatttttctctttaagatattcgtagaatttagaataactttttgaaacttcatcgctagtcatcttattatccgaaatgaatttttctatttctggacaagcgataactttatcagtcattgcattaaatttattcatatcaacaaattttccaataacatctccgatactttccatttcttcctcctaaaatggcaatccaagatcatcataaggctgtgcttgttcttggcgcattggtgtctggttaaggtaattatcaaacttcgttccgaataaagttgacggttgtaaatatttttctgctggttgaccatttattgttttgcctgtccagtcagcaactttattatcaacgaccttcttaaagtcatctagtttataatcctcattccacctcgctttgataaaacgtttgtgagcttcagtagttctaaaacttcgccctattttttcattcaagtaagaaataatttcagaatatggaataacatcgtcagatttatctgacatagtattattattctttttcttattcttactcttattcttatcttcttctgttgcgtcacgtgacgtcacgctaacgtcactattttctataagcttcttacgctctcgatacttcttattacgctcagcatttaattttctgattttctccattccatcaatgttttggtgcttttcccaattactgataccaatcatgttgttatcatatatctcaatcaacccaaagtctctgaatgttttaagagccaatcttacagtagaaacaggcctattacacaaagcagaaatcatttcatcagtatatggaatatgattacttaaatagacaagcccagaatcatttgtttttcccgccaagctaagcaagtaaacccatattctaaagatcgcatcattttctggcatttcatcaatcaacttcattttttcatcatcgaaaatattaacgctcaatttaatccaactaatttcaaccattcgatatcctttcatctatatttatttcaagttttatttttcaaattaaaagctggcaatgagtgtttatgtgcaggcactgaatactcatggactttacggtcgttacgccaccctccagcacttgttagaatggtaggtcatcatctgaaatttccattggatcacttccaaaagaatcgttattttgtggttttgcagctggattactaactcgttcaccatttgcttgattactttttttctagtacttggaaattacttgcgacaacctccgtaatataaacccgttgcccttgttgattctcatagttgcgagtttgaatactaccagtaactccaattaattgacctttatgagtccaattggccaagttttcggctgatttaccccaaataacacaattgataaagtcagcttctctttctccattagcgtttttaaatgctcgattaactgcaagagtaaaagcggcaactgctttattttgtggtgtatatctaagttcaggttctttagtgattcgccctactagaatgacattgttaatcattttgttcttccttttttatatctacgaatttttcgatatcattgtatgcttcatcaagtggcatttttagccaatcattttgttcatcaatacttgccccatagtttttcccggcaataatagccattttattaactacagcttgaagctttttctcatcaaattcttttttatctttaccaacaacatataatttaggtggagttggtacctcttcttcagtaaagtcagcttttgtattttgaacctttgaattctgaggtaaagcccaacttggaagctgtggattcttccaccaaaagttcttttttgaatttttatcaaaaactttgttccaaccatcagtcttttcaagtgatgtttgagcaaaactggtaggtaagtcatataaatatctacctactccccattggacagctgctctcttcattgatccagataatccacctttaactgcttcaacctgagtattttctgcgccatcccatttggtgacccattcgtctccaaacttaacagatataccacataatgtcccaccatcaggagctgttttgaattcgttcttccatccggaaattccaaaaacttcatcaaaacgttcttgaactgcccgattatccatataagcaagaaccatagcccaaggtttaccttgtttagaaaatcctgattgttgaactctccaaactactcggtctggttgcaaaggtttttgtaaggcaagcatttgttcttcataatctgccataatttacctcacgcatcccatttaattgactgggcttttggattttcaacaatataaggctggatatcctcataaacagattctccatactttttctctaactgattaatagtcaacggaacaacactatcaagcccatactttctaattaaagccattttagcagcgttatccattgcaagtactcttgtgtattgttgttttgaataagagagtcgtgaaaatagttgaccttcatcaaggcgtttcttgacttctttttcggcttctttttttaatttatctattccttttgttgctgaaagaagattagttaaggtactattatcaaactttttaagcatttcaggattaagttgaagaacttctcctgtttcattgtccaaagggactaattgtaattccataatgttctccgtttcaaatttctaggcattcgtggtataatttaagtagaagttttggcgaatttcctacttgctctgcgtgccatgcagggcttttttagttccaaacttttttccagtctgaaatacattcgttaagcattgcagctttatcattagcaagctcttgcttattctttttgcgtgaagtcatataaagacttccgtctggtcgttcccaagtttcaaagaccactactccacgattttctcgtttgattaaatcatgatagatttgtccaactggtgttggaattagtcgaactttacgaccgtttatgattgctgtttccattaatttcctttctatgtatgtgttttaatcctccgagtgctataattactgtgagcagatatttgcggtatttgcttagttttatggaaaggaggaaagttgatgtctgttaaagtacatttttctaatggtgagtcaatcgttatttctgaagaaaccagaataagcgcttggaattcattagataaagatcctgatggatattatgccgaaggagttttttcaggttctaacatagactctccagatttaggaacatcatatcaacatattgggctgatgggactttttggtagtactgactggtttgctatcggactagattttaaaactacttataaaacttcagcaattgtttcgttagaagaaacaccgtggtaatctaaaatattatctattgataatttgataagctcgtttgtggccctatcagctgtataaaacagttgctcttttagccatttgcgagcttttcttatatcaccatcattttgcttcaaagcaagatctgatgttttgttaattatttctttatagttgttagctaacttttctatttctttattcaaaatctctcttttctagcggagtaccgcatttaatttcttagcaatgagctttattgctctaatgttttgtgtgattaagtcgtgtaccagatcaaacaggatttcgcccgtttctgggttgactatgtatgtgtaggtcatgagaacctcttcttatttgataactgattggcgctttttaagttcttgcttatactcaggagtatttacaaactgcatgaagtctctgatttctttgtatcgaaatctccgtccattcatgaaaataccagacttaaattgtggaaatagctccattgcttttctacgtcgataaactgtttgatcatggatggaaaacttttccgctacttgctgagtagtcaagtaatcatcatctttatattccatctgatttcctctctattcttcaaagtcaaagctagtttgtgagttcaatccacgaatttcaagcgttgtattgaatgatggttgccacatatcaagatattctgttgcttcgtcataacggcttaatggaatatcgctatatttaacaacatcgaagcgattgttcaaatctttataaaactctctgaataccttagctcctaatttcttatgagcatttgaatacttaccgccagtaaacatataaactttgcttgctactttcttttgcaaaactttagctttatttgaaggaagtccgaatcggtcagtcaaatcaagaactgaattttcgatttgttcgacttttttattcaagttcacgtttccttgagcgagtaatgcaatttgttgttcaggagtttgcggtaaaagctgttgtttgagttctttttcaacttcaatgaaatattgacgggcttgtttccctttttcgttacgttgaatcatggaaatttcttttgccacgtcaagtttaagagcgtgattgataatagttgtaaatggatttctaggattattggtttcacttttttctgaaaccaatacaaagtcaatgttttcaatgaatccatacttgcacatatctttgaaccattgcgtgtatggtgtttttactcctaaaaattcatgtagttcacgaccgcttactacttggtcgttgttttcgttttgtgtgattgtaattaattgattcatttttgaatcctttttaactagctttatacacattttgtgtagttttgtcgtaaaaaatatcattcaatgatcttggaccaatgaatggtttcaggtagttgcggatcgcaaacatttctgtcgctctccaatcatactgacctaattctttacgtctatactgttcttcgctcaaaccaatagctttggagatttgtttttgcgagattttataatcttttcgcagagcaattaattctttttctactgccatactggctcctttcttttaaaaaatttctgcatacgcagtaagggaagttcaggaatcgaacctgttcgccagtcttccctgctcattgtgagcgatatcataactccgtgctataatgtaagtgactaaactaaaaaaagattttgaaactgtcaatgataaaataagagatgtggctaagaaatatgacgcaaatattaatcaaaatgaatagtataagcacaagcgctaatctattaatatattcatgaatagttgaatctttagcaagtcgctctaaagccatgcgttgtaatagatataaacatatcatttctaaaaagaaattttctgacatacattatacgactctttccgcccctctgggggctttttgttttgtcagttcaactgctgctttataagcgtttgaccatttaaataactgaggcaataaagagtctttgataaattgaacagaaaaatcttttaacagttgttttttgtaccactcaacactatgctgctgaatagtttctctgtaatgcgtaactacttgttccattagaacctccatttgcctgcgagggctttttatttgccaaacttgctacttacgtcgcggtggatacgtcgtgtaccgtcatttgagcctgttccgtctgccgtactgaatgctccatgtttgttcgcttgtttgactttatgagttaattatactacacaatttgtgtaaagtcaacaaaaaaacagtaattactaaaaaaagtttgcaaaacgtgtaattttcttttataatacatatataaaacttcgaaaggttcgatatggacgatagagaaataaataaatttgtcggaatgaaaataaaagagtttcgcaaaaataaaaagttgacccagcaagacttagctgatttggtcggagtgaaaaacagcgcaatctctaattatgaacaaggaattaggattcctaaaagagatttcttattcagggttgcaaatgccttgggcgtttcaatagacgaattttttcctatacaaagtgaagaaacatcttctactctatccgaaataaataaaatcagttcacaactcgaagaaacaagacaaaaaatagttttagagactgcaaatcatcagttagatgagcaaatcaaaaagaaacgtttatctttcttctctaataaagttgatttcgataaaatcagcaatattgttccttatgaccctaataaagaagggtacgcccctgttataggagaaatcgcagcaggaactccaattctgtccgaacaaaattttgaaggtatgcgccctgtttatggtaaatacgctggccgtgatgatatattttggcttagagttaaaggcgaaagcatggaaacagaaatacatgacggttctttcgctttaatactgcaagaccctgacctttcagaaggttctatcggagctgttcgcttcatagacgataacgaagcaactctaaaatgcgtcttctatgaatatgatgaaaatggctatcctctctgtttaagacttgaaccattaaaccctgattatccgattcaatatgctgatgagtacaatccagctgtaatagaaggtagattagtcaaagtagaacaagattattaaaaaaagcccaacctttgattaggtgggcatttttagaaaggataaaattatgtgggtagaagatttagctaatggtaaatataagtattgtgagcgctatacagatacaaaaggcaagataaggaaaagtatcagtaacactagataaaaatagctctagggcgcaaaatgaagcttctaggctattgtataataaaatagatgcaaagcttgaaaaagaaaaacaaaaaattgaagatgagcaaaataaaatagcttctatcactttttgggaagtccaagatgagtatttttcaatttatgaagaaacagtaaaagctaaaactgcctcactaagagatacagcaaagaaaaaaattagaagtttagttagtgaagaaaccttattatcggatgttaactctgtttttattttagagatattggaaaaactatattacaaagaaaattattcttattcttatatcaagacacttaaagcttcttttaacatggttttagattatgctatatcaaaagaatatctagcagttaatcctatttctaatgttaaaatcaaaaagaaagtcttaaccttagaacaaagggaaaagaaaaaagaaaaatatcttgaacgtagcgaattaaaacaggtcataaaagatatggcagtaattgataaatcaacctcattattaattgaatttatgtcacttacaggtctaagatttggagaatgtgtagctattcaaataaagaatattgagaataatgttttacatataaatggaacttgggacagcgtttctaactctaaaacaacaactaaaaatatttattcagatagaaaaatcacgctacccaaaagatgtcttcaaataatcgaagaatatcctttaaaatatccaaaggataaaataagcaaagataattatatatttatttataaaaacaataaaccatataacatttctgttgtgaatagcagactaaaaaaaataaattcagctaaaaatttaagtacacatattttcaggcatactcatattgctttattaactgagcttggaatacctttgaagtctatcatggaaagagtgggtcataataaccctcaaacaactctttctatatattctcatgtaactgaagaaatgagcaaaaatataatagaaaaactaaatgaaatagacctcttaaattagaggtctattttttaaaaaaggggcagaaaaaggggcagaaatttgataatatttaattatctttgataacttttaaaaacaccataactactaaacacctttatttacctagcttttgataacttttcataacaaaagctattctatgataatctatatcaaactaccctagcgacagagttttttctttttaccatttgtgttcatcaacattatctttatccacaagataaattggcgaattaatgatatgatctatttttttaccttgataataatcataagtagcttgcaaagccatttcaccaatcttagctggttgttgagcaattgtcgcggtcatagttcctgcttttatggcatcatgagtctcagattcaccatcaattccaaaaatagcaattttttgcccacttgcttgaacagccttagctgcgccaagcgccatttcatcattttgtgcaaagattgcttgaccatctttatgagattgcagcatattttgagtggtattcaaaccagtagtccggtcaaaatttgcagattgacttgataatatatttaatcctaaggtcttagcttcactattaaatccttttccacgatctatagttgctgaagcacctggtgttcctgaaagttcgagaacttttacatttttcccaaccaatttttcaaccgcttgagcagccattttacctgctgcaacattatcagaagccaccgttgttaaaacagttccaccatttgctcctctatccatagcaattactggaatatgagcattattggcagctttaatcgctgaaacaatagcatcataatcaacaggattaattaaaatcgcatctacattttgactgatgaaattttggacattattgagttgagttgccgaatcattttgagcatcagagacagtcaattttgtatttttttctttggccattgattttatggcattgttcatcgaaacaaagtagggattgttcattgttgaaatagaaacaccaatatttaattcatttgctttcttgtgtgcgacctcttctactttttcttttccatcacgaccgggaattccggtataaagactacatgcggtcaaagttgagactgctaaagtagctacaagggcaaaagttaatttttttactaatttcatattcaactctcctatttccgtttgctacgaatgacatctataagaaccgcaacgagaataactaatccttggataacttgttgccaaaaggctgatacaccgataatatttaagccgttatttagaacaccaatgattagtaccccaatcatagttccaaacatccgacctttcccacccattaaagacgttccaccgaggacaaccgcagcaatcgcgtacatttcataaccagaacctgctcttgtggcgtcgctgatgataaacgagaactgatgattaaaccagaaattgccgacatcgctccagataaagtataaattgcgatttttactttattgagcttgatccctgaaatataagctgctttttcatttccaccaagagcatagactgatttaccaaagtctgttttatgaagtaaaatccataaaataatgaaaacaagaatcattaaaataacagggaaaggaattcctagtagataaccttgtccaatataggctaagaaatagccatccatgtgtttagtaattggattaccatcagtaaaaacaagtgttgctccgcgataaaccatttgagtggctaaagttacaatgaaaggtgccagtttcccataggcaataagtgccccattaatcgccccgagaaaggctccaataattaaggcacaaagtacggcaagtggtaatggcattccttgggcaataaaacctacagaaactgcacttgagagggctaaaattgcaccaactgacaagtcaatgccagaagtcagaattacaaatgtcatcccgaaagcaataaaaccattggccgttacttgtaaaagcaaattgagtaaattatttgccgtcataaagttgggattgatacatgtaatgataatcatcaagacaattagagcaatcattgtcgttaaagaactgaatttttgagctaaaactttcacactcattttcctcctgttgcgagctgcatcacattttcttgtgttgcttcttttttatttaaaaacccggctattttaccttcatgcatgactgcaattcggtcagcgacaccaagtatttcaggtaaatcactggaaatcataatgattggaaccccacgttctgcgagttcattcatcaattgataaatctctcgtttggctcctacatcgactccacgtgttggttcatctaaaattaatactttaggtgcaattccaatccatttagcaagtacaactttttgttgattccctcccgataatgagccaaccatttgttcttcatctgttgctttaacattgagtcgctcagaaagttgtttaacgaaagttgttgcagttttatcatcgaagagtccgtgatgaataaagtcctttgtacttggcagagtaatattatcttttattgaaaaatcaagaacaagcccttcatcttttcggtcttcggttaaaaagccaattcctgctttaatcgcttgtgctgggttattgatagttaggctctttccattaatttttattgtgcctgattttagcttgtcaattccaaaaattgctcgcatgacctcggttctaccagctcccatgagtcctgcaaaaccaaggatttcacctgaacgaactgaaaaggaaatatttttaaagtcagctgtggataaattttctgcttcgaatacaatttctcgaatttcagcatttttttggggataataatctgtaattgagcgaccaaccattttccgaactaactcatcaacatttgtctcttttgtttttttagtatcaatgaccaaaccatcacgcataactgtcacacaatcggtaatcttaaaaatttcttccattcggtgagaaatataaataataccaacgccttgtgctttaaggcctgcgataacagaaaataaacgttctgtttctctttctgtcaatgcggctgtcggttcatccataatcaaaattttcaaatcagataaaaaacttttagcaatttcaaccatttgttgctgaccaactgacaagttcccgatttctttatctaaatcaatagttactcccaattgttcaaaagcaaaagtagcttttttacgcatagcttttgtatctaaaacaccaaatttattttttatttctcgaccaagaaaaaggttctctaagactgttaaatcaggccatgtattcatttcctgatgaataaagctaatgccaaatccttctgcctcttgaggcctcttgaggattcttgaaagttttatcctccttatcaatctcaatttctccaccagaagctgggaaaagtccagtcagaatattcattagcgtggattttccagcaccattttcccccattaaggcatgaacttctccagaattgatagttaaatcaattgcttcgagaactttgttggttccaaatgatttagaaatgttcttcatttctattttcaaaattgacttcctcctttttcacaaagcaacacctgattgtaaaataatattagaataaggtgtattttctcctgttcttacaactgctttgacatcatgattcattaattttaaggtctcatgactgacaaaaacaacttcaacatctgctgacagttttgtcagtaaaatttttagctgctcaggattattttcttttatctcgtcagcaagataaatcttttcaactagaatattttctaaataaatatccaaaacttcttgaaaagtaggtttcccacgtgtcagtgctaaatcaatttttttgacacctgatggtaccggtaagcctaaatctccaatacaaacttggtcagtatgtcccagatcatcagcgatttttgcaagctcactattcaatattccttcttttttcataaattcaaagtcctttcttttccttataaaaattaagattaagctcttttaatttatcttcaacttctgctagaattggcattccaccttgagcaccaaatttatgaatagataaatgggaagcaaccactgccaattggatagaatcaacgattgatagattttctgtcagtccaaaagcaaaagctccattgaatgtatcccctgctcccgtcgtatctaccactttagctttaattgctggaattttttgaaccccattaccattatggaaaatcactccttcacttcctaaagtgacaatcaggcgattcgcatatttagcaagaatttcctccagaggctcattcggaaaaagctccttacattcgtgttcattaggcgtgatgtaatctacaaattcaatcatttctaaatccgtttttcttgctggagctggattataaaggacttttatcgcattttctttacaaaatttagcgactgcaaggttagtttcatgaggtatttcattttgtaaaaccacaagttaactgtctttaattttctcccagaaattctctaaataatcagggaggacttcattattggccccaggaataatgataattcgattatcgtcatcaaataaagtaatttgggcaatccctgtcgtttgtggtaccgttcctacaccatcaaaaagaacagcattttctttgaagttttttagaatagtttctccaaaagcatcatttccaactgctccaatcatatttacatcatggggagctaatctagcaaaagcaacggcttgatttgctcccttgccaccaggaaccatcgcaaaattttctccaaaaactgtttcacctgcttgtggaactctttttgtgcttgtcactaaatccatggaaatacttcctacaacacttacttttgtcattaatttttcctcattcttttcttttttgtcgaattgtttcacgcgctacataatgaacaggcagctcaatctttgatttctcaataggctgatcagttgctattttataaataagttgagccgcttcaagtcccatttggtaagcggattgatgaatagttgaaagggctggataaataaattggctcatttgtatatcatcataaccaataatttgaatttcctcaggaatcttcttatctaatcgatggatttcatgaatataagccatggcgtgaatatctgacggtgcaatgatactatcaaaattttccttattagcaagaacttctcgcgcctctttctggatttcttcaaaatcataactttgactgtaaaaggctttaaaatcaactttctttgcttttaaataagcaatacttgctttaaaacgattattaatatttgtggcattcaaagagccactaaccacagcaacatttttggctccagcctctacaataacttttgctgctaagcgtccgcctgattcattatccgaaaaaacaccatagttacttttatgtccaactcggtccacaatgactgatggaatatccaaatcaggaaattcttctttaaaatcatgagttgaaataatacctgccgcattactttgtaagagaactttcaagtaatcatgttctgattgatgattttcaccaatattaccaagcatcactcgatagcctttttcttttaaaaattcttctgccccctttgcaagcatgggaaagaagggattggaaatatctggcaaaagcaaaccaacgagttgattcttcttcgtttttaaagactgagcagagaggttaggggtaaaatttaatttttttatcgcttcttctattttctttctggcttcatcactgacatacccattttgagcaatgaaacgcgaaactgtagactttgaaagacctgcttcaagtgcaacttgtttaattgtggccatggattcctcctttcaactgtgggaacgttctcacatttacatgtatgattgtatccgttttcatttattttgtcaatcctttttatatttcgttttaataacaaaaaaacctacttttcagtaggccttttaaatcaatcaaagacacggttaaaaatttcatctacacgagtcaaatgatagttataatcaaaagctttatcaatatcttcatcattcaaataatgacgaatttgttcattttcttcaagcaatggtctaaacatgacttgctcatcccatgattttgcagtcaatggttgaactaaatcataagcagcttcacgagtcattcctttttcaatcaacattaacatgacatgttgactgtaaatcaaaccaaaagtggcatccatatttcgtttcatattttctggaaagaccgtcaaatttttaacaatattgccaaaacgattgagcatataatctaataattctgttgtatctggtgcaataatccgttcagcagaactgtgagaaatgtcccgctcatgccaaaggctaacatcttcaagggctgtaatcgcatgaccacgaataacacgagcaagtcctgtcatattttcagagccaattgggttacgtttgtgtggcattgctgacgagcctttttgacctttagcaaagaattcttcaacttcacgttgttcagatttttgtaatccacggatttcagtcgccatgcgttcaatagaagtcgcaattagcgccaatgtttggaagtattctgcgtgcaaatcacgtggcaagacttgtgttgaaatttcttgtggacgtgttcctaatttttcacaaacataagcttcaacaaatggaggaatattggcaaaagttcccacagcaccagaaattttcccagcttcaacagctttagccgcatgttcaaagcgttcaatgttccgtttcatttcgctgtaccaagtggctaatttcaaaccaaaagttgttggttctgcatgaaccccgtgtgtacgccccatcatgaccgtatacttatgttccaaagccttagtcttcacaatttctgtgaaattttgcaagtctttgcgtaaaatatcattggcttgtttgtaaagatagccataagctgtatccacaacgtctgttgatgttagaccgtaatggacccatttacgttcttcacccaatgattcactgacagaacgtgtgaaagctaccacatcatgacgagtttctttttcaatttcaagaatgcgttcaacattaaaagttgccttttcacgaatttttttcacatcagctactgggatttctccaagctctgcccaagcttcatctgcaagaatttcgacttcaagccatgctttatacttgttttcttctgaccaaatttctgccatttctggacgtgaataacgactaataaccactttttactccttttgttactgacagaattccctcggtgctagcccttagagctgtcagtaaattattcctatatttttaatcttctaatgaacgaaacgtcctttttcactaactattatatcattttcaagtctaatgcatttggagatttctgtcaatattaataaaagtaaaaatattatctgtcaaaaccgaacaataagcattcaatccttaagccaactcattttctaaaagatccaaaatctctactgtttcctttaatgaaatttgtccaggagcgcttaagttttccagacctgcaaaagtccaacaagagccagtcaaataacctgaaattcttgaaagacgtcccaaatcacccattgccatactgataaaatgatttccatattctaaagtcatatcgcgagtaatctgcaataaatcaagcacatcacattcacgttcaggcatcacagccactttcacaaaagccgttccttcttcatgcattttaatcaaacgactggtcaaatcggtcggaacttcatcaaagttatgatatgaaaggacaattttttcacgataattctttaaagcagcaaatgaaggcccatgactgaaatattcaacatcaatataatctggttcaaactttaaaatttcttgtaaaatctgtaaatattttttctcagaaacctgaatatttccaccttctcttaccgttcttaaagtaaataaaatcttgctctctttaaatttttcaaagaatttaggggccatctcaaaaatatcatctgctgacaaaaaatcggcacgccattcaacaatatctgctgaaagataatcactgacagaaactttctcaagctctgttaactctgtcagcattattggaacaacaatttttgttcttctcataaacttctccttacattttcataaatgctttcccctattctagcatattttagtaaaaagaaaaaaggaaacaacgtttcctttaaattttttttactggggtagctggattcgaaccaacgcatgagggagtcaaagtcccttgccttaccgcttggctataccccaagatcgctggatgacgacaagaaatattttaccaaaaaccctcataaatttcaagttttaacttatttatttcaaagaaatatcaataattttttataatctctttaaatagatagattatattccttgattgcttcttctaaagcagcctcaaatgaagacactgtcgcaatttcttttccagaaagactgaccacaaaatttcctgatttttctttaatttcagcaattgtttttttcccacttttgataacagctccatcagctgtatcaatgatttcaagttctgtatcttttttctttgacatctcaaactccttatcgttttttaagctctatttctaagtgcttaatctttgatttttgaaaattttcttcctcaatcatagcatttttcaaccaatttgtcacgttcatattactgacagacttcccagcaaaagtaggactatagcacagttttgctatcagaattttcacaataatagaagataaaaaaaatactgacagcctttatttcaataagaaaaattctgtcagtaaattttattatgataattcagcaaccacggctttaagttgagctttcgtttgaaccccaacaatacgttttacttcttcaccatcttttttgaacatcaatgttggaatagacataattccaaatccttgagctgttgctggattttcatcaacatccattttgcaaatcttaagttctgattcatcaagttcttctgaaagttgttccaaaataggcgcttgcatacgacatggaccacaccaagttgcccaaaagtcaatcaaaacaagcccttcttttgtttcttcatcaaacgttgcatcagtaatattatattccattatatctccttcattgaaataattttcttcagtaagactattctagtgtaaatcacttaaaatttcaaggaaatagattttcagatactttattttttatttcaaaatggcaatggttgctccagagcctccagcattgattggcgcatattcataagatttgatatgacgatgtttttgaagttttttctgaaccatttctcgaatgacacctgttccaatcccatgaacaatcgtaatttgaattagatttgcaagtaaagcctgatcaatataattgtccaattccagttctgcttcttcataacgcatcccacgtaaatctagctgtgctttaaccttagaagttacttttttgctgacatttttagtttttgcttgaatttgttcaggagtatcaatgacttcaaactcttcttcacttaaacgagtagtaattgaacccatttggactgtccaacggccatctttttctaaacgaatcaattttccgcgctgaccataagaagtaacattgacctcagccccttgcttaagtcctctttgtgccttggcttttttcaaaaccttgtttttagaaaaatcaatggttggcgctaagccctcaagttcttttctagcagcgatgatttcatggggcttcaatgccgctttatcattaagatttttcaagatttcttgagcctcaagactcgcttttttaactacttcttgagcttctttttgggctttttctaattcaaagtcacgttcgcggttaatctgattataaactttcgtcaaatctttatgtaaactttgattttctcgttcaatttttttgatatttcttgaactttcaatgacttcacgcgttttttcttccaacttttcaatcatttgattgacatcatgttcgctcccagagatttgctgaccagcctcagaaataatcgtttccggtaagcccaaacgtctagaaatctctaaagcatttgaacgtcctggcacaccaagttgcaaatgataagttggctgcattttatcaatgttaaattccatactggcattgatcacttgctgagttttcacaccataagctttcagctctggatagtgggtacttgccattgttttaacatttcgttttcgtaaattttcaagaatggcaatcgcaagtgctgccccttctttcgggtcagtccctgctccaagttcatcaaacaagaccaaactattttcatcagcctgagctaaaatttgtacaatattcgtcatatgacttgagaaagttgacaaactttgttcaattgattgttcatcaccaatatcagcaaaaatgtcatcaaaaagatgaatacggctgccatcatccgctaaaattggcaaacctgattgagctaaaatagtaagtaaaccaactgttttcagggtaatagttttaccacctgtattcggccccgtaatgacaattgtattgagtgttctgtcaaatttaatatcatttgccacaaccatttttgcatcaatcaaaggatgacgagcggcaaacaagataatatctttatcatttgttaaagcgggcaagcttgccttattagctgccagataaagatatttcgcccgaacaaagtcaatatgtccaatcagccaagcattttgccgaatatcaaaactataaggctttaattcttcagaaagttcccgataaattcttataatttcttgtcgttcttcaattcgtttttgattaagcttattattaagtgaaactaccgcattcggttcaatataaagcgtttgaccagaagcggacatatcatgaacgactccggcaattttatttttattttctgcttttacaggaagaacttgacggtcatttcgaatagtgatgacattttcactcaaagatgagagattttttgtcagcatttcttgcataattttacgaatttctgactgatgactcttgatagaggcacgaatgtgcatcaattccagacttgcattatcgtaaagactaccggcattatcaaagatttctaatttcttaatcagccctgataaatcaaccaatttttctaaagtaatatttagtgatggtgtttcaacattttcagcttcgtcaaaaaaacgttgaatattgattccaagttgaatcactttttttatttcaacaaattcttttcctgaaagactcgcttcaagctccaagcgtcgcagaatctcagttaaatcatttgttttccctaaatttaacaaaccattttcttgagtcaataagcgaaaatcagcaacctcatcaaaaaggagctgaatcttatctttatcggtcaaggggactaagtcagataattctttctgaccctgcgctgtcgtcaaagcattcataaactgctctttaactttatcatattccaatatttggagaatttttttattcattatagttatatttcaatttatttttgtagatttgtccctaaaattattcgagtggattaatatggacaatattttcaataaacaggttttgcaagattcctgatgaaatcggtgtgtgtaaaaccacaaaacgtgctagaaagctagcatccagctgactttgtacagtggcaattggaactaaactaagtgccgtaagtagcatttgtaatccgaaataagttgctgcaaagcctaaaactccagcaataatcttcccgttttttcctaaaggactgagtgcaaaatgcaaaaacagaccaataagacgaacaataagataaatgactacaaaaattgctaaaaaagctatactcgcataaaaggcttcatctaattggaaaagaagtttatcactaaaaagcaagagatgtgaattttgcgtcgcattagagaaaaggacccaaacactgagttgttgagctaattctttataattatttgcggcaataaaggctgcaagtaaggttcccaaactataaatgacttgtaatatcaagcctcgtgaataaccaaccataaaagcccaaatcaaggccactaaaataatcaaatttaatatcataaaaattcctaatttattttttcttacccttatcaaggtgagcgagcagaccaaactaatttatacaaataaaactaagctttagtcaaattttctttctctattataccatagcctgtaagacgaaacaatcttgtatcgtactccatagattatgccagcaaaacgagaatcttagtctcttattgagagactaatgaggtaacaaggaagttcgcataagaacttccaaataaccacggacaaccgagtattatactgaatatcataaaaacgtatcccttggaatacgttttttatattaaaaattaaaaaatagatgacgaatgtccccctctgagtgggtggtcaaattcaagttttttcgtcatggcattaattgcatgtaccgcctcaccaaaaccgacagacattaaaggcattttcccagcataatcacttgcatctcccgcaacataaagcccttcaatattagattgcatcattgaatcggccttaacacgaccattacgactgacctctaagttttcagctaggctcacctgattcgttaaaaagccataattaactaagattttatcaatggaaaaattcaaattttcttcagccttcactttttttagttctaaatcattctcattaaaatttgaaaaagtataaggggtgtgaacttgaataccagagttcatcactcgatcaactgtcatttcatgaccacgaaaggccgttcttctgtgaaccaaatgaacttctttagccactttttctagcattaatgaccagtctaaagctgaatctcccccaccaaagacagcaacatttttcccttcaaattcttttagtgaagtgataaagtaagaaatttttccttcatttgctaagttttcttcattatcaattcctaattttcgaggctttaaaagtcctgctccggttgttagtaatactgctttggcttttctatttgatttatcggtaattacagaaaaaattccatcttctttttcaattttttgaacgctctctccaagaaaaaggcgatgagaaatttgtgccaattgttctaaaagatttttcgttaaatcagctccagttacagcgggtaaaccagcgatatcatagattaatttttcagggtagagattttgtggctgaccgcctgcaacttgcgctgattcaattattgcaaccgataaaccacgcattcctgcataaaaagccgcataaagaccaacaggaccagctccaacaataattaaatctaactcttgcatatcaaactccttgaaaccttatcgattttaagataaagtcattttctattgtctatctattattgcgacttttcttgtaaatgtcaaatactttttactttaaataaaaaaagcccctaattgggcttaatttttatttagttgaacgacgagaaatgatttcatggtccaagactaattggttttgctcaacatcttctttaagcattaattttgtcaaaagacgcattgctacagcccctaaatcataaagcggttgattaacagaagttaatgttggataagtatattgagtaattggtgagtttgcaccagaaatgatttcaaattcttcaggaactttaactcctttatccatcatcgcagacaagagaccaacggctaccgtatcatgtgaaacagctgcagaggttgctcctctttcaagtaagcgttcagcaagtgatttgccttgttcgtagctataattaccttcaaaaacaagattttcatcaaactcaatatttgcttcaagtaaagcttcttgataaccaaccatacgttcagtgttttcaacatctttcaatgaacccatgatgtaagcaattttcttatttccattttcgattaatttagttgttgattggtaagcagccaaatggtaatcaatattaactgatggaatttctttatccccatcaattgttcctactaaaacaacaggtgttcttgaatttttaagggaagttctaattttttcatctaatgatgaacccatataaacaattccgtctacttgttttgacaagaaagtttctaaaactttttcttctttttcaacatcattatcactattagctaaaatcatgttgtatttatacatggaagcgatatcatcaactccgcgggtaatagctgcgaagtatgttgaggtgattgttggcaagataacaccgactgttgttgtccgtttacttgcaagtccacgtgccacagcgttaggacgatagtcaagctcagcaatagcttctaaaaccttctggcgcgtcttttccttcacatttgcatttccattcacaacgcgactaacggttgccattgagactccggcgacacgtgccacatcataaattgttgttgattctaccatatttggctatcctctttcttttctttttattcatagtatttatgaaaaccattttcatttacaaattatatcatgaactgtaaaccttttcaaccttcaagtgtgtttttttacgtgatttttcaataaaaatagcgtagaatgggtatataatgttttttattttcaggagaatttagaaaacttatttacattaatattggaggaaccattttgagcaaaattgaacgtatttcagcctttctgaatgataaagaagtcgatatgactttcatcactaatccgacaactctaaattatctaacagggctagcaattgatccccatgaacgaattgctggtttgatgatttttagagattctaaccctatgttattcacccctgccttggaagttgaaaaagctaaagaacatacaagtggcctagatatttttggttatgacgattctcaaaacccttgggaagttgttaaaaaccatgtaaaatcagaagtcaaatcaattgctgttgagttctcagatattcctttagctaaaacagaaggtttgaaagcacaatttggtgatattaattttgtgaacttgactccattaattgaacggatgcgtttgattaaatcagcagatgaaattgaaaaaatgaaaattgctggggattttgctgataagtgttttgaaattggttttgctactgctgccgaacgtaatggcgtctctgaatctgacattgtcgcaaagattgaatacgaaatgaaacgtatgggcgttcctcaaatgtcatttgatacgttagtactatcaggtgctcgcgcagcaaatcctcatggaggacctgaaaatgtcgaaattcaagaaaataagcttctgctctttgacttaggagtgatgagtggcggctatgcatctgatgcaacacgtaccattgctattggtcaacctaatgattttgatgctgaaatctataagattgttaaagaggcacaacaagcggcaatggacttcatcaaaccaggtgtgactgctcaagaagttgatgcggttgctcgtgatttgattactaaagcaggttatggtgaatacttcaaccatcgtcttgggcatggtattggaatggatgttcatgagtatccatcaattgtggccggaaatgacctcgtcattcaagaaggaatgtgtttctctaatgagcctggaatttatattcctggtaaagtgggcgttcgtattgaagattgcctttatgtaactgataatggttgtgaaagtttcactcatactgaccatgatttattaatcttctaataaaataaaattaaaaactttcgccaaatttggcgaaagttttttactgacaaataatttttcaatagaaaaaataatcatcgcaaagatgattatttttattttattcactataatctaaattatcagcatgaccagagccattaccaacaaagaatcctgtttttgcattgattgagactaagtaacgtccatctggtgcataaagattataatatccactaacaattcctgcaggaaaaccttgactaccattggttgtatgaatggcagtcggaactaaaatgtaattatcacctgtaatatagccgcgttcgcgtgctttattaagcaccatttctttaattccagccccccatgtaaaggcaggatcatttggattaataccagcttgtggttgaacccgtgccgctgaaacttctaaattcactccattagagctcaaaccattgccgtttgtgctggcattggcatttgaatttgtagaagacgaagcattcgttgtagaactgctttgacttgttgtacttgatgaagaggtttgagttcctgctccttgattcgctttggcttctgccgaacttgcagaggcttgggccgagctttctttagccacttgactttttgctaaatcgatagcctgagttaacaatttattcaaagtttcattactcgttttaggagtttctggaattttgacattagtcactattttggcagctgaatcaagttttccatcagtaattgcggcacttgtaaacagggcgtttactttcttaatggcattaatttggtctgtaagactttctgtttctgatactgcatttgaccaagccattgaatttttgtgactattaactaaagtttcgagcgcagctaagttttcaaattgactatttttcaaaacattatgtgatttatcagtaaagaatgaatcatattgtttttcaaatttatctaagtcagtctgactacttttcgttgtttgaacagttttaggtttttgatgattattatactgtgcaaatccaaccgcaccagctgcaattaaaacaatagcacataaaccaatgataatcggtgtttttcgatttttagcttttccatcagttgttttttcctcagctgattcttgaggttcttcttggctttcggatttaggagcaattttttctgacgtcaaaacgggagctaccttatcagctgtaatcactttatcaggaatatcagctgtattctccttaggttcttgaactaagtctgtaggagcttcctctattttagacgcttcaggtgtctccttggcttcttcatttaaatcagaatttttctcttcttctggttcttttggttcagcttctgatttttccacttttgaagtttctggactttcatcatccttcacttcctccataggaacttcatttgctgacatcatgattgggacagtaactttttcttcttctaaaggaagctcttctactggttcatcaatttcttctattttctcaactgatggactttctttttgctctggcaatgtactgacaggagcatcaaccatcacaacggggtctaagacaaggtcattttttccagcttttgcttcttctgactttttgtcagtaactttctcagtcgctttttcttctggtaagtttgattttgactcaatcttcacttcatcagtctcacttttattttctactgctgaagtgctttctgagtcagtatttttttcaattactgctttgtcttttgaagcgtcttctgcttcttgttcaagaactttctcctgaacttctgctttatctgctgatggctcgatatgttctcgctcagactgaataaattcatctaaatttttatttttagcatcttcaatttcaccgcgatgctgacgaatatatttatctaaaacagattcattttcttcattttctttgtcaactcgttttgattcttcgacaatttcacccacagtaaaattttgtaaatcttgaagtttcaaagttttttcgccaatttgttgctcagatttttggttgtttttattcttattagtattgttatttttgtttttatttttgttttttttatttttgtttgacatttttcctccgaataagattcccactattccaataaaatggtgaatcagacaacgagagttgctcaaactcgtctgaatcaatttattgacaaacttctgtcagtaaattaatttcactgacagttatcataaacaaaatagcaagatgctagttcacacgataatatctgtcagtaaaaaattatttcatccgttttccgaaatacatatacaaatctgttcttagtattccgttataaagtttgcgttttttagttgcttttgcaccatagtgtttttcaaaagcgacatcactcgtcaaaatgtatttactccaagtttcaagtggtgcaaaggttttacccatttcaccataaagagccgctacagcctcttcatcttccaaacgcaccccgtaaggtgggttagaaactaagacaccatcaagcttatctgttctaaaatcttgaagtcgcatttgcttatattttatcacatctgaaaggcctgccgcaagtgcattgtgcttcgcgatttcaatcatttttccatcaatatcaaaaccttgaatatctaattctaaatctgtcagaacttgtttttgagccaaagctttttcttgtttcaaaatttcttcatcaaaccaaggccatgccgtaaaagcaaaaggacgattcattcctggagccatgttcaaagccaacattgcagcttcaattgtaaatgttccggacccacaagttgggtcaacaaaggcacgacttggatttgctaaccaattagttagtaaaataattgaagcagccatgttttcttttaaaggggcttctcctttttctgaacggtaaccgcgtttgaaaagcgagtcaccagtcgtatcaatcagtacagttgccatatccttgtgcaaggcaatttcgatagaaaattttgccccattttccggaatgggtactccttcaggacgatgatatgtcgtttgtaatttttttacaatagctttttttgtaatactttgaattgacggttcattatgtaaagttgacttcactgattttgctttactgacaggaaattgacagccaaatggaatgagctcatcccaaggtaagtcataaacattttcaaacaattcctcaaatgttctagctttaaattcacccacaacgattttaacacggtcagcagttcttaaccacaggttagctttagcaatttccgccaaatctccttcaaagaaaactcgtgaacggtcatcaattgaaacattttcaatttcaagattacgaagttcgcgagcaactagactctccaaaccacttgaagacgtggccaataatttgaatttcttttgcattttttaatctttccaatctctgtattattcttacagactgagatactattctatttcacgttaccaattatttatcaaaaaaagccgaggctaaaagccccagcctgtgtcatacagttttctataagccatgttttgttccagttcaatccatatcaatgaatctccccttcgataatcatctgtctgccaaaattcttaatttcagcctcaaccacgccttcatttgggctagtcaagtgccccgaccataagtttgggttgctcgcttgaggggtttaccacgttccattcttagcgtttccactaagactcgtctctatggcacttttacaggctattcacgcatatcaaaagacttagcgttttggccagccgttaggcatgacgctcctacctaggtttattgtttgacctagcacaatcactgcgtgcatctcagcaacgcgcgagcatggactttcctcacgattcacaaagaatcgcgcgattatccgaaaactgttttttcaaaaattaagcagaactataaagctcttttccaaaatccttgacttcacaaatctgtgaagcttgctatttcccttatttctaagtccacagcaaaacataaaacactttaaattttatattttttagttgttttcactagcgatgccattagggccaaaaacagcttgttctaaacgattgattcgtttgagtaaatcaaaattacttggattacgcatttccacttttggtttacttgaacgtgcttgaagaacttggcttggatcaaagcgttgtgtatcatcaagatttgcttgatttggtttagaaacttgcatttccaattcagcaatctttttcttcaaaaactcattttcttcttggagacgcaatgtttctgtctgataagtttcataatcagcaataacgtcatcaaggagttcatcgacttcttctttatcgtaaccacgcatctttgtagagaagtctgcttcatagatatctttaggcgtaaatttaaatgtcggcatttttacctcttcatcatcattataaaatgtccattatttatgataacagattttcagttttttttcaaggtcaacttgattaataggatatcaaaaagataagctttatcagctgcactcgtttttatcgcaaaatcgagttgaattaaatcagcaagtcctttttttaaagaactcacttgcaatcttcggaccaattgattagccaatttcactggataagggtgcattttcagatatgaaacctgttgattttcttgccaacccttttcttgaaaaagtttgacttgcaaatacaatcgataagaattagtcaaaatcgctaaaattttaattaaatcttctccttgtaaagttaaatcatgaactaaatcacgcgcttcatcaatttttcctttaaaaattaagtcagtcaaggcaaagatattatcttgtagtgattttggaactactttttctacatcatctaccgtgacttcacgccctaaagcataagtttggactaaatcaatattttgcttcactactgaaaaactgtcattagatttggctgcaattagacttaatacaggtcgtggcagtgaagtttcatgactaaaatattgaatgagttcttgtgtttttaattcctgtgcttcaagcaaagttgctttggcttttagttttttgacaacttttagacgactgtccaattttccatagagtaccaacacaagctgggtggtttccgaaggattatctaaaaaattttcaaaacgcttaagctgtttttcatctaaaatagtttttttagccgttgttaaattgaccaagttttccaaaataactagacgagaatcagaaaagaagggaagggattccaagtcttccaaggctaaatcgctattattaggcgttaagtcatagtaggattgacttaaatctgtcggttcaaaatttacaaaagtcaataactggctttttaattcttgaaccatttcttttgactcaccaaaaattactaaaatttgagagagcccttttcttttgacttcgttaaattcatcaaatacagtcatattaattcctcaacaacattattaaagcaagtcccactaaaactatcactagaataagcaaagcaaaacctatgcagccaaacttaaatagcttagcaaaactcgattttgcatttctgacaatctcattatcaggtacggcaactctttcttcgatagatttatatttttcgttggggtcgaaagtggcataagctccaccaataaatccctcatcttccgtcatttgatttccgtgcaaggcatcattccatgtaattggccgatatgactccactcccggaataaatgtttgagaggaagtgatatttttatctacttttaattcttcataaagtgctttaactggggctttcattccaccctttaagatttcatcatcagcaggtcgattccaaaattctaagcgcatatatagctgacctaaaatttgtaaaacaggttctttgcgctcatttaaaaccaaagcatccgctaaatcatttttttccttgcttgaaagttctttattttgctcatcttctcgtaaaatttcatagatttgtagaaaatagtgacgataatatagttcttcactcattcttctactcctccaataaattctccatccggactaacaaggactttacgaggagttgttcctttagcaggaccaacaattccctgcgcttctagctcattcatcaaatcagatgcgcgattgaatccaacttttaaagctcgttgcaattgagccgttgaagctttttgagcaataataaccatgtttcttgcctcttcaaacaacgggtctcctgagcctgtatttgaagccccagttcccacttggttctcatccacttctccagggtcaaagctttcatcatattgtgcctctgattgatctttaataaaggtcacaacagcttccacatcatcatctgacaagaaagctccttgcaaacgaactgggtggttttcgtcaattggtttaaaaagcatatctccgcgaccaagtaatttttccgcaccatttgtatctaaaattgttcgtgaatctgttccagaggaaaccgcaaaagtgatacgtgaaggaacatttgctttaattaatccggaaataacgtcaacagatggacgttgggtagccaaaatcatatgaatccctgccgcccgtgctttttgaccgagtcgaatgatggcatcttccacttctttacttgcaaccatcatcaaatcggccaactcatcaacaataacgacaatcaaaggaaattcaagcattttttcatctgattccgcattgtatttttgaactttctcattgtaaccagcaatatttctgacaccataacggctgaaaagttcataacgttcttccatttggtcaacaactttttgaagcgctctggaagctttgcgaggattggttaccactggaatcaatagatgaggtatatcattataaacagataattcaaccattttagggtcaaccatcaagaatttgacttggctaggcaaagccttcatcaaaattgaagtaataattccattaactgcaactgatttaccagaaccggtcgatcctgcaaccaataaatggggcattctagttaaatcaaaagttcgaattccaccatctaaagacttaccaagcggaatttcaaggagtttactaggattagttttacctgcttcccacatctcacgaaaaccaaccattgcaacttcagcatttggaatttcgacaccaactaaagatttaccaggaattggcgcttcaatccgaatatcttttgctgctaaagcaagggctaagtcatctgacaaattaaccacacgagaaacttttgtaccggttgctaatttgatttcatatttggtaattgatggaccaacaactgctgattcaacattggcacctattccaaaagatttgaatgtttcttctaaaatcccaatattcttgcggacattttcccgttcacctgattgatttttgacagggacttcggctaataaatcaatggttggtagtttataatttccattgtaattattagtattcatgaaattcactggttcatcatcgactggattttcttctaaaactggattttcattttcttcaaaaggcgcttctggaatattgattggaatttccacaggtgctgaggtaaataatgagttttcggcttcaggcaaaatagtttgtggctccggtatttctttttcttcttccagttttttaagagctttgacggcttttttagcttctactttttctgcacgtttttctttccattttgctaaacgctgatgcaaatcttcacgcattttaggaaagagccctggaatcatgagataaatagcaacaagccagagaacagcagcaataatataaacccctattactgaaaacaaggatttggcgggttcagtaatgattgctccgataagtcctgaaccaacaaaatgaatcactcgaccggctgttaaatcagaccaaataagatggaaagtttcattaagtccctgatgaagtcgaatttgaaagacaaacattaatccaataaaagttaaaataatagctggaataattcttttattttctttcaaaaattgcttacgaaaaactgatagaatcattattgctgccactaagagaagaaaaataatggcaagtgaaccaataaacaggcgaacaatattataaagtaagattccaacaatccctaagcgagcaagggcaaataagattaaaagaagcccaacaaaaaaagcaatcattttccttgttgcggcttttttctgtagttcttttttggtatttcttctagttgtttttttctttgcaggcatttttttactttcactaagagtttgagattactgacagacttgtcagtcaaattattatttttaaatggtttattttgaatattcgttttgtgcaaatactaatgacagtcttgtcagtattttgaatcatttaattaaaatgatggataattccacttacaattatatcataaatttgatacaataattttatggaaaatatcaatgattataaggctttggccttcttcgatttagacggaactttgcttaacagtcaaagtaaacttgaacaagaagtcattgaaggaattcaccgcattcgtgaaaatggtgtcttgccttttattgccactggtcgtggtcactttgaactggatgaaattatggctacaacagggattactggagctattgctatgaacggtcagtacattgttttagaaggtgaaacaatctataaggaagaaattccaacggcaagtgttgaaaaattactagatgccgcacaaccccattcagaagccctttctttttacgatagccaaggttattgggtgagcgaactcactgatttagctaaaagagcctattcttacactcacatgccaatgcctcaagtagatgctagacgttatctttcccaagaagtcaacatgcttttggttttaacgaatcatctcagtcaggttgagtattataaagaacaagtgcctgaactcaactttttcatgaattctcctagttcaattgatgtgacaaatagcacaactaataaaggcacgggaattaatcatgtcaaagaagttttgaatttcactggtcaaacctttgcttttggcgatgggcgtaatgaccttgatttattcaaagctgctgaccacaaaacggcaacgggaaatgcagtgccagaactaaaagaactagctgatttcatctctactgagaatacaaatcatggaatcatcaatgcattcaaccattggggaatcttataataaaaaaagttactgacaaaatatctgtcagtaacttttttatttattttcgagtacttctcgtcttcgatagacaaaagctagaatgaaacaaatggcaactggtaaagttaaaattaaacctgctccgttaaaaactgaggcgagtccgtaaaaaattccaacgactaagaaataaattccccaacctttttctttattcaacctagcaaaagctatccaattaagtacaagcaaagcgattaaaattagtcccgcaatcattgctgctgtagataataagtttttatcaaatccagcatcttgaagttctgtcataatttctgaaccagtttgcatggaaataatcatccaaaaactaaggagtcccagcagaacaagaattgtaaaaatgattgacccaataagagcaaatatttttgatttagtcattttttctcatttccttttttattttttaattataacatttttaagccaacaaaaaaaatccgcctcaaagagcggattcctaaaaatcttgtcagtaatgatttaatttttaaatttactgacagaatttcaatctattattttaaagcttgagcagctgtgatgattgcaagtttataaacatcttcttcgttacaaccgcgtgaaaggtcagaaacaggcgcattcaatccttgtaagattgggccaatggcttcaaaattacctagacgttgcgcaattttgtatccaatattccctgattgaatgtctgggaagataaagacgtttgcacgaccagcaacttctgaatcaggtgctttttgacgtgcaacagctgggacaaaggcagcatcaaattgaagttccccatcaatttcaacttcagggtgaccttctttaactagtgttgttgcttcaaccactttatccacatcttctgatttaccagaacctttagttgagaatgaaagcatcgcaattttagggtcaatatcaaagagtcttgcagtttcggctgaggctacggcaatatcagcaagtgttggagcatcaggtttgatgttaattgcacagtcaccaaaaatatatttttcattgtcatcacgaccacgaaccataataaaggcaccagaaactgattttactcctggttttgttttaatgatttggagagccggacgaacagtatcagcagttgaatgaattgcaccagaaaccattccgtcagcaattcccatataaacaagcattgttccaaagcaatttgggtctttcaaaatttcttttgcttgttcttctgtaactttacccttgcgacgttcaacaaatgtttctgtcattgtttcaaaacgtccacaattttctgggtcgtaaatctcaaagccttctgggttaattccacgtgaaatcaatgtttcagtgacttctttgacatttccaataaagacaggtgtaatcaatccatcggcattaagacgatttgcagcacctaaaatacgtgcatcagttccttcaggaaagacaatttttaagtcttttccactaatcttttgtttcagtgattcaaaaagttccattttaacaatatccctcggttacaagtttcctataacccaccgctttaagttgcggatttcctttctgcaattgttacgaattaagtataccatactttcacaaaaaaagtaagcattaccattattgctatttaaggacaagaagcgcttttatttcagtaatttttcacgatattcactaaataaaaattaaaaactgtcagcagacagtttttttagtcatttagaatactagcaatttttgtcgttataatatcgacaccaactgtattagaaacaccttcaggtataatgacgtcagcatatctcttagtaggttcaataaactgatggtacattggcttgacagcttctagatattgtgtaattactgagtctagagttcttcctctttcctcaatatctcggcgaattcgacgaatgatacgcacatcatcatcagtatccacaaaaattttgatatccattaagtcacgcaaacgctcatcttctaaaaccaaaattccttcaacaatcaaaacatcaacaggctcttgacggtaagtttcttgagagcgagtatgcttagcataatcataaatcgggatgtcaaccgcacgtccgtattgaagctcttttaattgagcaattaaataatctgtatcaaaggctaagggatgatcatagttcgtttttgttcgttcttcaaaagtcaaatgcgattggtctttatagtagctatcatgctcaatcatcgcaattctttcatttgaaaaagtttctaaaatagcatgtgaaacacttgtctttccacttgccgaaccgccagtgacaccaataatcaacgttttcttcaaaatcaaatctccaaattttcttctatatattctaccacaatttttgggctttttgtcatcaactgacaattttttattttttaagcgttcacatcaaaaactcttaattttactgacaaaagctcttaataagtgacatagaatcttttgaattcttatttttataatttatttacttaaaattcaatagtagagcaatgacctttaagaaaaaatttgatataatagaacaagattttaacagaaatttagaatcttctaacgaagatttctgtccacctataaaggagaatttgatgctaaaacttggagtaattggaacgagctggattgctcgctcatttattgatgccgcacatatgactgaaaaatttcagttttctgctgtttattcacgtcgtcttgaatccgctgagcagttttctgccgattttgaagcaattgagaaattcgataatcttgctgattttttcaaagctccacttgatgtcatctacattgctagtccaaacgctcttcactttgaacaagcaaaatccgcaattctagctggccataatgttattgttgaaaaaccagctttctcaaatcctactgaattgacagaaattattgggcttgcaaaagcaaataatgtcttcttctttgaagctgctcgtaatattcactaacattcattttccatcatcaaaaattttcttgctgacaaaacaatcaaaggggccgattttacttattcaaaatattcgtcaaaaatggctcccctcttaaaaggtgaacttccaaataaattcaatcctaaattttcaggtggacttttagctgaccttggtgtttatctcttgtacgctgcaattttctggtttggaaaaccccaaaaagtaacttatgacgccgttatacttccttctggagtagacttagcaggtgtcggtattcttgactatgaagattacaaagtttccatcaaatgtgctggaaacgtaaatagctatcttcctagtgaaatctatacaactgatggaactttgattttggatggcgttaatgcgattacttcagccaaattcattgctatggatggttcagaatctacaattgacattgaagccccaaaacattctctttatgatgaagctctagattttgcccatattttagaaaacaaagattttactgcaagctatgaactgcatcaatttgccaatgaagtttctgaaacctcatatcaaatgcgtcaaagtgctggcatcgtttttgatgctgacaataaataaattcctttaaaagttactgacagaaatattttttaagtctgtcagtaacttatctctggtctcttagttaaattggatataactaccgcctcctaagcggtgattgccagttcgattctggcaggggccatctaaataaaaaagaacaccaaatctggtgttcttttttatactcaatcgattaccaattaacttgacaatgattgttatgagccgctaagtttgatttattgttcaaatattaaaagacgaattttatcaatgcttagttataaactacccaactacctgctggaagtttgcttgccattgcaatttgttcagccagagtcatacctgcgtattcaccatgacccaataattggaaggcaccgtaagcacctgaacttgaattcacactatcagccatcccatttgattcatgagtgatgatataagcccattcactagcagaatagcccgctgcattagctgtattcgatgccatataattagcaagagcttggatgtcaatttgtccagaagtttggctcgtattaagcccaccagaaacactttctgctgcttgagcaggtgcagctgatgtaactttagtaggttgttcttcagtagtcttagcagtagcagaaacttgtgttgttgttcctgtcagaatattattaacttctgtttggattgcttttacatcaaaaccttttgttttaaggttagtgacacgagcgtctccattaccgtaatttccgttaataacttctatagcaacttcatgagttgatttaggtgtatccgcatgagcgattccgcccccaataaacatgaatgatgcaactaatccagttgaaatagcaactttacttaatttcatttagacctttcgatttcgccactaagaacattccataggacttgatcagcccagtctatcttctatcatcatggttacttcccatacacatcataaagtccgaacgcttgtgtaggattaccgtaagcagtttaacgtcattgcacgctatggacgtttcgagattcatttcttgcaaactaattgatcaatttaatttgtaagttaaaaaactatttaatatcagcagtagagtttatctaccactcatgaggcacaattatattatccattacttaaccgaaccttaaaaaaactgctaaaaaatcctcacaaatccgactataaagccttttctttcaaatttaattctaatattgtattatccatactacgttttgaaatctttctaaaacgctcccacttcccttcgaataatcatattttgggcatttccacataaaccctttcaaagcgactttgcttttcttcattgattcttagcctataatcagttataattacaatagaaatgaaagcactccagtcaaatcgcaaacttctgcccacaatgatacttaaacttttttaatattattaaaatgcagaaactttttttctcaaaaaacaaataaataaaagccgtaaaataacggctgtttttattaaaaatatattttcaggagtttttatgtctctcaaatcttttttagagctcgtcgaaattaaaacaaaaattgcgagtatttttccttatctcatcggtattctttttagtataagctattttaaaattctagatctaggactttcgctcttatttttggtggctatgctgctttttgatatgaccgtaactgctattaacaattatcaggattacaaaaaggccaaagatgaaaattataaaaaacaagaaaacatcatcggtcaagctaacctttcaactaaccttgttgcctttataatccttttgatgttagctctgagtctgattcttggattctccctcgcttattttgtgggttggctcttctttttacttggtggaattgtcttcttcattggtgttttttatacctatgggcccattccgctttctcgaatgccactaggagaaatattttccggtggtacaatgggctttggaatttttgcaatggtcattttaattaatacttctcaagacccaatttttagtctcaatcttgattttacaaataatacttttagcttaaacggcagtatttttgctgctattgctatgattattgccagcttacctcttatttttaccattgctaacatcatgctcgccaacaatttacgtgatttagatacagatattaagaatcaccgttatacattggtttattatattggtcgcccttatggcattaaacttttccaaattttgatgtatgcttcttatcttgctattatccatggatttttatttagaatttttgagtggccaactttgcttagcttgcttaccttccctatcattagaaaaaatctgaaagcacacgagcatcaagtaccaagtccgcgaagttttgtttactccttaagaaacatggtcttatttaatagcgcctatgcctttagtctacttctctcaatcatttggcaatatttaacaaaataaaaaaagtgatagatatcactttttttatttttcattcagaaccagacgaagctgctcacgagcaagcacttcatcttcccttttaatcaaaaatgtgagataatctccagcctgtaactcggtatctccatgtggaataatatcttttccagaacgatgcactgacacaagtaaacaaccatctggtaaatttatctctgataatttcttgcggtcagcaattgaatcaaattgaacaattgtttcaaacatcatctgtttatcagaatcatcaatctctatttctttttctttcaacattttttctagcaatgaatcataaattggttctgcttttaataaatctgctacaacgtatgcaatcaatgaaacaaatgccaaaggaagcaaatggtcaaatgaccctgtcatttccactaagagcaaaatgccagtcattggcgctcgcacgatagcagtaaaggttcctgccattgccaaaatcactagattggcaaataaatgacttggtagatgaaaaactgaaatcacaattgtagcaaagacagcacccagacttgctcctaaaactaataatgggaagaaaattccgccaggaacacctgaagcataagaaatcattgaaataagatactttccaatgaggactagacaaagaaaaccaagccccatgcccaaactaaaagaatccattaagtgatggccacttccaattatacttggaaaaaccaagcctgtcactccgacgattaaaagcgtaattaaaacgcgtaagaaaggacttttaattttcttcatcaaactttggcttgttaaaagggtccaattataaaaagcaccaaagaaccctaaaataattcctaaaataataagcaaccaataatttgacaggtcaatagaaccaacaatttgaaaatgaaaaactggtccgctcccaaacattaatcgtgcaaccatatcagcaaccattgctgaggtcatacaagtgagtaaaatcaaaggagagaaatatttaaagacttcttccagagtgaacatcacacctgacaatggcgcattgaaagccgcagacaaaccagcagatgccccagaggcaattagaatccttttatggcgttcggtttcggccaatcgactagaaaccatttgacccattgaagctccaagttgaaccgaaggtccttcacgaccaagagaaagtcccgcaaacattgccaaagttcccgcgataaatttagcaaaagcagtcgtaaaccaattgtttttaaaataaccctgcaactgacctttgacttgtggaattcctgaacctgaactcattggatatcttgtcattaaaaaactaataagcaaagccaaaagaacaagacccaaaataagaaggggaataaaaataagatgtgaactggtaaaactataaatacccaagcctaaattttcagctttttccaaggccaaccgataaagactggtcaaaaaacccgcagtcaagcccacgagtacacttagaaaaagcagataaagatttttatttgttgatttttctatatcttttaatttcattactacttccctactaacgcttattttaataaatttttaagcaagattattataccataaaatagattccttatgttttgtacttttaataatatacacacccctgtataaatttactcaaaaaggtactcaatcgagtacctttaattttttaactacagatttacttaaagttttctatctttccaaaaaaggaataaaccaaagagcatcatcaaataaaatggaagtgtcaatgcagtaatttctaatggtattctcacaacaaaaataagaataatgagagaaatagataagactaaacctctatacttaaaaattgattttggaattcgtggccaaacatagatttgtagaagaaatgcgatgacgacaatcgccagccataaaactaaaaacatcactctacctccttgttaagtttaattctctattttttcatcagaatctcgtttactatcatgtattaactaatagatacctaaaccaattaatagaatagagaataaaactactggaaacaaactacctttttttacaaaaacaaagaaactaagaagtattaccgacgaagcaatgataatcaatcctcttttgcttcggccatagctgataaaaaaagaatctttatatttttttcctattaaataagccccccagattgtcaagagcataacgatactcagcaacatttaaagcctcttttctaaagtaatcagattatgcagtgtaaataaaattattcatctgagttttactctaataatctacatcactttctttttggtggaaattgagaaattcctgtcaacaaagaacttccttctccccaagctacttttctttcagctcgaagttccttataaaagctcaagacttcttgagaaagttgagaactaataaccaagggaagtaaagcatttctgaaatgtactaattcaaattcaaagtttttacttttttcaattcgttcgcgatagtccaataatatttctttctcagatgatttaagttctgactcatttttcagaagttcatcaattcgttttaggattttttctttattttctttttcctttttaaacatgttatattttctcctttctaccagtttactccttgagcattaaatacgtaaattgcggctcccattggacctctcgtttgagcaaaaacatacttatgatttacttggtcataataaagtactccagaagcagtgttttgaataaatgttagattagaagtattggtccaatatccactatctgaactaccaccttcaaattccatattcatccgtggtagtattcttaaaggagttgttacatcttgagaattcgaaacaactgaatcggcagacactgatattgagtaaaattctgaaaaaactgctaaagctattaggattacataaatttgttttggtttcataagaatttccttctttctattatatttttgtacaattttgttcatcctattaaatttttttaatatatttctctttccattaattttcaagcgcgctttcttttatcttcaacttcattttatcagaaaaaaagtctcctttttaaatcattgcagaaatgcaacgaagtaatctggagacttttttatgttaataattttcctaaaagcttttgatatcgtttttgataataatctgctaaatcttcataaccaacttgccgaaaaacttcaatggcctttttgatttgcttttcggctattatcttatctttgaaacaatagctataaaaaccatgcgccaaatttcttagattttcaacatagaggtcgtagaaatcctctttggggtaacttttttgcaagatacttctagctgagtcacgagctccttttgaggaaagcaaaacgaccgctcgatacgaagattgaagaactcttctgcgatatttaaaaacaccatataaatgtttactcttcccccagagttctttcatcaaatacataatttctcgttcactgaaactgcccaaagtcagataaaaaatcgaaagttcaaaatatccccattctccaacatcatagagatattcaaccacatcatcagcttccctttgtgtcagtatatcataacgacttttagcacaataagcaagcatttttgaatcatattccatagcttctagatagagattgtgaagtttatcgacgtcatctgcaatatccgcaagaattatatcttctaaaaattcttctttataatccattgaaaaattattgataaaatgttcatactcagctaaagtcacattcatctcttgcaaagcactatccaagcgttcaaaacttatcatggtttgacctaattcaaatcttgataaactcgcttttgaaatacctatttctgaaaaatgagaaagcgaaaaattcttttgttctcgtagttttttaaaaatttccccataacgtttataaggcatattttttcctcgaaatttttcttttttattgaccgattactttttaccaatacgaatatttgatttaggttttttggatttagtggcaaaatggcttgcgattgctccaccaccatgtttttgatattctacggcaacaaagccagcttttctaaaaagttcttcaagcgtcttggcatctggaaaatcttctgctgatttttgaagccattgatattcttttaaagatttggcaaaaactttaccaaaaaagggcatgacatttttaaaataaagttcaaaagcttgtttataaattggtaaggttgggtgtgatgtttcgatacaaaccactctgccccctggttttaagacacgaaaaatttcttttaatacagtaagatagtcaggtgtgtttcttagcccataaccaatcgtaactacatcaaagcttcctttttcaaaaggtaaagccatcgcatttccttgtagaaattcaatgtttttcttcgcttcttctttaagtttagccttagcaatttcgagcatattttctgaaaaatcaagaccaattactttaccagaagggccaacactttcagataaatcaaaagtccagtctccagttccacaacacaaatcaagaatagacagaccagttaaatctcccattcttttcattgttttagcccgccataaatcatgctgtttaaaactgataatggcgttcattttatcataatctgatgaaatactattaaagatttcttgcacacgttcttcgtttactttagtcatagacttattatagcacaacttctatgctactatttactgattatgattgataaaatataaaaaaattactggccacaaggtcagcaattttttatattttaatggaagaaatgactcttacttccgatttcagaaattttcttcgttttatcttcaaagtgtgggaagagaaaggccccaattgcaacaaatacaattgatactgccacaaggataattattgcaaaccaagcgtttggccaataaatccctccagccgattctcgtaaaagattaacagcgtgggtaaatggtaaataaggattaatggcttggaagaattttccagaaacttggattggatagttcccaccaccaccagaaatggaaagtacaaggataataatcgctattcctttaccaacattaccaaatagcgcgactaggacataaaccataatcataaaggcgatggatatcagtaaggcaaagaggacgctgtagaatgggtctcgtacatctacccctaaaccaaagtagtttcctaaggttacaatcaaggcttgagcaagtccaatggctacgaaacttcccattcgagcaaagaattgttcacgtttagaataacgttttttatctttatctgatagatgaacctctgttgttgccaaacttgaaagtaagactgcaccgacccacagacaaagcgctgtgtaaaaaggtgtacttgccgaaccattgttggcaataggataaacttgattttcttgcacttctactggttgggtcaaaaagtcactctctttagtagcatcaagttttagaagtttaacaatctctcctaaatcaacttctttttcacctttttgaatggctgttgctgctttttgaatgcccgatttgatttcaggccagtcattttggattaaactattggcttgattcaaagtagactcgacgtcaggcattttctcatttgccattgttaaggtatctgttaaatctttacgaacaccagcataatcatttttaaagaaatcagaagctgtgcccaacttacttttaaggatagggaactcatttttataaagactagccccttcattaattgcattgacaattgtcgtcatatttccatttaacatcaagtttgcatcatgaatttcttgtttgatggctggcatttcaccttgatatttttctaaaatggtaatagcattagaaactgtttgacttgttgaatttagtaaagcttcaaagtcaatttgttgagcctgatttaataaacctttggcatcagtgattgttttagtcagtgttgtcaaagcgttactgataattgagttaatttcatctggattgatttgatttgcgatattagctatattagtaactaaactattaatttcgtccaaatagtttttaacatcagagacattaccagtttgaatcaaatcgttaagatgattcattctgtcactaaggcttgaaagtaaggaatctaagttagttagtttttcaataactgaatctaaatcatgacttccgttactttcttgaatttgcttaaggtaatcaactgttgttttaattgactgtctttgttgattaatattggtaacaaagtcagtgataaggctattaatttgttgcttttcttctgacgtaagttgattatcatctatcgctttttcaattgttgaaataattgttgacgtatcactagaaaaatctttaatagattccaatgccactttaacactacttgtaattgacggaagtgcctgttgcatttttgttgcagcatcaagggttattgtccctaaactatctgcatcttgtcctaatttttgaatgtctggcattgatttttgaacttgattgatgatttgcaagccgtcttttgcttcttgaattccttgggtcatagtactttcaactgacgcaaagtcttcatcaatcatcgaaatttgtttaccagcgttttgaatttcaggaattttttcttgaagagtcaaaacaagtgacaaacttttatcaatttcaggcattttatcattcaaactaattactttttgacctaaagaatcaacttcgggtaaataagtaataaattcgttagccttagccagtttttctttgatttctggcattttaccatgaaggtcaaccacttgttgggtgtatttgtcaatggttcctagattatcgtttgttgataaaattgctgacttaaccttttgaatgctgaccatatttttatcaatatcgtaaccaatcgtattaaaggtttttaagagtgtactacttgccgtattaataaactcttcagaaatctgtgattgaagagatgaagcacccttagaggttattttgggagcaatagcatttatcttttcattaatagaataaactatttgtggctttttaatatcaccggttgtaaaacttaaaaggtcttttgaaaaatcctttggtaagtaaattccagcatagtattttccggatttaactcctttgtccaattctgctttagaatctacaaatttccaacctaattgatgatttttctttaaattcttcagaacttcatcaccaatgtttatggttttatcttgaaaactagcaggtttatctgcactgtagactgcaattggcaattgcgaggtattggcataagggtcccacaaggctttaatgttaaaccaagcatataaagagggaattatcattaaggcaacgattaaaaaggtcgccacaggatttttaaaaattcgtttccagtctagggcaaacaacttccaggtattttttatacttttcacttcttatcctcatcattcttatctcacttgtaactttttaaatttcttaaatatcatcgaggctttttcatacttcatgactgcggatttaaaaattacgcaatacacgattttatcatatttcataaaaaagttctagcactgcttccttttaatggacacttgcctaactattgtaaatttttcttgattgataaaaaactcaaattcaaagaaatgtttatttgataaaaaaagagggaaaatcccccttttatcaatcattcatttgttaaatcttcaccattacttgcaatcatttttttataccaatcaaatgacttcttaggtgttcgtttcaaagttcctttaccgaaatcatctcggtcaacatagatgaatccgtaacgtttactcatttcaccagtgcctgctgaaaccaaggcaatacatccccaagaagtatatccgagtagctcaataccatcaagttcaaccgcttttttcatttctttgatgtgagcagccacgtaatcaattcgatagtcatctgctacaaaaccattttcatctggtttatctagggctcctaaaccattttcaacaacaaacaatggtttttgataacgatcataaatagaattcattgtaattcggagtccaatagggtcaatttgccagccccattcacttgcctttaaatagggattagtgacagactcaaaaatattaccagctgacttatctgcgtccttgtcttttatcttagccactcgactagaataatagctaaatgaaataaaatcaacagtattttctgctaaaatttctaaatcacccgcttcaattggaagttgaacatcctcacgttctaatctttttagaagatagttaggatatttcccacgcgattgaacatcaatgaaaaagagattgtcatgattttgtttttgagcttccaacacattttctggattacaatcaaatggataatattcgccagcggccaacatacagccaattttattttctggatcaatttcatgagctatttttgttgccaaagctgaagccaaaagttcatgatgagcagccaaatacttggcttgttctttattttccccttcttcaaagacaagtcctgcccccatgaatggagcatggagtagcatattaatctcattaaatgtcagccaatagcgaaccaatcctttaaagcgagtaaaaattgttctcgccagattttcataaaagccaaccatttttcggttacgccagcccccatattctttaatcaaatgaactggacaatcaaagtgagtaatggtaactaacggctcaattcctaaacgtttgcattctttaaaaatatcttcgtaaaattgcaagccttcttcgtttggttcttgttcatctcctttggggaaaattcgtgtccaagcaattgacattcgataggtcttaaagcccatttcagcaaaaagggcgaggtcatctttccaatggtgatacatatcaatcgcttcttttgcaggatagaaatgttcctcgtcaaattcaaggtgcttcatttcccctgtaataattggaaaacggtcttttccgtgaggcacaagatcaacgttagcaagtccacgtcctccttgattatatccgccttcacattgattagctgcggtagctccgccccagagaaaatctttactaaatggcataatagatgacactccttttttattctttttttcattttaccattttttaattgtttttgatatcgatttcatcttgttttttattagaattttttcaataaataaaaaagactcaaaactattttgagtcctcttcttcttttttttcaggctctgcccaattacgacggagactaaaatgttttggaactaaatcataacctggttggcaaaaagggtgacaacgtaaaatccgtgctgttcccatcgccaatcctttggctggtccatgtttttctattgcctgaatcatgtaattggaacaggtaggataatagcgacaggctgggggaaagactggagaaatccaacgttgatagccatgtactgctttcactaatacttttttcatctatttcactttattattaagaaagaatctatacttattctccttaattttactgacagactagtcagtaatttattttttactgacagaaatgattgagaactttgtcaataaaagtttttattttgaaaggctcagaatatcagcaaccatcaattcaggggtaaggtggtagcggtcataaagttcagcaacaggaacagaatcattaaattcacgtttcgctccaaaatttaaaactttcacatcatatttcccgaggaatgaggctactttttgaccaaatcctccgtcaagaattccatcttcgatagtggcaatcacttgatgattttcaactaagttttcaaggaaagcttggtccaaatcattgatgaaaattggattaacaagtgtaggattaactccattttcagctaaaatcttagcgactttttcaccatgtgaataaagtccaccaagagccaaaatggcaactttttcaccagcttttgtcatttgatatgaactcgtcgaaaaatctgttagaactgttggacgtgattctaatccatgttctggcatttgaataacgactggttcttcatgttggtcaagtgcccaatcgagaattgaaatgaactcttcttcagatgttggagcaagatatttgatatttggaatgtttgaaatccaagtcatggctgatgagccttggtgcgtttcatctgaacctgaaataaccccacctttaacaatgacaatcgctggttcttcattaattgctaaatcatgccaaaattggtcataagctcgttgcacaaaggtcgaattgtggaaaatgattggacgagcaccagctgcagccattgccccaccaaatgttatggtaaattgttcggcaattccagcatcaatataacggtctggatatttagctgcaaattgtttcaagccaaaaattccagggattgctgcattgatagctacaagtggcaaaccttctgaaacttttttgtccatgtaatctaacatgatagagctataagatttgccagaatcagtcactttcgattgacctgtttcaagatcaaagggcatatgccagtggaaagcttcctttattttcaagggctggttggtaaccgcgacctttttcagtatgaatatgaagaacgattggatggtcaatatcttttacttcttcaaataagttgacaagtgattcaatatcatttccattttctaaatatttataatctaaaccaaatgttttaaagaagttattttcagcttgaccatttgtctcccgaagttcggctagattacggtaaagtcccccatggttttcagcaattgacatttgattatcattgaataaaatgatcaggtttccttggaaatctccagcgttattgagagcttccatagcaagtccacctgaaattgaaccatcgccaattaccgcaataatatttcctttatcctttgtcaaatcacgcggtttggcataacctaaggcattagcaatggatgttgaggtatgtccaaccgtgaaaaagtcgtgctcagactctctttgactggtataaggagtaatgtcatggaaatgtccatcagtaaatccatttttacttccagtcaaaattttgtgtggataagtttggtgggaaacatcccaaataaacttatcaactggtgaattgaaaactttgtgaagggcaattgttaattcagtcacgcccaaatttggaccaacgtgaccaccgacatttgatactttgtgaaggactgctgctcgaatttctgaagctaattcttctaattcttcatttgaaatattttttaaatctgctgggctgtctattttttctaaaactgacatttttgatttttctcctttatagatttacttagtttttactgacagtattcgcctttaaaaaactagtaaattgactgacaaaattgtcataatttggatgatactattatcttatcataatttgtcagtaatttttttctctcatattttacaacttttggaaaatttttgcaggatttgaaattgtgctgtccacacgaatcttgacaatgaattttgttcctttaggtttattatcttcaactgttattttcccattataggcttcaacaatttgtttggccaaagaaagtcccaaacctaagccacctttttggcgagttcgtgctttatctactcggaaaaatcggtcaaagatttttttcttatcttcatcagaaattccttcaccattatcagcaactgcaaaagttaggaagccaccattttttatcacgtccaccgaaatttcaccttcactgtcagtatatttcaaggcgttatcaaataatatcgtcagcagctgcttaatgagcgcttggtccaaattaactgtgccttctaatttcaagtttcctgaaaactttttgcctgcattttcggtaagcatttcataactattgaaaatattttcaaagtaggttgccgttgtgggctctggttcaatctttattccagaatcccgtcttgccaagttcaacagatttgaggtcaacaaccgcatattacgaacttcggataaactttcggagatattttcagattcgtctataattgttgccgttggtttttggaaaagtaattctaggcgattttgcaagattgctaaaggcgttctcaattcatgtgacgcattttcaacaaactctttttgtttttcataagccgctaaaattggttttaaggtccaatttgcaagatatagactgataattactgacagaatccagaaagtaatcattgtggtcacgatgacccacatcgcccgactcattgcatcttgaatttgatccacatttgaaaatatctgcacgtaaactggcgtgactgtcccatcagaatttgtaataataaattgcgaagtggtcaaataccgataatgccagttatcaccatagggattttttactgaaacagtctgaatggtattaatttgcttttcattaaatttcatagccttttgcaaacgactcatcacaaagttggtactgattcgtccgtttgattctgatgagggcatgaaactctttccttctgagtcataaaaaataacactattatttggcccataaaagccactatcttgtgaatcactcgtaccaaattgattattggcagcttcttccaaaaacactcgattttgagctaaattatgtaaattttggtcagtcgccctgtacattcccaattgcatgacttgaataataatcacggctagggcgacaaagatcactgtaaaagctagaaaaaaatgaaggaaatttttcccatcattttttacgatagctgaagatttaacttttttaattatattcttcaaagaggtctcatttctagatagatttactgacagttcttttagctagcgatttattgactccctttagcattggagccatctcgttagcactgacttattggacaagctgagttcatatctacgttaagcttgcggcttggcacaataaactggccgaagtcacatttttagtttatagaaaagtttttataaatccataagctgtcagtaaaattttatctcaagatatagccaacatttcgcaaagttgaaagattattgacaaattctgtatctttcaattttttccggattttactcatataaacctcaacaaccgtcacagttgtgtcactatcataaccccaaattcggtcaaaaatctgctcttttggcaaaataacattttggttttgcattaaataaacaactaaatcaaactctttaccaattaaatcaacaggttggtcatcaactaaagttgatttatttgataaattcaaacgaatatttccataagacaaaccattggaatcttccaatttccctgtccgttttaaaagtgcttgaattcgtgctttaagttcatctaaatagaaaggttttgttaaataatcatctgccccaatatcaaaaccatgcattttatcatccaaagattctttggcagtcataattaagacaggtgtatccacattttgttcacggagttcttttaagacttcaaaaccatttttttctggaagcatcaaatcaagcaaaatcaaatcataaattcccaattctgcttcgtagagtccttcaactccatcataaacttgtttcacttgtgcaaaagattttaagaaatcgtaaacagatttagagagtgataaatcgtcctccaataataaaattttaatcattgaatccatcccttttcacattttttaaggcaaataatttataaattatttttggttaaattggccgaaaagtcaataaaaccgcgcccaatcctttctattattttacactattatcatatttttgtcttgtactaggcttaaccctatcttaaacaaaactaaaaaagctagaactcaaattctagcttttgttgattcccgaacaattaattcaaaaggaatgattgttttttctggtaagttttctttattatctcgtaaatctaaaattttcttgatggcacttgcccctaattgttcaatatgaatatcaaaggttgtgagataagggtgaatcattgccccaaaaatggaattgttgtaagtaacgagacttacatcttctggaacatttagtccttgacttcgtaaacgctccaccacttttaaagataggacatcatccataaccactaatgctgtttcatttcttagtgaaaaattactatccatgaataataaatcgtggctgagacctaatctttctgcttcatctttaaagccttgataacgctcttcaaaaacttctgtttctttcgtatctgttacaaatgatatattctgatgatttaattgggctaaaagccgaacagcttcacgtccaaggagcatattatcattatccacatgtgtaatttcgtttttaccttctgttggcgtccctactagaacaaaaggaaccttattttctaaaagataatctcgaacttcatcactttttccagcataaagcacaatgaatccatcaacccgtttttcggataattgaagttcaacttgcttctttaattctccgaccgaatgtcccgtcgcgatagcaatcgacacatcataatcccgagcggtttcattgattgaggtcaaaattttcataaagaaaggttgacttgttttgtcggcgaccgggggaaagacaactccaatggtatttgttttcccagaagctaaaatctgagccgctgcattacgacgataacccaattcatgcatggctttgcgaacttttactttcgttttatccgaaatttctgaactgtctttaatgactcgacttaccgtggaagcattgacaccagctttttttgcaacatctttaattgtaactgccatattttcacttaaaactagccgaagctagctcaactcagcgctcctttctctattcttttttgaatctttcaaattttattttgccaaattttagactaattttcaactattttttagatttttgataaaaaagtcatccaaagcaatcaaattaccttgttttcgtaatataagaatcactcaattctacagtttcatcataaatcttaagacttaaagattgtccacgcaataattcaatttttacttcttgaccgactgaaattttcaataaacgtccacgatagttaatgtggaaggcatatcctgtccatacttgtggtaaaaatggtgcaaaactcaattgagcctcccaagttttcatttgagcaaatccatgaacaatcgccaaccatgaaccagaaataatcaccaatatgttacaccaagaaaatctaactctaaaatatgatgaatacagccattcttcttatagagatatattaaataatcttgaaaaaaaatcaactacaccatccgataaaaatatgtctgactttataattttagactatctcagccaaaacattgaaaacgaatcaataacaactttttttcagcatattatctcaacaattgaaaggaactatgactcactcattaaaatccatcataaatctttatttagtaggtacgctatcccaaacaacgataatgattttttattaaacgatgaaagaaaaagtattaaatttaaattatatgattataaacccgaattgctagttaagttcattggaaaataaataagtcgtgctatcctaatcttaaggatttctttgagcgctgttttgagggggcggtgtttttttgtctcttttaagtaattttgagtttccttagctttagcagattcagataaagaaactttcttttgcaaggcagttttaccattttggcttttagttttcttgatttgaccagtcctttcaaaggactcatctggaaaattttgcgctaattgtttgatgattgtttccaaaccaaaattactgctaatccaaaagggagtattagttgctttgcaggcttctttagcaaattgaatcgaatgatgagccacatttcgatttctcatgatgacaaagtctgatttggctacgagctggtcaatttcagctcgatttggttttttcttatcgaaaccaagaaaagtaactccaaccttagccaagccctcccgaaaatcatgccaatattttacttcacatagaataagtagtgttttcatttaaatttccttattaatagctccgtctttactgacaaaagcgaattatagtgattatatcacatttttagttgaagattttagcaaagaattatgttaagactatatcaataaagttaaaaaataataaataagttagaataagcttgaaaaagaaagaatatctttataaaattaggaggaaaagttaaaaaggagattttatgtaaaagtttaaagggagtttaggctcggtcgtgagaggacttggttttttgtttgtagtcttatttttgataatgattacatcaacaatcaataatgtattaggaataatcgtatttttgggactcttaggattcactatttattatttgttaagtggacgaaaaaatacagggaattttatttccaaaatcactaataagattctttggcttgttactcttatcttatttgttgctacaactggagtattgacagttcatagtaatcaaattaaattaaaagaagctcggacagagctaaccaagtctgataaaaaactgtcaaatttatcatcggaatatgtttcgatagaaacacaaaaagatgttaaagctgaacaaaaagatactcatcaaattaatcaaagtaaaaacaatgacaagataaaagcagagacaaaaagacttaaccaccttgtatctgttgtaaaatctgagcaaaaagcagtcgatgatattttgaatcaatctgctgagcttaaaaatgatgaaaatattttatcagaagataaagcaagccttgataaattagagcaaaaagcaaacaattatcagtcattaaagtcctataaaaaggaatctgaaaatttattagagctaatttctgttcataatcaacgggaagaacaactgaaaacagttgcaacaactttaaaagataaaaatctgtcagcacaagataaaagtcaactagacaagttagtactagagattaaaaaagctaaaaaagtttcagatatcgaagataagatgtctgagatcagtactgctttagaaactgctcagtcaaatatccaaacaaaaaacgaagtagatgataaaaaagcacaactcaattcgacagtaaaaagtgctcaaagtttactaagtgatacatatatttctgctgcagacaaaacattaattcaagagagcatagattcagttaataaagctgaaacacttgatgagttagataaagcttcgcaaaacattattgacaatacaagtaaagttaaagccaataatgaaacggctaaagcagctgcggacaagaaaaaaagagatgacgaacaaaaaagaatagcagatgaaaaagctgcagcccaagcagcagaaaatcaagcagctgccgctcaagcaagctcagattcgcaagaaaattcggcagtggcaagtggaggttatagcacaaatcccgctggttggggagtagcggaagctggctattgtttctatcgtccaagtagtcaaagatattatagttcagtggcaaatcctgggaattatacctatatgactatcagtgaagctcaaggtcttaatggaagcccagggcatagtaatggttcggctcacacatgataaatttatcaaaaaaatagatttcaaaaatttgacctagtaaaaattaagtggtaaattaatgatagatgggtatggtgcacacccgaaacggtttcaagaaataacttgaatctaatggcgcctacaaagcaaagccttttttgccttgtagtctgccattttttctttggcttacaatggcattaaaggcaaagaaaaggagagttattatgacagtcacaatcgaaaacattcacgcaagagaaatttttgattccagaggaaatccaaccgttgaggtagatgttagattgacagatggaactttgggacgggcggcagttccctcaggagcatcaacaggagatcgcgaagcggtcgaactaagagatggcggagcgcgacttcaaggaaaagacgtttctaaagctgttgcaaatgttaatggtgaaatttatgaagccttaaaaggccaatcaccattcaatcaagcaaaattagaccatctgatgattgaacttgatgggacaaaaaataagtctcgcttaggtgccaatgcaatattgggtgtttccatggctattgctcgtgccgcagctaacagtgaaaaaatcccactttatcgttatcttggtggagtagatttggaacttcctcaaccatttttcaatgtcatcaatggcggagtgcacgctgattcaggaattgacgttcaagaattcttgattacccctgtaaaacgtgctagttttcgcgatggtttagaaaaaatcgcaaatatctatcatactttgaagaaaattttagctgataaaggactagaaacggccgtaggggacgagggtggttttgccccaaaacttggttcgacggaaaatgccattgctacactttatcaagcaattgaaagagctggttatgtgccaggcgaagaaattgcgattgctattgacccggcttctagcgaattttatgatgacaaagaaaaagtctatcattttgaaggtcaaaagctcacttcagcagaattgttgacctactatgaggggttagttgaaaaatatcctgccctaatctctattgaagacggattttcagaacatgattgggctggttttgcggctcaaacgaaagttcaaggtcaaaaaattcaattggttggtgatgatatttttgtcacaaatcccgaaatcttcaaagaagggattcaaaaaggtgtagcaaatgctattttgattaaactaaatcaaatcgggacagtgaccgaagcgattgaagcgattagtttggctagaaaagcaggttataagaccatgatttctcatcgttcaggtgaaacggttgatagttttattgctgactttgctgtagccatgcacgctggacaaataaaaacaggttcaatggcgagaagcgagcgggttgaaaaatataatcaatttttgcgtattgaagaagaattattaggactagaagtcactaaatagaagttgaaaaattactcagcgaaaaaccttatatctgatgatataaggtttttttatatacgaagtcatgtcgaagtaaactactatattagaaaagttgtttaaggtaaaactgatacactgttgccagaagtcaaagcaacatcatttgcgtcgtagagagttaccaaaacagttgaactagctgtgataccataagttgatgtaaagattgagaaatttccatttccaggtgtaatttttatcaaaggttttttagcattgtctactgtaaggccgatttttgctactttagatccagtgtaagttcctgtgatatattggtcttggctggccgaaaaattatcaatatgagtgattgcatttgggataggagcttgtactactacttgagtaataggacttgtgtctttaccatctgtttctactacattaagaattgaataagcaggttgagaagatgtaagagtaatagaatatttaccagctgagtcaacagaaccgcgtccgatttcctgtccagaagaatcagtaataataatagtattaccaggagtatgtccagtaccagttactactgtataaccttcatggatagtatttacctttggcgcaggaatttcagagactttatgtttaacggttgttgttgctgcagcactcatacctacaccagtgttttggcggacttcaatagttacattctcattttgtttaggagaaattgtaacatgataaataccatttgttcctacagtaccagtgccgataactttaccaccagctttaatctcgattgttgttcctacagtaccagttccggaaatagttgtatctgtatcataaacatcttcgattgttggaacctgttgaaggaggtcgtatccagggtcaagggcatgtgtatttaaagaagtagcagtattatcatcagcaatattagtgtaatcatggtctgttactaccgtaccattgaaactataatgtgtgccgttaactgcatctgcgatacgaattcctgtctgtgtgacaaaatctccgaggtcaagtgcaatgttaacattgaagtgaaggctattagcaattccccaagtagcaggtgggttagtgaatcgaacgatggtattcccatcattgtcaacgcccatacgaatatcagaagtttgatattgatatgggtttgcaccccatccaggaccatcataagttccgctgaaataagtaatgaagcttgggtcttgagcggcctcgtctaattcactaggaaggacaagaacgaattcagtttcctggttccatccaattgatccaactgggaaacttccagagtaagtgaaatcaagttgacctgtggtaactgtattgccagaagtgaggtgtaaaccattggaaccagtaccatcaataaggacttgacctcttgaagtagtagaaagtggattaacatctgttgagacaataccatcttgtgcttgaacattcatatttgtgtctgcacttgctgagttagcgaaaagtattgccgaacttagtagtccaatagtagccattggtacaaaaatctttttattcattcttattctcctttttttaaaaacctttttttgcgattgggactatgagcgcatcctgatttcagtccagtaacattaaaatcctttcttttttctaatggggcgcttcaactattgtttacaagatttattgtattataaaaacgttttctagtcaagagaaaaatgaaattaattaattaaaatctaataaaagtctaataaaataagttttcggtaaagtttcaaaccagtaaaaaaaggaaaatcaatccaaaaggtctttttttgagaataaattcacaaaaaaaaagacctttttccatacaaaaaagcctcatttttgaaaaattcttcctatttcttggattttgcaatcttaaaatataaatctgaaagtaaaaatattgattagtaaaaataatattggctgatttatagtctaaaaaccaaatttttaagcataataattcgaaagctttaattatttcagggattatttataagaaaaaacatttaataggcagaaaatctatttttttaatagaaaaaaagctctgtaatctattgatagagcttttcggaaaaatttttaaggagaagaggggattcgaacccccgatacgcttgtgacgtatacacactttccaggcgtgctccttcgaccactcggacacttctccaacttccttaacattatagcaaaaaagctcagactttagcaaagatttttaaatgacactttatttactgataatcgggttaatttttagtagaaatataaaactaaatggttaaaagtctttaaaatttggtataataagggctatgaataaaattctcgaagtggaaaatttagtttttaaatatgaaaaagaaagcgatgtaaatcagcttaatggtgtctccttttcgattacaaaaggggagtgggtttcgattatcgggcaaaatggttcgggaaaatcgacgactgcacgactgattgatggactttttgaagaatttgaaggaattgtcaagattgacggtgaaagattaacagctgaaaatgtctggaatctacgtcgaaagattgggatggtttttcagaatcctgataaccaatttgttggggcaacggttgaggacgatgttgcttttggcatggaaaatcaaggaattccccgtgaagagatgattaagcgagttgatgaggctttgcttgctgtcaatatgcttgattttaagacacgtgagccggcaagactttctggtggacaaaagcagagggtagccgtagctggaattattgctttgcgacctgaaattattattcttgatgagtcaacctcaatgcttgatccgataggacgaagcgaaattatgcgcgtgattcatgagattaaagataagtatcatttgacggttttatctatcactcatgaccttgatgaagcagctagttctgaccgaattctggtcatgcgagccggtgaaatcattaaagaagccgcgccatctgaactctttgcgactagcgaggatatggttgagattggacttgatgtgcccttttcttcaaatctaatgaaagatttgcgcacaaatggttttgatttacctgaaaaatatttgtcagaagatgaattagtagagcttttagctgataaattgggctagatttactgacagatttttctgtcagttcaaggcgattaagattagcattgaatcggcaaaattaggaaattttagcttgttagaatttctgtcagttcaaggcgattaagatgagcgttgaatcggaaaattaaggaaattctagtctgttagaatttctgtcagttcaaggcgattaaggtgagcgttgaatcggcaaatcaaggaaattctagtcctctagaatttctgtcagtaaaatggatattattggatttgagaaaaaagaaaaatgattaaatttgaaaaagtaaattatacttatcagcccaacagcccttttgccagtcgtgccctttttgatattgatttagaagtcaaaaaaggaagttacacggctttaattgggcatacaggttctggaaaatcaaccttgttgcaacatctcaatggtttattgcaaccgactgagggtaaagtgaccgttggggatattgttgtaagttcaacaagtaaacaaaaagagattaaacctgttcgcaaaaaagtaggggttgtttttcaatttcctgaaagtcaactttttgaggaaacagtcttaaaagatgtggtttttggcccacaaaactttggaattcctaaagaaaaagctgaaaaaatcgctgctgaaaagcttgaaatggttggacttgctgatgaattttgggaaaaatctccttttgaactttcaggaggtcaaatgcgccgcgttgccattgccggaattcttgcaatggaaccagaagttttagtgcttgatgaaccaaccgcaggccttgacccgaaagctagaatcgaaatgatgcaactttttgaaagtattcatcaatcaggacaaacagttgtcttagtcactcatttaatggatgatgtggctgattatgctaactatgtttatcttcttgaaaaagggtatatcattagctgcggtactccgtcagacgtttttcaagaggttgattttttgaaagcacatgaattgggcgtgccaaaggcaacgcattttgctgaccaacttcaaaaaacaggagcggtcacctttgaaaaattacccatcacacgagctgagcttgttactttactgacaagtctgttagtaaattcaggaggtgaaaactgatgcaaaatatgctgatgggacgttacattccaggtgacagtatcattcaccggatggacccgcgttcaaaacttttagtcatgattgcttttgtcgtcattatctttttggctcatgattggttaggctatcttcttttagtactttacactttggccggtgtcttactatcaaagatttcagtctcttactttttaagtggcctgcggccaatgattggtttaattctgttcacagtcattttccaaatgctttttaccaacggtcaacatgtcatttttagcttatggtttatcaagatttcgacagaatctttgattaatgcggtttatattttcttccgttttgttttaattatctttatgtcaacgattttgaccttaactacaccaccattgaccttagctgatggaattgaaaaaggcttgggtccattgaaaaaaatcaaagttcctgttcacgaattaggtttgatgctatctatatcattacgttttattccaacattaatggatgacacaacaatgattatgaatgctcaaaaagccagaggaatggattttggcgaaggaaatctgctgaaaaaaattaaatcagtcattccaattttgattccacttttcgtcagctcatttcgtcgtgccgatgatttagctgtagccatggaaagccgcggttatcaaggcggcgatgggcggacaaaatatcgtcagctcaaatggcaaagtcgtgacagtctactggtcgtaagtattattatcatgaccattttacttattctatggtcaaaagtttcctagaaaaaatttagaggagaaaaaaatgataactttaaatgtcaatagtttggaaaatgccgaaattttttggaaagaactaggtttagaagaggaaatagccctcaatgaaacctatgacccagctccagaaacgttggcaatttcagtagaaacaatcgatgaaatccatgacaaaatcatcgaactcggactgcaactaagtccaattaccaaaagcgctgatggaagatatctgttttcctttatcgcaccagaaggcaacaccattatcatcatcggcgaatgggtcgaaagaccttatacaggcgagatgcggacagaattttttgaaaatataaaagacgtcctaccgcttgcgcctgtacgtttgtcagaactgacagaaggacaatttgttctttttggacgtgtcacttgtccctggaccagaagatttgccaaacagcttcctggctacgctgacaaaacgatttactatgttgatacagaaaatacagaccttgataatgagttgcaagccattcgcaaagcccacgaaattaacactgtaccaacatttatgaaacgtggagctgatggaactttcgtcaaatttgacgagaaaatagaaagtctgtcagactttatcagtcagtagcacacaaaatcagagcaatctgattttttttattattactataaaaacgcttacttttagctgatacactacatgtatcaggttttgacaatcctgtcaaaaccaatacttaaggagctttttatgaaaataataaaaaaccgcagaaattttattctcatcagccttatcgcccttttttggctgacatttagccttgcactgccttttcgccttgtcggcgatgacccgcaatatttcacagccttacatgattttcatggaaatctgatttcgtatcttgtcaacgattataaaacttggtcatcacgaatgattggcgacggactaaatgtccttctggttcatcatgtcagactttggcaaatccttgaagcgcttgcttttacgataatttttgtcttaccagcttactttttcaaaaactcatctaaaaattgcgcaaaatttcttttgatttcatttactttatcttttctttttcccatcggtctgatttatcgcgcgggttacgtagccacaactgttcactatctctttcctttcgcctgcctccttttagcgatttttccttttattcaaaggcttaatgaaaagaaaaacccaatttttctatggataattagttttctagcatttatttatgccattttagagcaacaaaccctagtaatcttaggaattttcctcacttcacttattatttatctatttattgaaaaaaagtggattcgtttacctctcacttaccttgtttttgcattcctttcccttattttcagtctcactgccccgggaaatcatttgcggacaatcagcgaaacaaaagcatattttccaaattttggtcaactttccctctttaccaaagctaatatgggatttgcttcactcacatcatctctcttcacaaatacttatttgctccctcttattttcttgctgacagtctttgttttactcattaaacaaggaaaaatttgtaaatcactgattattttaccgccaattatctttagtgtgattattggttttgacgcgtccagcttacaagatcttatcgtctcaaagttagacttagcaacaaatgcaggaactctgactcgcctacttcttacttttctcaatatgaataaagtcaataatacaggcaatcctgtgatgaccagtagtttagcagatatcctatttttactcctcatcatctgcctatttttagcgatttattggcttttcaatagtaatttcaagaaatctttactttcttttcttgtcctattgacaggatttttaagcagatttatgatgggatttttcccttcagtctggatatcaggcgcacgaacagcaacatttttactctatagttttatgtttgcactccttatcatcctttatcaactcaacgagagcaaaaacctcgaatagaactttttttccgaacaatgctataatgttctaaaagaagttccgaggagaaaaatatgacccaagcacaaaaattatccgcccaagaaattattcaatttatcggcaatgccgagaaaaaaacacaggtcaaagtcactttgtcaggaatgcctagttttaaatcagccggttttcttgcggaaaacggtcgcccaaactttaaggcacttgccaataaagggattcaagttttgggcgattttcacacccattacagcctgaaaatcatcattggcgattggcaagccgtacgtcccttgcttgaaggattgactgaaaataaagattacaccattgaatttgaaggcagaaattcagcagtcccacttcttgacacacgtgctatcaacgctcgaatcgagccaggtgcgattatccgcgaccaagtcacgattggcgataatgcggtcatcatgatgggcgctatcatcaacatcggagctgagattggcgaagggacgatgattgatatgggtgctgttctaggtggtcgggcaactgttgggaaaaactctcatattggtgctggtgctgtgcttgcgggggtcattgagccagcaagtgccgaaccagttcgtgtgggcgacaatgtccttgttggggcaaatgccgttgtcattgaaggtgtccaagtcggctcaggctcagtcgttgctgcaggcgcgattgtcacccaagacgtcccagaaaatgttgtggttgctggtgtcccagctcgaatcattaaagaaattgatgaaaaaacagcgcaaaaaactgctttagaagatgcccttagaaatttgtaaattacaggaaatagataatttctgaacttttgttacttttaacaaaagtttttttgataaaagtagaaattcacaggaaaaaaagagtaaaataaataaaaaaacttttgaaatttagcttagtaatgaggacaaatatgataaatttaatcgaaatccgacgtcaacttcaccaaattcccgaaattggacttgaagaacataaaactcaaaaatatttattgacgatcattcatcaaattattcaaaataaatcttttattcaagttgaaacttggcaaactggtattttggtatatttaaaagggagtcaaggccaaaaaacaattggctggcgcacagatattgacggacttcctgttgaagaattgactaatttaccatttgctagtaaaaatggacgaatgcatgcttgtggacatgatattcacatgactgttgctcttggtttacttgaaaaattgagtgaaagtcagcctaagaataatcttctttttctttttcaacctgcggaggaaaatgaagcaggtggcaaactaatgtatgatggtggagcttttaagaattggctccccgatgaattttatggattacatgttagacctgacttaaaagtaggagatattgccactaatgaacagactctttttgctggaacttgtgaagttgagttgactttcgttgggacaggaggacatgctgcttttccgcatacggcaaatgatgcactcgttgctgccgcttatttcgtcactcaagttcagacgattgtgagccgtaatgttgaccccttagattcagcagtggtaacattcggaaaaatggaggccggaacaaccaataatattattgctgaacgtgcctttttgcatgggaccattcggagtttgacccaagaagtcaatgaattgactcaaaaacgtttgaccgaacttgccaaaggtgttgcccaatcttttgatatgaccattgatttaaaactcaaacaaggaggttatcttcctgttgaaaataatcctaaactggcaaaagaactcatggatttttttagaaatgaaacaaaagcaaatctgattgatattgcaccggcaatgaccggtgaagattttggttatctgttgagtaagattcctggggtcatgttttggcttgggattaacagtgaagctcctttacattctcaaaaaatgcaagctgatgaagaagtgcttgattttgctgtagaagccattggtcaatttttagattttaaagcaaataggaactaataatatctgattttttcataaaaaaataaattaacaactttaatattgaatagggatatgttattatagaaagatagaagttaaaataacatttttgtattaatggtgttacaaataggactttttcgaaatatataggagtttttaagaagaaaaatgagtcaaaaaagaagtgcaagatcaaagagttcaaaaaaggccttttggaaactgacgttgattatgggagccctgctgattgttgtcgctggaatcgggacatattattacgatcaaggagttcgtaagcagaatattgcttatgaaaagcaggtaaatgaagcaaaagaagccaaagataaagcctataattccagaaaaacaagcgacattaatgaagcaaaaaaactaattgttaagctccatgagaaagataaaagtagtctaaatcaatcaattactcaacttttggcatatttgacagatattgataaagtgagtcaactggttgctaaagagcatcaaaatatcaccgaagatacgataaaagaagcagagcaagctcttgaacttttaaatgcttcttatgaaaaaacagataaagaaaaatttgctcaacaaatcgctactgataagcaagttcttgttgaacgacaaaaagaggctgaacgaattgctgatgaaaaaaataaattagcaaatcaaaaattgattgctttgacttttgatgatggtccaaacccgactaccactcctcagttactaaaaacattgagtgctgcaaaagttcccgctaccttttttgctttgggtaaagaggctcagcagtatcccgatattattaaagaggaatctgacttaggaaatgaagtcgcttcacatacttgggatcataaagatttggtgactttgtcaccggctcaacaaaaacaagaaattgaaagtgccaatcaattaatcaataagattacagggaaaaatgtcacgctctttagacctccgtacggaagttacaataattctgtattgtgccaaactgatttaacagcagtcaactggtcagtggatactaatgactggcgttaccatacaagcgcaccggtcgttcaaaatgtagcgacttatgctcatgatggtgcgattattttgatgcatgatattcatcagtggtcagtagatgccgtaccacaaattattcaaaatttgaaagcacaaggatatacttttgtgactgtcagtactttattggatattcgaaatgggggcgcaaaagcacaacaagtgtattttggcagataaattgatagaggaatagtattttatctattcctttttttgctgacaaaaacctaatttattttaaatttttgcatgtaatgagtttattcttgacaacttttgggaaacttggtatactaatatagtcgtttaagagaaacgcaggcgtggctcaactggatagagtacctgactacgaatcaggcggttgtaggttcgaatcctaccgcttgcataaataaaatatgacgaaagtcatttttttatttgaatgctttaaaaaaattatattagctacgggaagtagctcagcttggtagagtacttggtttgggaccaaggtgtcgcaggttcgaatcctgtcttcccgattaccgactaaccctaactcatctttcgtggatgagtttttttgataccaaaattagctaatcttccataattcttgaaagtgttatcaagatatgataaaattcaagtgataatgtgagttgagggaatctctaaaagcgagcattaaatgaaaggagccatcatggcatataaatcacataaatttggtaaacgtaacggaaaaaaacactttaacgcagtaggtgtaagaactgcaccaaaaccagaagctaaaaaagaagaaaaataattaattttatctttctaaattcttgactcatctattgaagatgggtttttttgattccaaaaatcgctgatatactatgtatatcaggtcttgacattctgtcaagaccaatactaaggagcgatgatggaagaaaataagaacttatttaagagaaaaatttttccacttttaataatcacttgtgcgattacattgacctattttccttattttaagaatacattcggtattgatacgagtacgatgataaaaagtcaaggacagatgttaagtggctatttgtcgcaaggacgttttggaatggtctggatttttgaacttttgattcatcgttataataatcaaattgttccgtttattgttatcccacttcttgttggtgctgggatttatctttatttcactttaaataagtatgataaagagtcatcggattttgcggctagtttatttgcgattgtttttatctgcaatccagtggtttatgcccaactttattttaaaatgcaagcaattcagattgtaataggggtattttgtgtacttttgggaataaatttgagcttatcaagacttagaacttcagttaaaattattggttctgtcttattatttgctttttcatttttgatttatcaagtttttgtcttctttattttttcaatgattttattttgtttttacgtttttagagataaacgtcagcaaattttgcaagtcatggtgcctagttggcttgttgcaagtcttatatatttcctaagttattttctagcttcatttatgattcactattcttcttatggaaatgaaacttatatgatgtggaataaattacctgaactgggaaatttgcaaaagataggcgctttatttattgcactatttgccttagcttatctgtttttattgataattactaattgataattactataagaagatttagagcaaaaaaagaaatcaatgtcttattattgatactgttgattgggtcaataatgacatttaacatggcttttggtaatttacggcctgctcctcgtgtttattttggaacattttcgacggtcttttctggaatattatacttgggaattagaaaaggaaatggtctgaaatatctttttttgctgattattttattttctatgttttttacttttagcctttctcataaggcgaacttatcttatgaaaatgaccagattttgacggaaaacgttatgaaatatgctcgagagcataatatattggaaaatggaactaatcttgtctttaatggaaatttacaaacaggaaatcagggaatgcttaataaatttcaagatatttttattacaggtgctacgagggtatcttttttccaatttgacccacctttgacgtctttaagaccttatgattttatggaaattaaaggctatcatttcaaaattcctaccccaaaattgagagcaaatcttagtttgaaatatgaacatttaccaaattatccgagcgaaaaatcaatgttttgggataaaggagaaaatgcgcttcttgtgaagctttctaattgagcttttcttgacaaaataaggatttttggtataatagaaaagttgaatatagcagtcagctagaaagctcgtcaacattttgctgttatgtcaaggaagataagtcattatgttccttgtgtcaagtaactgaagctataagcgaaggcaaaatgaacgaattcgaggctgtcaatattcttcaaataaaatatttggaggacataaattatgtcacgttatactggtccatcatggaaacaatcacgccgttacggaatctcacttactggttctggtaaagaaatcgcacgtcgtaactacgtacctggacaacacggtccaaacaaccgttcaaaactttctgaatacggtcttcaattggctgaaaaacaaaaactccgttttacttacggtctttctgaacgtcaattccgtaacttgtacgttgctgcaactaaagttaaagaaggaactgttggttacaacttcatgactttgcttgaacaacgtcttgataacgttgtttaccgtcttggtcttgcgactactcgtcgtcaagcacgtcaattcgtaaaccacggtcacatccttgttgatggaaaacgcgttgatatcccatcattccgcgtacaacctggtcaagtgatttcagttcgcgaaaaatctatgaaagttcctgcaatccttgaagctgttgaagctactaaaggtcgcgctaacttcgtatcatttgatgctgacaaacttgaaggaactcttgttcgtcttcctgaacgtgatgaaatcaacccagaaattaacgatgctcttatcgtcgaattctacaacaaaatgatgtaatttcttataagcattttgaaatcgctcctatttgggagcgattttttcatcatttttttggtaaaatagagataagcgttgtgattaagaattgctgataaaaaaactagttaaggattatttctaagtggaaaatgttaaaaaaattgctgaattattgaatatcaaaaattcacaagttgaaaaagtattagaattgacggctgaggggaacacggttccttttattgctcgttatcgtaaggaagcaacaggttcacttgacgaagttgaaatcaaaaaaattattgatgaagataatttactgaccaaactttcagaacgtaaaacagctgttttgtcaaaaattgaggagcttggcaagttaactgattcgcttaaaacacaaattttggctgctgaaaaactgacagaagttgaagatttatatttgccttacaaagaaaaacggcgcacaaaagcaacgattgcaaaggaaaatggtttatttcctttggcacaattaattgtaaaaaacgctgctaatcttgaagaggaagcagaaaaatttgtaaatgagaattttacgactgctcaaaaagcattagagggggcggttgatatcctatcagaagccatttctgaagatgcgcggttgcgttcatggctgactggtgaaatcaaaaacaatagtttactgacaagtagtttgaaaaaagatgccgttgatgaaaagcaagtttttcaaatgtattatgaattctcagaaaaagtttcagaattaccaaattatcgtgtattggctttaaaccgtggtgaaaaattggggattctgtcagtaaaatttgaaaataacgaagacaaaattttacgttattttgccgcccgttttgctgctcaaaataatccaatgatgcaagtggccattaaagatgccgtcaagaaaaaattgattccggctatggaacgtagtattcggaccgaactgacagaaaaagctgaagcttctgccattgaagtttttggcgaaaatttgaaaaatcttttattggttgcaccgcttaaaggccgtgtagtcatgggatttgaccctgcttaccgtactggagcaaagcttgctattgttgatgaaacaggtaaattattgatgacaactgtcatttatcctgtcaaaccagcaaatgcaggacaaattgctcaggcgaaaaaagatttagcaaaatttattcgtgaatatggcgtaaatatgattgccattgggaatgggactgccagtcgcgaatctgaaagttttgtttctgaagtcctcaaagaaaataatttttctgatgtttattatgtgattgtcagtgaatctggggcctctatttattcagcaagtgaattggctcgtgaagaatttccagaattgactgttgaaaaacggtcagcaatttcaattgcacgtcgtttgcaagatcccttagctgaacttgtaaaaattgaaccaaaagccatcggtgtgggtcaatatcaacatgatgtttctgagaaaaaattgacagaaaacctagattttgttgttgaaacagtcgttaatcaggtcggtgtaaatgtcaatacagctagtcctagcctgctttcacacgttgcgggccttaataaaagtttggcccaaaatgtggtcaaatatcgtgaagaaaatggggcgcttaagacaagaaacgaacttaaaaaagtcccgcgtttgggagctaaggcatttgaacaagcggcaggtttcctaagaattccagaaggaaaaaatttccttgataatacaggggttcacccagaatcttataaagtgactgagcaacttttgaccgaaattgctgctggacctgctgtcagtaatgaagaattactgaccaaactttcgtcagtaaatattcctgaaatggctgaaaaacttggtcttggtcaggaaacattgaccgatattatcaatgatttgcaaaaacctggtcgtgatttgcgtgaaagctttgatgcaccaattcttcgtcaagatgtcttgtcggctggagatttacaaattggtcagcaacttgaaggcgtggtccgtaatgttgttgattttggtgcctttattgatataggaattaaaaatgacggcttggcacacgtttctgatttgagcaaatcatttgtcaaaaatccaagtgatgtggtcgctgttggacaaattgtaacggtttgggtcaaatctcttgatttacaaagaggaaaaattaatttgaccctagtgaatcctcgcgaaaaagattaattctgtcagcaaatttttctgatttcagttccgttagatgaaactctaatccaaatttactgatagagagaattgataagaagcgaaaaaaatactgacaaccttcttagattgttttgccaaggagaagatgtgcttacaaatcaagaattgacgaaaaaggtaagagaaatttctttaaactattttaagcgtccatttgaacatgaagcaaagtggaatcagcgtttacgaactactggtggtcgcttttttccaaaagatttacatcttgatttcaaccctaaaatggctgaactggagaattttgaaggagtagttctacatgaattaactcattaccacctctatcgcacacaaaggggctataagcatcaagatgctgactttaaaagattacttgctcaagttggtggccttcgttatgcaccagcagtagaggaaagaaaagtaaaatatgattatgtctgtcaaaattgcggacaaaactatcccagacaaagaaaaatcgatacaaaaaagtatcgttgtggaaaatgtcgtggtcagttgaaaataaaaacaagcagaatttagcaattctgtttgttttttattagttattaaggtatttatccacattttcttcactttttccccaaatgctgtgaataagtatcgtgaaattggggataaatcccccaaaaagggttaattgagccaaagaaatcttatccacaacttgtattgaaaagaatagagatgaggattgatttttttgacaaaaaagcgtagaatagtaaaaatacatttttgaaagaaatattcgagcttttgggctcgaaatcttttatatcatgctctaaaaattggacgaaaaagaaaagggagatactcgtgcttaaatcagaaattattgctcaaatgccaaaagttgaacttcactgccatttagatggctcgctaagcttgtcttgtatcaaagaactcgctaaaaatgccggtgtgaatataacgatgactgatgaggagattttggaaaaggcacaagccctagaaaataccaaaaatttactggaatatctaaaacgttttgattttgttctgcctcttttacaaagctatacaaatcttgaattggcagcctatgatgttgttaaacaggcagctgatgatcatatcaaatatattgagattcgctttgctccaactcaacatttattagaaaatctaagtctagaagaagcggtggaagccgttatagctggtctttctcgtgccgaaaatgattttgatataagagctaatgcactcatttgtggattaaaacaagagccaattcaaaagttacaaaaacttctgcctctttttgataaaattcctgatgaacaccttgtcggatttgatatggcaggagatgaattgaattatccacaagaaaaatttattgatttgattcatgatttaaaaattaatgctgtaaatgtgacgcttcatgctggagaatgtccagcatgtgagcaaaatattttagattcaatcgccatgggggcaagtcggattggtcatgggattatgaccaaaaatctatccaaagccgaacaagaaatgatgattgaaaaacaaattgttttagagatggcgcctacgagtaattttcaaacaaaagctgtgacggagcttgcacaatatccttttaaggaactgtatgataaagggcttcatgtgactttgaacacggataatcggacagtttctgccacaagtctaaataaagaatatgaaaaaatatcagcttggtatccagatttttctctagctgattttgaaaaaattaatcattatgcgattgatggagcttttataagcaaggaagaaaaagaacaacttcatcaaagctttatcaaagaatacaaaaaaatctctgaataattcagagatttttttattttaaatcgcgattttcgatgacatctgcgtgaagttcacgatgcttaaatttccaaccagattctgttttttcaaagctatcatcataacggagataagcaatcatcagtgatttttccccattttcttttgtgatgacatgatgagcaatagtataaacataggcacttgcttgccttggcttttcactgtcaagagcaatttggacttgtccaatgaaatgaaaagttttttcgtattgtttgagggcttcaaaggttgctagcattttttctgacgtattaatttctcagccttgcccttattccatggataataaacgctcattgagccgtcttttgtgaaaaggtcgaactgagcttttgtttgccgagtgtctgcataagtcgcatagttattgattaatgtttgaatttcttctttgttggtcattttgatttttctctaagatatgagctatagctcaattaatctttttctttttgtgctaattgctcatgaaaaatgattttgtctgctaaaaatactcttgttttttcaagttccgctattttattgtccaaatcttgcgccgttttctttaagagttgaacggaaacttgatgattcatgtaatttttaaaaatttcgtgaatatcttccaaactgacaccagctgttcgataatgtaaaacgagctctaggcgtgttagactttcctcgtcaaagattcgattgccatttttatcacgaggaatacttaagaaacctttacgctcgtaaaaacgaatgctggaggaggaaactttaaatttgcgagaaacttcttgaatcgttggcatttttagctctttcattttaagtgagttgaagtttttattatttcattacttcatgtttagagtatatcagcttaaaccaggtttaagtcaagaaaaaagattattttgaataaaaaaatactgacagacttccattctaataagaatttggttctgtcagtaattttttatttttcatcaggtgtcataatcattggaacaacaagtggtgagcgctcagtttgtttataaaggaatggtgagagtgcttcacgcatcgcacgtgctacagacgcttcattagcattttcttcatgcatggcttcacgtatagcattgaaaaggacacgttggccactacgaatcaaatcaccagactcacgcatgtaaatgaatccacgtgagagcatatcaggtccagcaagaacggttttcttttcaaagtcaacggttgccactgcaagaacgattccgtcttctgaaagttcatgacggtcatggagaacggcatttccgacatctccaattcctgaaccgtcaacataagtatcggcagccgggaaatggtcagcatatctggcgctgtcagcagtcagtgcaaggacatctccgttttcttgaatgaaacaattttctttagggacaccagtatcttgagcaagtccagcatgaattttgagcatacgatactcaccgtggacaggcataaagtattttggtttgataagacgcaacatgagtttttgttcttgttgtccaccgtgacctgaagtgtgaatgttgttcatcttaccataaatgacttcaactccagcttcagcgattttgttaatcaattggttaacaccatgagtatttccgggaatcgcatttgatgagaagacaacggtatcgcccatttgtagggtaatatgacggtgcatgccattggcaattcttgaaagtgcagccattggttcgccttgcgaacctgtacacataatcaaaagttcatgtgaagcatattgattgacttcatttggttcgataaatgtgcccttaggcgctttgatataaccaagttctaaaccgttaacaatggctttttccattgaacgaccaaagacaacgattttacgcccagtcttaactgctccatcaacggcttgttgcaaacggaaaatatttgaggcaaaagaagcgaaaataatccgaccttcaatacgttcaaaaattttcatgatgcttgcaccaacgactttttcagaatgtgaaaaagttggaatttcagcattggttgaatcagaaagaaggagtaagacaccttcgctaccaagttcagccatccgatgtagatcagcaggttcacccactggtgtgaagtcaaacttgaagtcaccggtcgctacaattttaccttgaggggtatttacaacaattcctaaaggttctggaattgagtgagtggtacggaagaaatcaagactcaagtgattaaatttaatgactgaatcggcgtggatttcgtagagtttagcatcacgtaaaagcccgtgttcttcgagctttccacggatgagtgcaagtgacaatggcccagcataaatagggatattggcttgtttcaaaaggaaaggaattcctccgatatggtcttcgtgtccgtgagtaatgaagagccctttaatccggtcgatattttcaacaatataagtgtaatcagggatgacgtagtcaacacctaataaatcgtcttctgggaatttaattccggcgtcgatgatgatgatttcatctttatattcaacgccataagtgtttttaccgatttcgcccagtccgccaatggcgtaaactgcgacttcatcagcttttattttaagttgttttggcatgtttctcctattctttggattttattagttatttttactgacaatgggtcagttaagtatcaagagttaaaaatttgttgacaggactgaatacagactgcctttttaaatttaaaggtacaagaaaatcactttagattgctgtcatttttgacaataatctaaagtgttctcctttgtactcctgttagtcttagaagcttgtgatttcaaatacgccagtttctttttcatattcaacagattcatctgaaagtgagtcaataaactcaacatggtaagcagtatttttagcaagaagttcgcgggcaaggacaaccccttcttctttagttgcgacatcaaggtcgagataaagggcatcagttgtctcacggcgaggtgagcgtgtgttatctttttggtagaaaactttaaaaatcattctataatttacgacgagcaaaagctcgttcctttcttaatagttcgtgtttgctgttctttgcaattattatcattttagcatatttgcaaggaaatggaaagttgcgctcattaatttcacaaatgaaacgcttcctaaaaaataatggtggaacttgcaaggcaagcgtggtaaaatataaggaagtagatactgataatcgagataaagtaaaaaattatttaaaaaggatgatttgacaggaaattaatcaacaagattcgctttgaaactgccagtcagtcctatcagtgacttataaatcaacaactttcagaaatattataggtaaaaaatgaatatattagcatttgatagctcatcaaaggctttgtcagtcgcattgcttactgacggattattgcttggtgaagtgacactaaatttgaaaaaaaatcatagtacgacattgatgacgacgattgattttttgatggctcaggttggcatggaagcaaaagaccttgatcgaattgcagtagctcaaggtccaggctcttacacgggattgaggcttgctgcaactgtaggaaaaacgctggcctttagtttgaataaagaacttgttggcctatcaagtttacttgcgattgccaatcgtgttcaagatgatgaagcctatgttttgccaattattgatgctagacgcggaaatgcttatgccgccctttataaaaatggtcagcaaattattgccgaccaacattgtaattttagcgaatttttggctgatttatcagaaaaattttcagattttagcaaagtaatttttactggagaatctgaaaattttgttgatgcaattcaaaatgctggattttcaaaagaacaaatcatcgctgacagcttggaaaaacttccgtcagcttatgaaattgcaaaaattgccgaaaatttagttcctgaaaatgtgcacgcttttgtgccaaaatacctcaaaaaagttgaggctgaagagaaatggttggaaagtcatgaaaaagctgaaaacactcctgacgactacgttcaaagggtttagtggaaaaaaatttaatcctcgtcgttatttagaaatggccgatattgaccttgaacacgatcgagaaggtgttcattatcggttggcagatagggtggatattgtggctctacttgcgattgagcgagatgtttataatggagatattccatggactttctcgcattttgaacatgaaattgtcaaaaatgatgaagcttttttcattgtggctgaaatttctggtagtgttgttggttttattggcacacgaattaatcatcatggtcaagacgcacatgtcactaatttggctgtctttaaagctttccaagggcaacagattgcctcaacattgattgagcagttaatttctctaatggcagcacttggaaaaaatgtgatgaccttagaagttcgccgtgataatacaaaggctcaagggctctatcgccgccaaggctttgttactgacaagcttcttcctcaatattatgaggatggtgccgatgcaatttggatggtcaaagaattaaaaaaatgaatttaaaacgtctgtcttactctgaaaataagtcgaaagacaaaaatacttttccacctgtggaaaagttatcagtcaatatttatgaacttttatcagtggcttatggacagtcgccttggtcacaagtttatatatcgagtgatttagtaaacgaaaattcggaatactttttactagaagaagatgagcaattaattggtctgctagccatttcaacaatgatggatgaattagaagtgaccaatatcgccattcatcctgattttcaaggacaaggtttagcaaaacttttactgacagaattatcaggatttacaggaactttatttcttgaagttcgtcagtcaaattttgctgctcaaaaatgttatgaaaaattcggttttgaaatttatcatactagaaaaaattactatgacaaacctcttgaagatgctttgttaatgagaaaagagcaattttaaaaatgaaagataattatatattagcctttgaaacttcatgtgatgaaacttcagtggcgattttaaaaaatggaagtgaattattatgtaatatcattgccagtcaaatcaatagtcataaacgttttggtggggttgtgcccgaaattgccagccgtcatcatgtcgaacaaattaccgtttgtattgaagcagcgcttgaagaagcggaaatttcagctgaccaactgacagccgttgcggtgacagaaggtccaggactaaacggtgctttattagttggaatcatggccgcaaaaacttttgcttgggccaaccatctgcctttgattcctgtcaatcatatggcagggcatttgatggcggcgagtttagtcgataccatcgaatatccggccatggctcttttggtttcaggtggacactctgaattggtttacgttgaaaaagaaggaagctataaaaaagttggcgaaacacgggatgatgcggccggtgaagcttatgataaagttggtcgggtgatgggattaacttatcctagtggaaaagtcattgatgaactggcccataaaggtcaggacacttacaatttcccacgagctatgatgaacacacatgaagtagaatttagcttttccggattgaaatcagcctttatcaatcttgtacataatgaaaatcaaaaaggtaatgatgtgattgccaatgacttagaaaatctggcagcttcttttcaagcagcggttgttgatgtactgatggctaaaactaaattggctatggaaaaataccctgtcaaaactttaattattggcggtggagtatcagcaaaccaaggcctacgtgagcgtctgtcagcagaaattactgacgaaaaattaatcattccccctttgcgattttgtggggataatgccggtatgattgcagcagcagcctacattgaatggaaaaaaggtcttgaaaatgttcaagcaggattagacttaaatgctaaacctagccttgtttttgaagatatgtaataaggagaattttaatgatgaaattaatcggaaaacttcagaatggtatgacctttactgaagaatttgatggggtcaacgattttttagcccttcaacaaagtgactacaatgcaatcgcagacgaaatcgaagttgttgaagtaaaaattgctgatgaagtccttgattttcaaggaaatatgggtcagctctattatgaattaatgaagtaaataaaaagttactgacaaatttgtcagtaactttttttagttagagttggtttatcattaatattttagtctgtggaaaactttctttaagctctttcagatgaactttgagctctggataacaaaggatataatcaattatttcacctttcttcgtcagtaattcgctcaaatatgttttttgaagttgagcttcatagccaacgagctctttgccttttttagccatggtttttccatttctttgtaagcaaacatttttccgattgataagccagcctgtgtttctagtgataagtcgttgcccaaaagcagataagcagtagtcatgtaactgccacctttttgaatattataactctataaaaataaattgaattaaaaaaaccttccaattatcggaagaatttcttaaatcttaagtcaatcaaaattactgtactacagatagttcgtgaatgctgcgtccctctttgtcgactaattgtagccagctattcgttccagcaaaatagagaaaatgtccgacttcattgactgatttcaagacaatatcagcagtggttatgaaagttttagggtcccagttttctttttgctcttctctaagcgtttgcgtgaaacgataagctaaaccaggtgtaccatctgatttcattcctccgctttcagcgatttttgcccccgctttaatgaccaattcgttagattttcgccaaataatcgtggcttgactgtctggtcgtttaacaaaaaattcaatttctgaaagtccttttttccaacgatgttgcgctttgggagagaaggcttttttcttttctaatttaattccaaaagcgccgagtgcacttaaaaattcatctgcataagttgcacaagctttttcgatattattaggaattttaagtggttctgccttatcacgcaaattaattccagcttcctcagccaaattgaccaaatactgagtcagataatttgcatctaattcataagcttttacatttagaatcacaaccttatcaaattctaatttaggaattaattctaagtcattagctatcattttaatctgtcctttttttaataaaaagaaaagttcatcattatttaaatcaaaacgcgcattgttttgttccaagagaagtaaacgggcctctgaaggaagatgaatttctaaaccgaaatcagacagagtgaccgtaaaagttaaatttttcataactttattatagcatacctctttcaaggtaagggtgaatacatttcgcaaatggctctacaccaacgataaggagctttaaggaagaactataagagctagagctttcaatgtcaaagtctccaattgactccataaacttctcccctctcaaaagagcccgtccagcttatcggaaagtgatttttgcctattaggatacaagtgtccgtaggtgttgtaggttgtcttaatggatttatgtccgagacgctccttaatcacataaggagactcctcgttctctatcaagagtgccacatgagaatgtctgaagtcatgaatacgtatcttcctcaacttggtggtgcgagccatgaccttatcaaaggcacgtttaactctgaattcattgagaggctcagggataaactgaaagagctgtaaagtattggggtcttcacaataaggcgtcaagagttctctctatttatatctccatgcttgaagttcttgggtcaagctcttgtgaatggtgatcgagcgatagccagatttcgtcttgggtgggtggaaggacatctgcccatcaggtaagcggacaagggtcttattcacattaatcgtttgtcttgagaagtccacatcttcccatgtcaaagccaagagttctcctttacgcatccctgttgagaaggctactttgaagaagagctgataaggatactcctctacctcaaagagtgacataaaggtgttgaattcgtcaagcgtccagtaatgtatcggttgaggagattcaggaagtttgcgtagggctaaacaaggattgtctggacgaaagccttgtttgacagcggtattgaagagcttactcagttgtgccatgaggcggttgattgtgcttgcctctaagttcttcttgatgagggtttgtctgaagatttccatatcttttggtgtgagtttgtctatcttggcattctcgaagtacccctcgaagtgtttacggtagtagacctcttgggtatggaggtaggtatctcttctgtggttatttttgtcctcctcttgggtgagtgtgtagagtaaatcaatggttatccctttgattttagaactgtctccgaacttttggattctgagttgaggtgttctagcgtaatcgcttcacgtctggtcttaataccgcgtttgatgtggcgtctacatttgcctgtgacagggttgaccccgcctgagatgtcaatgagccaaagtcctgtttgtttgtcttttcttaccgtcatgttcgtggtctccttattgtgtttttgcattgtgacaagagagagaacgtgcctctaattcttgtctgagtatttgtcttgcttgagggagtgctgggggtctaaagccgaggatgttctcaagggaagaggagggaacagagccgaggtttggtatagcgtagtaatcaaagccttcatcgactaagtcttgcttggcttgggcaagaagggcagaaacttgtcctgtaccatagcctagagcgaggaggtcatactttgtgaggataggattagctacggtttgcctgttgtcttcactgtcagagtgaggaagttctggggtagggaggtcacaaccgaggagttgctccataatgtagcgagggactcgccctaatcgggagttggtgtaatagtcatagcctcgctcgaccataaggcgtttgccttcggtaatcagggttttggctgtcccaaagccgtagcctgtggcgataaggtcgtctttggtgagggtaggatttttcatgttctaatctcctttatgtttaatatagtaattatttttaatcagccttgagatttccaatcaaaggttattggttcgtcccataaggactcgcttgagtagcgtcaaaagtaccccaagtagggaagaacgaaaagagagagcctcgggaatgagggagtgacctctcacttgtgtatctgactagggaggtgtaacatcaagacaatcagagtacaaaagaacgccctacatgataatgtagaacgtttgattgggtatcttagccgaagttaatggtgtcaagcatggcttccttggttacggtgtctaaaccgaggtaggcaagtgttgctttctggtcggagtggttcaagaggttcatgacaaagccgatattgtagttagtctgttcgtaaacacggtaagcacccgtctttcgcatggtgtgtgtccctaagtagttaatacctatcaaatcgcctgtcttggtcatgattttgtagtactgctttctggtgatgtgttggttgggagtagtggtagaaggaaagagccaagggctgtctatctcttgctctactaaccaatcatgataaagcatcaggtcggactcaagaggcttgaggtaatgggtgtttggctttcctgttttctggtctgtgatgtaggctctgtctttgagtaccccctcgggtgtgaagaggtctgcgtattcaagagagaggacatcacttactctcagaagagtggctttaccgagttggaaaatggtgtagttgcgtctgcctgccttaaagttgtttaagagagtgtcttggacttgtctgaggacatttgagtccttaatgggttgtacattgtggttctgtctttttgccatattatggtctcctttggttggtgagtttgaggacaaacagaaaaattgcccctactctattcaactaaagaagctcagccttgttcctctagggttttcgaggagtctttttgtaagaaagactcctgtttgcttttgttttgaccttctctaactttataaggaggtagattatcatttggcaaggactgatgaattcatcaacctcgacctatcctatcgtggggtaacctacaaacagaatacacaaaaaccccaatgaacaaagctataacagtattcattggggcttctttcagttaaatcctttgcactatgcactaaagtgaggtaagataattcacatcacaaaggactcaaaaatgcgtttctaggacattttagctttagaagagggttgagctagggaaggagggaaaggacgtaaatcgtggctttttcgcccgttttcgtgttcctcctatccttgccaatgaccacaccatgcgggttctcacgggtaggagtctttcttacaaaaagactcctgtttgtgtgaggaagggtggtgtttttgttgtttaggtcatcaatacagagagaagacctaatgtttgtgataagagtgttacttaatcacgtttaggcttgcgtttaacgataaatgcaagcacagaagccatcagtacccctagacctgagagcatcatgaggagcgttgatgattctcctgtttctggaagaccagttttgttcctagtattgtctactttgagtgtatttttagactggtctgaagtcaaaggagtaccttttgaatcaataagcactccgtctttgttcaagaggttgccattatcatcgtagtatgaaccttcaggagctgttttaggaacagttttgcctgatccagttttagaactactgttgtttgagccattacctgggattggtttagctggatttactggtttgtcaggggttggggtgggagcaggggtagaaccgtcgcctacatatacaaagtagtaggtttgaccttgttcagtaaacttacctttgtaagtttcgtctgacttagttgtatcgagtttataccccttgattgatggagctttctcttcaaaggctttacccacatcacctttaacagttttaggttctttaagttgtttagagtccttatcaacgtatttaaaggttactgaaccttgtttaactgggtctggagtagggttaggtgtgtttttagaatacagaactgggaattcgttaggtgcaccagttgtatcgatttccataagtgtaccaagtccacttacatatgtgtaaccgtcaacagctaactcatctttgtgttttgtggcatcccaatgtccaccgttagcctcaatttctttcttgcttgcatcaagtactactgtcttaagaagttttaagtttccttgagcgtcttcagtgtccttgtcatacaagttaaatgtgattttaactacgtcttcgtcaggtgttggtgtaactgggttggctttaacattgtttacggctgttgtaacgttgtcaatttgagcttggaacttgctgtccaagtctgttgattctgctttcaaagcacgtgctttagcattaggagctggattggctttcaagaatgcttcagcgtctgagatggctttgtccaaagcatcaacgtacgtagcttgatatttatctttgtcagagtaaggtttggcgtctttgattgtttgttcaagtaatggacgaagttttgagtcctctggttgtgggtctggagtaggtgttacatctttgttgtatacaaagtagtatgtttgaccttgctcagtgaacttgccagagtaagtttcgtctgacttagatttgtcaagtgagtaccccttgatggtaggagctgtttcagagaaagctttgtctacatcacctttgatagtcttagaggcttgaagcgctttagagtccttgtcaacgtatttgaatgtcacagaaccttgtttaactgggtctggtgtttcgtctttgtcgtacttgaatgtaactgttgtgttaccttccttgtactcatcacggaagaggttaggtgaattgtcgttcaatttccaacctttgatgtcaggagctactacttcgtaaaggtcgccgactttaccctcttgtgttgttgggtctttgatttcatttccacgtgtgtctgtgtaacgaattgtcaatgtaccctctttaacatcaggtttatcactgtctttgtcgtatttaactgttacagagtttgttttacctggttctgggaagtcgtaggtttgagtacctaagcctggagtttggtagtaagacttctgcattgtgtaaccgtcaatcttgaactctttagagcttgggtcgattgatgtccattgtccttcttgtccagaacgcttaactgatttaccaatctctttgttggttttagcgtctacgagcttgaattcaacgaaagaggcttggtctttagtgtaacggtagattacatctttttgacctttttgaactgtgaagttgacatctttagcactgttaagcttgtagtgggggatatcaagggctactgatgagtattgactacctactggaagtgtatctgtgcttgatggagcgatgtctttgccagttgcatcatcaacgtagcgtgttttaaatattacgttctctgctgggtctttcttagtcatgtcagtaagtggtactgtcacgttgatttgtccgtttactggggatacaacgtcaccttgagaaccatcacctgaacggtcggtgtagacatagatagctgtgtagtatgttttaccgtcatagccaaatgatgaatttgggttaatccatttagaatcacctttagcaattgcccaagtgttctctgagaaaccgtgaccgtaggtgtttgaagacgtacctgcttcagcgtctttgataccttgtgcatctgttccaagaacttcacctgtatccttgtttgtgtaagtgatattgaagtcagcgaaacgtgtattgtagttaatgtctccattttcacgtttttggtggtagtaaccatctgttccgagtacgaaaccgtcatcgtcaggtacgtacccctcaggggtgaagaaagctgtgtattcttgtacccaattagcgttgaatgggtaccattggtttggttcttcagtgtaagtatatccagctactttgaaagcgtctttacctgcaactgtacggatgtcttggtcagtagttccttctactgtcatgtctgctttgattgactcacctgaaacgctgtttacgaagtggataatcgctttgtgcttttcagtagcttgtttcgttgctggtgaagcttgtgtaagcgttggtgctggtgtgttagggttcttcgctatcaaggggtggtgcaaagtcggctgaaaccgtctttaccactatcagggttggctacaactggagcaggtgtgtcttggactgttttaactgcttcagaggctgttgtaggtgtttcaactttagtagcttcagaagattttgtagaagactggactgtttgaggtgcttggttttgcactgcgttatccgccaatatagctacagctggtaaagcgacacttgacaagacaagtccgcacatcaaggtactagagatacgtctctgcttctttgctttcttttgttgcttctgaacacgtgtgttctttgtatttttcattgtctatctttccaataagttaatctccttcatcacatcaaatattatcctatattgtgaggaagaaagcaaacttttttagggtacagttaaggtcaaaaggaataaaggaagagcactcctgtcagagtgctctctttgctttatttatctgtataacttactacgacccccaatacaaaagtgatcaagggtcagaagcggtgagaggcttgtgtcatcaggggttagaggtgatgaagtctatcaaatcggttgtagtctgagtttaggggaacatcttctgtaagaaaccttgcttttgggattgagaagatgtctctctgccttactacgtcccccaattacctttttgttcaagggtaagagtggtaggaatatggtcaagctgtgagattgagatgttaacgaagtggaaagtcaggtgagtgctgggtttagtctgattgagtctcattcataggcgaagggttattctgaatcccaaaagcccctacccatgtatgtaagtcattaggtagggactaaaggtatgattgttatctgtctaagcacctattgacctgtctggttcaagtaggtagagtttgtccttaacggactctaagagctattggggtaccccgtaactcttagactcttttaattacaagcggttgtaggtggttaggtaatgggagcttgcatcaagtggctaagaggagatgagggttagtaaataggctcactatcgagcctatcatagtactcttcgagtgctatcgggtctctaaaactcgttaaagcctttggaagttgttgttgaacaagagacctagattctggggtaacatctttgtagctcgctgttctacgctgaacactcgttaaacagtctttaatttcctgatagtaatcaaccattaggtatgccaattggggtttttcctcgtctaaaaaggcatagacgtcttccatatcggttatagcattgttccttatgaattttagaactaaggcgaggtcttggtaatgcttgttttgacggtagttggaactgtatctactactgttaatatagtctctgatttggaattggaatctgttgatgacatacccccactgtgggcattctgcgtctgcgtagtccataaatggttttaactcaaggatattgttgtctcggatatattgccttatctccctcatcatagcagtttgttgggtcttgcttggctttaggacttctttaacatcaaacccgcaaaaagctttaatgtcttccttcttatattgatacttttcagggttatcaagatgaagccaataccttactttacctacaacagactcacatggtttagggtttggagcatgaagtttacctgttagacttaacatttgtctgtaagactttaagctattgaatttgatgagacaatgataatgtggctttttagcgccaccatatggattctcatctttatcgtgtaagggactatgtccccactctgcaccgatatctgtgattatatcttcccagttttggggtgctgaatcgggataaacaataaatatccatattctgtgtcggttttgtttgttattttgcataattatttgcctttcttaatcgttaaaatgcacatttgtgcgagttaaatagcgataatgacctgtctttcccttatattgctcgatttgttactctaagagtctcccgaaagcttgtgatagctggctctcgatgttaaaagaacattgttcacgattgtattgggtcatagtataacacgaggaggtcaaagatggtctaagaagaaggatgcgcatcacctctaatatataagtataacaggttagtggagtcagcggaagtccctcaaatggcgttatgagtgggtttaaacgggttctgcgtttttgataggttctctcaatttccgttgaacttcactcaaaaagggtctgcttttatcgattggcggagtgggttgaggtgtatcgtatctgcactttttaaaatttttttacctctactcatttggcatttaggtctagctattgatctagggtataagaaaatcagtctaggtaatttaagccaagaaggaaaatgacagataatcagggtggggtgttttaggttgactttttgtatgtttgtgtctgctcatttggtatctaggtgggctgtctgagggtgttgaattacggtttgagggttgaagtgctacggaaatactaaatcagagaagtgaatgtgtgtttgtgctttacagtccatcatcaagataaaatataggggaagagcttttttagtgtatcttgtctctctgttttggagtttgcttgaaataatcgagtgtgcacttttgtagttctgatgttattcagcttagctggggtactgtaagcttgagaccagtagttcaaagcttgatacggtgagggaatcagcttagctaagtgtaagtttcagcttgtctaggcttagaggaatatccgagaagggtcagacagtttacaatcaaggcttatcttagtctctaggtgttgtttagggtctaatgtcctcaataaaggtcaaagatggaaaaagagcatgagggttctgtcagtctctttacatgaaggtataacagttcatcggagtagtctctttatcggtcaagggttgtttggttttgtgtctaggttctcgtctgattttcattccttgagaggtgaaggatgaattgagttggtgctgtcggtatagtggaagtcacatgcacacacatttaattttccaaaagcatggcggggagagcgatttggaagaaaatattgtgtggggtatctggattttcattgtgatacaggatgaaaactgaggaaggaagttcatcactctatgtgatgaagaagaaaatagggcgagaacttccctcacctgttcggagtcaacgtaccccgaagtgggaggaggtcttgagttcttgttgggttctgaaatacagggttcttggtgtgagcgagtggacttgggtattaagtctcttgtttgggttggttcatgatgtcaagtcaaaggaacaagtcagtttcttagtagccttccccatcaagagcataagaaaagccatcagtgctctgatgactatatgtctccaaaaaatttcctaaaacggtgagctgtaatgggaagatctttgtccttcttcgtgaagcttggttggtcttgggagtgcttagttggatgctataataatggtgaaaataactttattatagcagaaaatttgtcagcgttatcaatgaaataactttgaactaaatgtttggtatatacaaacatcccccaaggaaaaagatgtattttataaaaaaagatgtattatataatatttttacttgaaatagccttataaagttcgatatttacgaacgatgataactattaacagaatatttacaaaagggtcattgtaaaggcttaaaaaaagggttagaattattttgtgaagagcacaattcataaaccgattgagaaaaaccttaaggagattcatttttaaaatgaaaaatacatcaaagaaagtcattggacttacagcaggcgcggtaattgccctatcactacttgcggcttgtggaaatagcagttctgcttcaaaatcagatagtaaaaccatttcggatttgaagatttcatttattccctcaaaaaatccagatgatatcaccacagcgactaaaccaatcgccaatattttgaagtctgagttgaaaaaacaaggctataccgttaaaaaaattgatacaagcgttggaacaaactatcaagcggttagtgaaggacttgatgcaggttcagttgatgtcggatatggaatgtcagccacaacctatgcgatgtatcaagatggttcaactccacttttgatggcaacacgtaaaggactttcaaatgatgcctcaacctcagcaaaatattggaatgaacacaaaccaacaacaaagactgataaagaagtgacttcatatcgctcattaatcattgctggtaattctccaatgggtaaaaaattagctaaagaagccaacgatggaactttgacatggaaagatttgaataaagcaaaatgggggcttgaatcgacttcatctgctgcgggatatatgtatccttcacaatggttgacagataattttaaacattcaattcgtgatttgaaaaatacagtaacgatggattcttacgattcagcgatggctcaacttgcatcaggacaaattgatgttatgcctgaatatgccgatgctcgtttagatgaagcaacaaaatggaccacaacttttggtgcaaaaggaagcatttgggatgatacaaatgtgattggagtaacccctgctatcgctaatgacggaattatggtttcagaaaaatctaaaattatgacaccagagttcaaaaaggctctctcaacagcgattaaagatatgtccaaaactgccgaaggcaagaaagttattgcgatttattcacatgatggctatgttgattcaacaaaagatgactataaaacagccattaaagtggcaaatgaaatgagtaaagccaactaatgaacaaataaaatcattttaaaagggtctgggttactcgttgagttccagactctttttgtgaaaatgaagcaataataaataaaatagaagcttcatatagaatggagaagtgatgattaaatttgaaaatgtgtcaaaagtttacccaaatggcacaaaaggtctgacagatattaacttacaaattgaccaaggagaatttgtagccattattgggacatcaggagcggggaaatccacccttattcgctgtgtcaatggtttaaatgatgtgacttccggtcgtctctttgtgaatgatacggatgtctcaaaactaaaaggcaaagacttaagaaaatttcgacgccacgtcggaatgatttttcaatcctataatttagtgcctagagttactgttttaaaaaatgttatgtttgctcgtgtcccagacatgaacttatttaaagtgatttttggcttattttcaaaagaagataaacttgttgctttagattctctgaataaagtaggaattttagacaaggcatatatccgggctgatcaactttctggtggtcaacaacaaagggtttcacttgcgcgtgcactgacacaagaaagtgagattttactggctgacgagcctgtttcagcccttgacccagtgacggctaaagaagtaatggatgattttaaaagaattaacgaagagctcaataaaacgattttactaaatattcaccatgttgaacttgccttagaatatgcctcacgaattatcgccgtcaaaaaaggaaagattgtctatgatgggccctcacaagaagtaaccaaagaaattttagatgaagtttatagaaaagagggctaaatgtacgataaaatatttaagcccaaaaaaatagaactcctcacgggtgaagtggttgaagaaaaagtcagtcgtacttggatttactggataattattattataattatcggtttatctgtacttcttacaaattttgactttagtgcgcttagtcgaagtggactctttttacaaaaattagcaagtatgcttccaccaaactggtcttactttgataaggtacttcctcctttgcttgatacgattaaaatgagcttttttgcttccttattgggagctttattagcggtcccttttgcaattttaacagccaataacatcgttaaaaatcggttagtaaatggaatcattcgctttatttttatgcttgcaagaactttgccaacgctagttttagctttgattgcgacttatatttttggactggggacttttgctggggtcgttgcgatttttatttttactttttcttttatcggaaaacaattatttgaagtcattgaaacggttgatatgggaccatttgaagcggcagaggccttgggagtgagtcccttaaaagccttctttattgctgtttttcctcaagttttacctacttatctttcaactgccctttatgcttttgaaggaaatgttcgttatgcagcgattttaggttatgttggtgcaggcgggattggaaatatcttaaatgaccgtgtaaattttcgagattttgccagtgtcggcatgattttggtttcaattttggttacggtcatgattatagactctgtcagtgcactcattcgcaagaagattgcctaggaatgaaatgagaggaaaaatgaattcacaaattattgaagaatacaatcgacgacctaaaaaatggttttattatcttttgatttttatcattttgttagctatttcaatttggtcaacctcggttgttcattatcacggggtgtcagaacatggtgctttaattgctaaaaatattttcacaggaatttttcatccagatagtagtttaattttcaatttcactgaaacaggtttggcttatctcttgctgcaaacttttgctattgggattcttggaactttggtcggtgcgattatcgctgttccactatcttttctggcggcaacaaatctggttcctaactggctggcttatttgattcgttttgttttaatggctattcggacgattccttcatttatctatgcccttttgtttattccagttgttggtttaggttcgtcagctggtgtgatggcgcttggttttgagtccattgggatgattgcaaagttatttattgaggccattgaggatttggatatgggtgtcattgaagcgatggatgcagctggtgccacaacttttcaaaaaattcgctttggggttttgccacaacttttaccagatctttactcaatcctactttatcgtttagatatgaatcttcgtgatgctgccattttgggcttggtcggtgctggtgggattggtgcgccattgagttttgcaatgtctggctataaatggtcgtctgttggagcgattttactcggacttttagtattaattatttttgttgaactcatttcatcaagaattagaaaaaaattagcgaaaggataaaggatgatgaagataagaattcttgaaacaagtgacttgcatggctttgttcttcccacaaattttacagaaaaagacatggatttacctttttcgattgctaaagctcgaactaaaatggacgaactgacaagctcctctgaacaaaaaggagaaatcgtcataaaaattgaaaatggcgacatcttgcaagggtctgctctggcttactatctggcaaaaaaagcaaaggaaggcatcaaagatttagtcaatgtcacaaattcttttggctatgacgttggcttactagggaatcatgagtttaattatggactggagtatttagaaacgtatgtcaagcaagtcaattatcctattttaacagccaatgttttggataaaaaaggacagccagcttttggaccaacttatcaaatcattgaaagacaaggcgtaaaaattggaattgttggtttcttgactcagtatattcctcattgggaacagccagctacaattaaagatttaacttttcaatcgattgttgaagctgccaaaaaaattttacccgacttacgtcagcgcgttgatgtgcttcttgtagcttatcatgggggatttgaacgagatttagtgacaggaattcctacggaaatcttaacaggagaaaatgaagcctaccaattattattggaatatggagaattgattgacgctctagtcacgggacatcagcatcggaaaattgctcaacatgttttaggagttcccgtgattcagcctgggtttcgaggggcttttgttggggaaattgagctagaattagataagcaaaaaaaaattacccattcaaaagccaaaattcatagaacggccaagtcaaaagtttcgacagaggttcttgaacttatttctgatatcagtaaggaaacagaagagtggttggaccagccaatgggaaaagtattggggaatatgaaaattctggatccaatggccgcgcgcattagtgagcatccttatattgaattgataaataaaatacaaatggaagcaacagctgccaaaatttcggggacagccctttttaacaatgaagctaaaggttttgatgaacagattaccatgcgctcaattttgacaaattacatttatcctaatactttagctgttttaagagtgacaggagcagatttaaaagctgccttagaacgaacggctgaacatcttgaaattaatgatgagggagaaattatttttagtcctcgctttgttgaacctaaacctgagtattataattatgatatgtatgaaggcattgattatactattgatttgaagaaaaagattggtcagcgaattgtgaacttaagttttgagggacgtccagttgccagtgaggagtttttagaaattgtagtcaatcagtatcgagcagtcggggggggaaattatccaatgttttctgctgacaagattgtcagagaaataacagtggacatgacagaattgattgcggcttatttgaaaaatcatcctgtgattcaagcgactgtcaatcataattttatgattttaaaataataattactgacagcttttttagcattaataaagcgctaaaaattactgtcagtaatttttttattaagttttgcttgagaataagctaagttattctcaagtttttcctgatatactttatttattcaaaggaggagcctatcatgaaacaaacacttaaaatcaagaaaattaattatcaatttgtgaaatcagaagacaacaagctaatacttccaagtcctttagaaagtccctacctgacagcgaaagatgagcaataagagccagatgagaggatattctgtgatagaatgaaaatataactattaataaaggagcattaatgacaatgaatatcacatctcatggtgaaaaaatagcaacaataaatccgacaacaagtggtgatgcacctgattttgaactgacagatttaaaaggaaataaaattaaattatcaaaacttgaaaagcctgttttgattagtgtgttcccagacatcaatactagagtttgttcacttcaaaccaaacattttaatcttgaagcagcaaagcattcagaaattgactttttgagtatttcaaataatacagcagatgagcaaaaaaattggtgtgcagccgagggagttgaaatgacaattcttgctgatgatggaacttttggacaagcttatggtattgttttaaatgatggaccactcaaaggtcgtcttgctcgtagtgtttttgttgtaaaaggggggcaaatcgtctatagtgaaatattagcggagctttcggatgagcctaattacgaaaaagccttagaagcaactaaataattaatgacaaaaaattgaggatattgataagagtgaatatcctctgtaaaagctgtcagtagacagtttttttaataagttaaagaaaagatgtaatttttctttgtactcgaaattttctattcaatttgatataattatattaatactgaatatttaggagaagatatggctgtaaaacgtttaattgaaacttttgttccggaaaattataaaattttccttgatattgaccgtaaaactaagaaaataaaaggtcaagtggcaattactggggaagcaaaagatactgttgttgcctttcatgccaaaggattacacttcaacaaagttcgcgcttttagtgttgatacaaacttcattgaaaatgaagaagatgaagaaattgttgttaaaattggtgaaacagggcgcgtgactgtttcatttgaatatgaagccgaattgactgacaacatgatgggaatctatccttcatattatgaagtcaatggtgaaaagaaaatgctaattggcacacagtttgaaagccattttgctcgccaagctttcccatctattgatgaaccagaagcgaaagcaactttcgatttgtcagtaaaatttgatgaagaagaaagcgacatcattgtttcaaatatgccagaactcttgaatattaatggaattcacgtttttgaacggacagttaaaatgagttcttaccttttggcttttgtattcggtgaacttcaatataaaaaaggaaaaacaaaatctggtgttgaagtaggtgcctttgcaacgaaagctcatagtcaagcagcacttgatttcccacttgatattgctattcgttcaatcgaattttacgaagattattatcaaacaccctatccacttccacacagctggcatattgccttgcctgacttctcagcaggagcaatggaaaactggggatgtatcacttatcgtgaagtttgcatgttggttgaccctgaaaatgcaaccattcaaagtaaacaatatgtggcaacagttattgcccatgaattggctcaccagtggttcggtgaccttgtaactatgcaatggtgggatgatttgtggctcaacgaatcattcgctaacaacatggaatatgtttgtatggatgctttggaaccaagttggaacgtttgggaatcattctcaatttcagaagccaatatggcattgaatcgtgatgcaactgatggagttcaatctgtccacgttgaagtaactcacccagatgaaattggaacactttttgatccagcaatcgtctatgctaaaggttcacgcttaatggttatgcttcgtaaatggctcggagatgaagactttgctgctggcttagccctttatttcaaacgccatcaatatggaaatacagttggagacaatctttgggatgccttggctgaagtttctggaaaagatgtggcagccttcatgcactcatgggttaatcaaccgggttaccctgtcgttacagcagaagtcgttgatgatactttgattttgagccaaaaacaattctttgttggtgaaggtgttgacaaaggacgtttgtggaatgttccattgaataccaattggacagggctaccagacttgctttcttctgaaaaagttgaaattccagggtttgctgctttgaaaactaaaaacaatggtaaagctctctttttgaatgatgcaaatatggctcattacatcattgattataagggtgctttactgacagaccttctttcagaagttgaatctttggagaatgtgacaaaattccaaatcttgcaagaccgtaaattgttggctaaagcaggtgtgatttcttatgctgacgttgtaaatatcttgccatcattcactaatgaagaatcttaccttgttaatactggtttgagtcaactcattagtgagttggaactttttgttgatgaagattcagaaactgaaaaagccttccaaagcttggtaggaaaactttttgctaaaaattatgctcgtttgggttgggataaagttgctggtgaatctgctggggatgagagccttcgtggaatcgtgttgagtaaaactttgtattctgaaaatgcagatgccaaaacaaaagctagccaaatttttgcaacacataaagaaaatttagcaagtattccagctgatattcgtccaattgttttgaacaatgaaatcaaaacaactaactcggctgaattggttaaaacttatcgtgaaacttatatcaaaacaagcctccaagaattcaaacgtgaacttgaaggggcagttgctttgattaaagatgaaaaagttattgctgaattacttgaaagcttcaaaaatgccgatattgttaaaccacaagatattgctttctcttggttctatcttttgcgcaatgatttttcacaagatgcggcatgggcttgggaaaaagcaaattgggctttacttgaagaaaaattgggtggtgatatgagttatgacaaatttgtcatctatccagggaatactttcaaaactgctgataaattagcggaatataaagctttctttgaaccaaaattagaaaaccaaggcttgaaacgttcaattgaaatggcaattaaacaaattacagcacgtgttgctttggttgatagccaaaaagcagcagttgataaagcaattactgatattgctgaaaaattgtaatttataaataaaaatcaccttttagaggtggtttttttatttataaattattcgtttgatttcgctttcgatagaacaatcaaagcgagaataaggaagataaatcccataagagcaggagcagaatgtccgagactaatgtaaatttgtccaccaattaaaggaccgataacgcgtgtaagtgcttgaagagcttgacttccgccttgaagtttaccttgttcagaagaagtcgctgatattgaaagtttgccattgaaggcagttccgaaaatactatctccaaaagcaaagataaacattgccagaatgaagaggggccacattttagaaaaagcagaaagagcgaaaagtaagtaagcaattatttcgcagactattgctagacagataagtttatcttcattagctaattttagaagtctgggcatgatgaaaatttgagttaaaatatccatcaaacccatgattgaaatggcaagaccaattaatacaggtgtccaagcaaaactatcaagtgaaaactgactgataatagcttggagcgcaccatttggcaaccaaagtaagataccggcaaagaggagacgattgagatttttcatgcgtaagagctgaaaaagttgggtgaatggattaagctgcttaagggaaaaattttttgtgcgattattttcaggaaggctttcatccatgacaaaagcaccataaagaagatttgcaagggagatgattgctccaaagtagaaggggactgaatttccaaaatgggctaggagtccaccaacggttgggccagaaattgttccaacaccaacagcagcagctgtccatccgaatacttttgttcgattttcttcatcagtaatatcggcgaaataagcgaaaagtgtcacgatatttccaccggttaagccatcgatgattcgtccgataaagagcatccaaagactgccagctaaaccaaagaccagataccccaaggcagaaccagctaaagaaattagtaatattggtttgcgaccaaagcggtctgataaagagccaagtgcgggggcggcaaagaaagtacagagtgcataaatggccattagtgcagagacgatgaatgcttggtcatgagcatttgcaaaaggggcgaccataaatgggacaacaggggaaatgattgtaaaaccaagtcctgtcagaaaagttgtgataagcccaaaagtgagggcatgtttattgatgttcatagtgagaacctccattaagatgtgagttcgttctagggtctttgcaccttttttctttttcgattgctttagcaagtgggggaaagggtcaagggcaacaagaatttgacagttttgatgtcagattctgcttgactaaattgaattgatgaaattttccattcgatgagttacattagtaacttagtgagaatggacaaactagattgaaaaatgagggattctactcaaggagtagtttcgcaattttatctaatttcagtcacttcaaggcgaacgagctgaattgtgatgattatttgatttcttaggaagttttttgcgcaggttttcagctgctaaagtgaactctgtcagactaaaggcttcacttttctattcgagtttccttggaaacaaaaaaagtatatcgcattattatttctttgtcaacaaaaaacaaataaaaaaaccgtcagtaaaaattaatttactgacagacttatttttcaatattttttcggatagaagaatcaaggtgattattgtatttatcaaggaattctaaaatattactgacggcttcatcagttaattcgtcaaagatcacttggtcgttttgggaaaatttttggtgaagactttcgtgacggtcattgatctgctgaccttctttcgttaatcgaaaataaatttcttttttattttgaggaatttgataactttcaatcagattttttttgagaagttttttagcaattttactggcagcaccgcgtgtcatataaagatgatgagctaattttgtcacattgggatagggagttttggcaataaattcaattgtttcgatttctgataatgaaatatttgaaaattcagcttccatctgtggcttataataagcatcaattttgttaaacaagttagtcaaagaggtcataatttgttcctggttttcttgaaactgagtcatgagtcattttcctccatctttaaagtgctttgccgataaatacaagaccaatagtcatttcggcgccaaatgcttgtgacaatataattttgctcattttgccagtagtcataagttaaaataaatgtttttttactgacttgtgaagctttataatgatttatggccaaaggaattactgaccgactagataggagatttccagattcattatttttactgacagaatttttgtcagtaatttgtccgaaagtattcaatttttcactggcatttatcattcttccatcagcaagaatttcctgatacttttcatcagtcaattttggcaaattttgatgattcaaaaattgttcttcttttgctaaaagctcaagtgaacggctagcatagtgttcttcctcaggtaaagcagcaggttcgacgtgaacatcaacatcatagaccccaaaaccatcaatcaacattttttcaatagattctgtcgcttcatgactttcataaacacttaaatcaggagacatttcaaccacaacgtcaagaaaaatgttgcttccatacgaacgaccgcgaacgagtttaacgcctttaacttttggagctaaacagatagcctctctatatttcttaacaagattttcatcaaagccatcagaaagactaaaaactgattcgtggaaaatatcataagcagtttttaaaataaaaccacaaataatgattgccatagcagtatcgagccactcccagccaatgctacttgctaaaatagcgaccacagttccaatagaagttaccgcatcagaaagattgtccttacttgctgcagagagagcctgagagttcgtttttttagccaaatcacgattataaagataaactccgagcatgacaaaggcagaaaataaaccaacaagcgctcctagtggatcaatggtttcttcttttccggatagtagagtcatcacggtttcacgtaagacctcaaaaccaacgaagaacatgataaaactagaaattaaactcgcaatagattcaattttccagtgaccgtagacatggtcactatctgctggaattcgagcaattcgaagtccaattaagattgcgatatttcccataatatcagtcacattattaaaaccattggcttgaagagcgctagagtgaacaattgtcgcaaaagcaatttgtccgatagacaaaacaatataagcgagaatagaaacccaaactcctttttcagcgagtttcagattgtttgtacttgaagctgccatataaatcctcccaaaattacatcattccattataacaaaaaattcaaggaaagttggcttccagcactaaaaaaaccttttataataaggcctcttaaaatagaattaaaaaagaaggatggactaatttcttaaaaacggagatgattttttcttatcttatatagtagaaagtcgtcaaaaataaaatattatataaatagtttaagtaccttgacttacatagtaatgtgaagtataatatactttgtttaaaatgatagaaaggaaaaagaatggcagaaataccaaaagaaatgttacgagcccaaaccaatgtaattttgctcaatgtcctaaaacaaggagataattatgtttatggtattataaaagaagtcaaggaagcctcgaatggagaaatggaacttaatgaagccacgctctatacgatctttaaaagacttgaaaaggatgggattatcagttcttattggggagatgaaagtcaaggcgggcgtcgcaagtattaccgactgacagagattggtcatgaaaatatgcgacttgcctttgaatcttggtcaagagtcgataaaattattgaaaatttagaagcaaataagaagagtgaagcgattaaataaattcacgattcattcctaactttaaattctaaatttataaaaacataagaagatataaataaggtcgcaaatcgttgacttaaactttaaaaagcgttacaatatttttgttagtttaccatttatgaaactaactattgtaatctttaacagcattaacaattaatgcttgtttactaaaaaaataatgttataattatcttctcaaaaaatttattgaaattattttgaagtaaaatgaaattgaaaattcaatttaatgtaaagtagtttacattatttaactctagaaaggaattttatgattttcaaatcaatcatgaagcataaatgggttgccttattctcaatcttttcaacctttgtttatgcaggagtacagctttaccagccccaaatcatgaaacgaattatgacagtaatgtcatcaacaacttatagccgtcatgagatggctgacaaagtttcagtatatggagttgagttgctgattgttgcagggatagggattctctttgctatcttcagtaccctttcagcagcacgtattgctcaagaaattggggcggacgttcgtgaagcaacttacaaaaaaattaacacattctcttatgaaaatgtcgaaaaattcaatgccggaaaccttgttgtccgtatgaccaatgacgttacacaagtgcaaaacttgatgatgatggtcttccaaattttgatgcggattccagtccttctgattggtgcggttattctatcaattacaactcttccaaaactttggtggattactgttcttttaatcgtcttaatccttgtggttacagctgtattgatgggacgcatgggtcctcactttatggccttccaaaaattgatggaccgtattaatgccattgctaaacaaaacttacgtggcgcacgtgtcgttaaatctttcgttcaagaaaaaaatcaaatcaaagaatttgatgaaacttctgacgaactttacgaccataactgggcagtagggaaactcttttcagcaatgattccactctttaccgttattgctcaaggagcgatttggcttgcaatctacttcgtttcaacttttgtaacagattcaccaaccgttgcccaagatagcattggtgggattgccacattcatgacttacatgggaatgattatgtttgccatcatcatgggtggtatgatttcaatgtttgcttcacgtggtatggtctcaatcggtcgtatcaatgaagtactgaaaacagacccagctatgaaatttgacgaaaatgcgaaagatgaagaactttctggttctgttaaatttgaccatgtttcattctcatatcctaatgatgaagaaccaacactcaaagatattagctttgaagtagaagctggtcaaatggtcgggattgtcggagcgactggtgctggtaaatccactttagcacaactcattccaagactctttgacccaacagaagggactgtttcagttggtggaaaagaccttaaaacagttagccgtggaactttgaagagaaatatttctatcgttcttcaaaaagctattcttttctctggtacaattgctggaaacatcaaacaaggtaaatctgatgcaaccgatgaagaaatgactcgtgccgcacaaattgcccaagcggctgaatttatcacgacaaaagacggacaatatgaatcagaagttgaagaacgtgggaataatttctcaggtggtcaaaaacaaagattgtctatcacacgtggggttgttaaaaatccaaatgtcttgattttagatgattcaacgtcggcacttgatgctaaatctgaaaaacttgttcaagaagccttgaataaagaacttaaagaaacaacaactattattattgctcaaaagatttcatcagtagttcatgcagataatattttggttcttgatcaaggaaaacttgttggccaaggaactcaccaagaattagttgccgaaaataaaatttaccaagaaatctacgatacacagaaagcacaggaggactaagacatggaaaataccaaatcaacaagaaaaatgtctgacaccacacgtgccatccgatttttttacctctatctcaaaagatataaactccaatttgctgtgattatgattttcatcgtcgcagcaacatggttgcaggtaattgcaccctcactcttaggggatgcaattacaaatcttggggtttatgttaaagacttctttacacatcaacatgctggacaatcacaagatgcattacaacagattgctcaacaattaagccaacaaatgcaccaaaccgtagattggcacaatgttcccgaagtcgttaaaacattaccacaagcagttcaggaccaaattacagctcatcttcctaaaggaacaactttagaaacactcaaaacagtggcaacttcacatgctgctagcacttctacattcatgaaaggaatgtggcaattgcttgcagtctatgtagcaacaggtgtgtcaatgttgatttataccttgctctttagccgtatcgttgctcattcaacaaatcgcatgcgtaagggtttgtttggtaaacttgaacgtttgacaatttcatattttgaccgtcatcaagatggagatatccttgctcgtttcacctctgacttggataacattcaaaatacattgaaccaagcactcgtttcagtgatttcaaatgctgccgtttttgtcggagtaatcatccaaatcttccttaaagatgtaacttttgcttggttgacagtggcggcttcaccagttgccattttatctgcagttatcattattcgtcaatcgaaaaaagcaacagataaacaacaagaagaagtttcacaactcaatgcctatatggatgaaaaaatctctgggcaaaaagcaattatcgttgaaggtttacaagaagattctattgatggtttcttgaaacataacgaaaatgttaaaaaacgtacttttgctgctcaagcatggtctggtatgattttcccattgatgaatggtttccaacttttgtcaattgccatcgttatctttggtggtacagcctatgttctcaacaacgatagtatgtcaatcactacaggtttgggtctcttagttgcctttgttcaatatgttcaaagttactacaacccaatcatgcaaatttcatcaaactttggtcaacttcagcttgccattacaggtgcaactcgtctgaatgttatgtttgatgaaccagaagaagttcgtcctgaaaatggtaagaaatttgacacgattaaagatggtattcaaatcgaaaatcttgattttgaatatcttccaggtaaaccagtcctcaaaaaagttaatattgatgttaaaaaaggacaaatggttgccctcgttggtccaactggttcaggtaaaacaactgtcatgaacttgatgaaccgtttctatgatgtcaatggtggagcaatcaagtttgatggaacagatattcgtgaatttgatttagatagtttacgttcaaatgttgggattgtacttcaagagtctgtactctttgatggaacaattgccgataacatcaagtttggtaaaccaaatgccactcaagaagaaattgaaacagttgcgaagacaacacatatacatgaatttatcgaaagcttgcctgacaagtatgaaacacacgtttctgatgatgaatcagtcttctcagttggtcaaaaacaacaaatctctattgcacgtactattttgacaaatccagaacttttgattttggacgaagcaacatcgaacgtggataccgtaacagaagaacaaattcaatgggcaatggaagcagccattgctggacgaacttcattcgttattgctcaccgtttgaaaacaattcttaatgcagataagattgttgttcttaaagatggtgaggtcattgaagaaggaaatcatcatgaactcgttgctcaaggtggattctactctgaactttatcataatcaattcgtttttgaataagaaaaacttgtttgaataaaagaaataaaaactacagctaattttttagttgtagtttttatttagaaaaaaagtctatgaaaaactactataaaatgttaaaatagagagcggttcttaaaaaaataatttttttaagacaataaaaatgtgaaaagtgattttgaaataatatgaaaaaaatagtaattaatggtgggaagcgtatctctggaacaattccaatttctggagcaaaaaattcagtggttgctttaattcctgcaaccattctagctaacgatattgttactctggaaggagttccagatatttctgatgtcgcaagtttagtcgaaattatggaaatcacgggagcaaaaattgagcgaaatcttgaagaaggtcgacttgtgattgatacacgtagtgtcgtttcacgtcctctgccttatggaaagattaattctttgcgtgcttcttattattttaatggtgcacttttgggtcgttttggacaagcgacagttggcttgcctggaggctgtgatttaggtcctcgtctaaccgatttacatgataaagcctttaaagctttaggggctaagaagattcaagaagaagaagctgagcacttagaagtgattggtgattcattagttggaacaaccatttatatggacgttgtttccgttggagcaaccatcaatacgatgcttgctgctagtcgtgcaaaaggtgtaactgtaattgaaaatgctgcacgtgagcctgaaattattgatgtggcaacccttcttaataacatgggggcaaaagttcgtggtgcaggaacagatattatccgtatcactgggatagatgaaatgcacggagctcaacatacggtaattcctgaccgaattgaggctggaacttaccttgctttagctgctgcgatgggcgatggggttattattgaaaatgtcatctatgaacatttggaatctttcattgctaaacttgaagaaatgggcgtacgtttgacgattcgtgaagacagcattgaagttcataaatctgaaaatttaaaatcagttaatattacctctgttccttacccaggatttgcgactgatttgcaacaaccaattacgccactgttgttaaaagcaaaaggtcgtggttcgattgttgatacgatttatcaaaaacgtgttaaccacgtacctgaattagcgcgtatgggtgctaatatttctgttttggatgatagaattatttatgacgctccgaatgagttaactggaagctgtgttcaagcaacagatttacgtgctggtgcggctctggttactgctggaattattgccagtggaactacaaaaatttctaatattgagtttatcctacgaggctatgatcatatcattgaaaaattgactgctgttggtgtagatattcaattgattgaagagtgacaaaatagatttatttgcgtatatactaatgagaaaggatataagatggctgataaattaaagtttgaaatcattgaagaacttatcgttctctctgaaaatgcaaaaggttggcgcaaagaactcaatcgtgtttcttggaatgatgcagaacctaaatacgatatccgtacttggtcacctgaccatgaaaaaatgggtaaaggaatcactttatccgaagaagaatttggcgtcctcttaaaagaattgggcaataaataaaatttaaaaaaaatcctgagtgttcaggatttttttattacttgaaaccatatttcaatagaatggtgataggatatttgctgaaaataaatgttttgtattttaaggctattgtttttatggtaggtagagttgtataattacattaagaagtttcaattaagtgaaaattcagacagatacagaaagaaggggagtccaatgcaggaaaaagaggtttaagctaattattaatagaaaggagaaaagagatggacgaaaaaatttttgaagacattatgtcagatattattgttgttagtgcagaaggaagtgaagttaatatttgtgtcattgcaaaatagagtattaatagagctattataagtcatataagtcgtgcgctttctaatgcttagtggtttaagattaggatagcatgacttatttattttccaatgaacttaactagcaattcgggtattattattaatagaatcaattatttaagacgaattaataaaaaatatagaaagataagtttatgatgtattcaaaattcatatcatttttaaaacaaattcctctcccgatatgtggcttaattttgggtttaatatccttaggaaatctcctttacagtaaaggttacgctattttaggaaacctttacgatatgttaggcttgttccttatggttttgattttgctcaagatagtactggcaatgaaacatacaatttcgactttgaatgacccaatcgtagcctctgtttcaccaactttcaccatgtctttaatggtactaagcgtatttttacaacgtttatccggctttagtcttcttgcgaatgtaatttggtggactgctttagtcttgcatcttattttaatgatgtattttatttatctccatatactccctaaagaactaaaaatacatgatgtttatccgagttggtttatcacttttgttggcattggcgtaatatcagcgacatcaccagatttcggtcttgaagtggggaaagttgtggtttggataacattactcttttactttatccttcttcctattgttatgcacagagtctttattttacgaaaaatgcacaaatctttacttccattgattacaatcatcacagcaccaggttcactgggattagtaggttatcttactgttgtagaatcaaaatctaaaatgttcattatctttttatttatcttgtcgcaagccatctattttataactttgggcttactgacaaaacttttaagaagtgccttttaccctagttatgctgcctttacattccctcttgtcatttctgccactgcggtaaatttaacaagtaagctcagtattttccaatttttgaatttagaattattagctaatttagaaatttttatagcgattataatcgttacttacgtttttataagatattttatttttttgggaagtaaattacttcagattatctctgaaaaatattctgctgaaagcatctaaaaaaacatcgaattccaaaaaaaatttaaaaatgaataaactgtaaaaaggcaccactaggtcaatgaatctagtggtttttttatagttaactaagcttactttttttaaaatggaaatttaaagctcagactttgctttgtttaactttcaaaatagctttaatatctccctttgggctatgccaataattttaaaaacgtctataaaaaaaaggaaacattgtgttataattagaacgctgcgtgctttttttcattaaataaaaaaatttgactggatttttaggttaaattgttcattttttgaagtatttaatgattaaaagtatgcaaaagaatataggagaataaaaatgactgtattatatgatgaaatcatggttcgttatggtgaactttcaaccaaaggaaaaaatcgtggttactttatcaatcgtttggcaaaaaatatccgtgaagtccttgcagatatgcctgaattaaaaattacagcagtaagagatagagcacatattgaacttaatggagcagattatgccgaagtttcaaatcgtttaacaaaagtttttggaatccaaaatttttcaccttcaatcaaagttgaaaaatcaatgcccattataaaaaaagaagttgtagcactttttaaggaaatttatagcgaagggcagacttttaaaattgctactagacgagctgaccataactttgaattagattcaacagaattaaatattgctttaggagatattgtttttgataatttctcttacgcaaaagtacaaatgaaaaaaccagatatcacgttgcgcgttgaaattagacaagatgcgacttaccttagttttgaagatatcaaaggtgcgggtggaatgccagttggtacggcaggacgtggacatttgatgctctcaggtggaattgattcaccagttgcaggttacttagcgttgaaacgtggcgttgagattgaagctgttcactttgctagccctcctcatacttcaccaggtgctctaaaaaaagccaaggacttggcggctaaattaactgtctttggcggagcaatcacttttattgaagttccatttactgagattcaagaagaaataaaagctaaagctccacaagcttatttgatgacaatcacgcgtcgtttcatgatgcgcgtggttgaccgtgttcgtgaagaacgaggcgggaaagtaattattaatggagaatctttaggacaagttgctagtcagacgcttggctcaatgtctgccattaatgaagtgactaatactccggtcattcgaccagtggtaaccatggataaaaatgaaattattgaaattgctgaaaaaatagatacttttaatttatcgattctaccatttgaagattgctgtacagtctttgccccaccttctccaaaaacaaatcctaaacttgaaaattgtattcaatatgaaaagagaatggatgttgaaggaatggttgaccgtgcagtcaaaggcattatgcttacaacgattgctggcggaaattgggaccaaaccgaagaagaagaatttgctgatttcttataatatgaaaactctgcttgttattgataagtagagttttttatttgatacgaaaactacgattaatagactaaacttgacaaaggactgaaacaaggatataataaccaacgttatttataaacttagaaaaaatatttgagttagccttttaatataaagattgttagggaattttaaaagaagttgtggcgctcattttatagggaaggattttatgtcagatcgaataaaggctttgattgccttagggatttttacttttatgtcgacattggatggttcaattgtcaacattgctctaccaacgatgtcaaggaaacttcatgtttcaacttcacaaatcacatgggtggtgacaatttatctcattgtcatttcagcgattgttttgatttttggtcgtcttggtgacttgattgggaaatcacgaattgcccgaattggttgggggatttttattttaggctcagcactggctggtttaaactttggttgggcttaggttttttactttttgcgcgaattgttcaagctattggggcttcaatgtttatggcaactggttttggaattatttcagaaatttttccagttgaaagtcgagccagagcactttcaatctcggcgatgtttgtttcagtgggttcaatcgctggaccagcacttggtggtttgattttgcaggtcgcttcttggaattatattttttggattaatgttccaatcggaattttggcttggatttttgggaatcatgccttaccaaaagaaaccacgagtggaaaatggtcagatattgattttaagggtggaaccttgatgacagctgttgttattttactttttctgtcgcttaacttcggtcaatcactgggttggactagtccattgattattattggcgcacttgttggttttattctctttggaatatttattgtcactgagaaaaaggtggcacagcctttacttgatttagggatttttaaatcaaagttgttttcaatgagcataattatggcactctttaattttaccgtagctatgttttcaagtattttattaccattttatctgcaagattttagaaattatgctcctggagtggctggaatgattatgatggcttaccctgctgctatgctgattgccagtcctttggcgggttcagcagctgataagatggataaagaaattgtcacttttgtcggtatttcaggaattgttttgtcccaacttggctatcttttgattaatccacattctgaaccttgggttatagtcgtgattttattgattcaaggaatgtcaatgggaattttccaaagtcctaataatgcattaatcatggaaactgttgaacgaaaatatttaggaatcgctggttctgtaaactctttagctcgtaatatggcttttgttttaggaacatcattagccaccttaattctgtttacagcgatgtctaatcaattgggctataaggtcacaacttatttgacaaatcaaccagatgtcttcttgcacggttttcatgtagctttctatttttcaacttttttggttttagtcacttgggtattgggcttggttcgtctattaggtcggaaaaaaagttagtaaaaaaacaatcgatagatttttttttagaggataatctagcaaacaaatgtttacatgtgtaaattttcacgtactaaatatattgagaatttagaaaagtttgccataataaattttataataaaaaaataatttctataaaggaacaaaatatgtctaaacttcttgttgtaaaaggtcatccactcactgctgaatattcactttcactcaaaggtcttgatgctttcgtcaaatcttacaaatctgctcatccagaagatgaaattgaagagttggatgtctttagtgctgatattccaactttgaacacagaattagtcagtggccatgtttgcaggtgaaaatgcagaacttacagcatcacaaaaagataaattggctcgttttgctggttttacagaccaatttttgtcagctgacaaagttgtcattgctaatccaatgtataatttgatgattcctgctgaacttaaatcatgggttgatactgtaaacgttgctggtaaaacatttaaatataccgctgaaggaccagttggtttagcaaatggcaaaaaagtcttacatttacaagccaatggtggagtttatggagcacaagaccctgtgtcagcaatctttaactttatcggtagcgattttagacaaattgctgttgaaggacatgcttatgacccagaaaaaacagaagaacttcttgctgaatttatcaaaaaagtagaattagaagctcaagcattctaaataaaagtctgtcagtgaacagactttttcttgaatttactgacagaaatctcagtaagtagctgtaggtgttgtcagtaaaaggaaaggctaaaaaatggtaaaacatctttttaattcacatattgattgggttggtgggagaaattctattggtgacttgcaagctggggcacttaatgaaaaaatttcaattcctgagacaatggctggaccaggagtggggaccaatccggatgaaatgctacttggagctgctagcacctgttactcaattactttagcggcaatgcttgagcgaaatgaaattcctttggaacatttaaaagtagagggacaaggcgtggttgatgtgacaaaagggatttttacttatgaaaaaattacctatcatgtcttcatgaaactagccgccggggctgatgaaagtaaagcgatcaaattggcagaacgtgcagaaagttcttgtatgatttcaagggcaattcaaggaaatatagaattagaaacgatcattaagattgaaaaataaaaagttactgacaaaactgtcagtaactttttttgattttatgttaattcaatcattagtttttattttttcgacgttccaaaaagtcgaaaagtagcgtatgatgattacttgctaatgaataatcttcaagaatattgacattaagtcgcatatctttggcttctcttgcggtaattgctccagaaagctcatgctcaaagataactttacgttctaaatagtaggcacgcatcatttcagtaatgttattaggctgagctttatttaccatccgagaaatatgaccaccagaagccacaatttcagaagttcgcaaacgttctgattgtaagaaattcaaaagttgttcatcaaaaaccccatttaaattgtccaaggcttgtaagataagttcggtgttattgaaatatagttcagtaatttcatcacgcgttgtttccattgctgcttttgtttttttgaaataaaaatccacatgcaagaagcgagaaaccagcaaatgaaaggcacgcaaagtaataacataaacaaattgaatacttgaaacaagggaatggacaatacttgtttccaatgagcgaatatacctttgataagttcgataagtatacatagaaattttattttcacgtaagtaagcttcaagaccttcagattcgattcggataatcaaaagttgcaaatcattatagtcaatcgccatatcggtggattcttgctcaataattaactgttgaatcctttcttgataagcatcaattgcaatatcgtatccctgaggatttttagctgttgtcatatcctgacgtaattcatcaacaacctcggataaaatagcgattttagagatattgttaactttagatacttttttgactgcaaagaaagggagaatgaacattccgaccaaaaagcttaagccagttacggcagctgctagaaagactaggaccggttggatatcaacacttcgaggaaccaaaagaatcgttgcgatacttacagttcctttagagccagcaaaagtaagaagaagaatatcattccaataagcagagaaaggctgtttttgtttaagcgaacgaagccagtaataaaaggcaatgacgacgaatcgaagggcaaataagccagcagttagagcaagagtaaggagaattagatgagctgaagaataaacagggtcaactaaaagtggaacaacaagttgataaagttcaattcctaaaaacaagaagacaaaggaatttaaaatgaaagtcaaggtgtcccaaattgtacttttaagtttttctacttgagcatcaaataaagttgttcttttgagaccattggctgacatcactccagcgacgacagcagcgataattccagaaacatgaagttcttcagaaatgagaaaggcggaaagaggaaccacaagttctaagagaagatatcctgagacatctcgggcatcgacatcttctaaaagtctcaaaactagccctttgatataaattaaactaaatccaatagcagccccaccaatggaagaaatcaccaatttcattgtagcatctggaaaagaaaaataacctgtaaccagtgcgactaatgcaatttgaaaggaaataattccagaagcatcattgagaagcccttcaccctgtaaaacactcatgaccctacgtggaaaggagaagtttttggataaagcccccacggctacggcatcggtaggagcaagactggctcctaaagcaaaacaagcagccaaaggaagtccgatatatatccaattagaaattaaacctaatccaagagttgtgataaaaacaagggggaaaataagtactaaaataattttactatgttttaaaatatgtttgacatcagcttcttcactttctctaaatagaagtggggcaataataaagcctagaaaaaattctggagcgacatgtaaaacttcatcagcaccaaaaaagcccaaaataagtcctaaaaccacttgaatcagcggaagggcaagttttgggaaaactttattaaggacatttgaaaaaactaataccaaaaggaaaataatgacataaaaaatagtatggagcatagagtcctttctttaaaaaattgacgagcgcttaaaaagtgcaaagtagagctatcaaaggtagctctactagtgcatattctacttatttatttcaaacggttaattgcttttttctttaaagcaattttttcatttatttttgagcagtcttttttacctaacagcgctttacaacgtttgagttcaagatctgtaagctgacgtttaactcgttctttacgagcaatatcaaactcaccgtttttgattaattcaagtttttgttcaagaattaattttttattcttaacggcatcaatataatatttaagctcagaaatatcgttagtacttgcttcgttagcaagtgcatttcctaatttttcatcaagcttaatgagtttatcagtaagcatttcaagtttagcgtgaagtttttcttctttttcttcgtctgagagggccataaaagcttcaaattttttactatcttcaagcttttgagacacttcaggtcttttatcgatgtacaactcacgcaagttttttaacttatcttcaaattttttatctatcattttgatcacctaaaaacatattcagtacagttattataacatattgtagattaaatgaaagagctacgcttaaatttttctaaaataaaattcctgctcattttatagcaggaatttttgataattaataagtcaaaacaaagtttttcttttttccacgacgaatgactgtcagacgattctcaattttatcggaatctgtaagaacataatcaagttcttgtactctttctccgttgatataaattgctccatttgtaatatcttcacgagcttgtctctttgaaggagcaattcctgcagaaattaaaagctcaattagagtcaggtcttcatcaggagcgatttgatgttgtggcgctgctttcaagccagttaggattgatttagcatccaattgacgtaaatctccaccaccaaacaagatttcagaagttttaacagcttgttcataagcttcttttccatgaacgagacttacaacttcacgagccaaaactttttgagccaaacgttcatgacgagcagcctcaaattgttcttcaatttcagcaatctcttctaatgaaaggaaggtgaaaattttcagcattttcacagcgtctgcatcatcaacattaagccaaaactggtacatttcataaggagaggttttatcagcatcaagccaaattgcatttccctctgatttaccgaattttttaccagttgaatctgtaattaaaggaatagtgataacatgtccttgtttgttagccttacgacgtaaaagctctgtaccagcagtcatattaccccattggtcagaaccaccaagttgtaaagtgacattatgcaattggttcaattcgtagaaatcataaccttgcataatttgataagcaaattctgtataagatattccgctttccatgcgtgattttacagagtctttagaaatcatgtaatttacagtaaaatgtttacctacatctctgagaaaatcaataaatgtcaggttttcaaaccagttgtagttattggtcatttctgccttgttttcaccattttcaaaatctaggaaacgctcaagttgactacggatttttccagaccattttgttacggtgtcttttgtttggagcgaacgttctgaatctttaaaagaagggtcaccaatcaaaccagttgcaccaccaacaagtgcatagggtttgtgaccagccatttgcagacgtttcattgtcaaaatgagtacaagattacctaaatgaagggaatcagcagtaggatcatagcccacataataggaaaccatatcctccgtcagcgctttggaaagcgcagcttcgtccgttgtttggaaaaccaaaccacgtgctttaagttcgtcaaaaatgttcataaaaaaatcctttctataataattgagctgttccctttggattaaaaagtaaaaaaataacagcactgttttacattataacaaattactaaaaaaaattctgaaagtggcgaaaaattgttttaaatttgatataataagggcatgaaaaaagactcaattgactcgcaagaggagattcgtgctcgtttaaaagaaaaaatggataataaacgacgcaaacaaagtaactcttcaaggaaaagtcctaaaaaaaataataatgatagtgatgacaggtcaagtttatccattacttttaaagtactacgtggtttgagtgtagtatttggaatagtttttgtcttggtaggcgtctttggagcagcaacaggtgtgggttattttgctcgattagttgaacaaacgaagataccacccaaagctgaaatgctttcgaaaattaatgatatacatggggtttctgtcattaattatagtaatggtcagccaatctctgatatttccagtgatttgattcgcgttactgtgaaaagtgatgatatatctgctaatgtaaaaaatgccttgattgcaaccgaagatgacagttttaaaacaaataaaggtgttgttccaaaggctgtcattcggggaattgttggctcaattggaggtggaacaagttctggtggttccaccttaactcaacagctcattaagcaacaagttttaggagatagtgttacattccaacgaaaagctagtgaaatcgtctatgcactaaaacttaataattatctgactaaagatcaaattttgacagattatttaaatgtctcaccttttggtcgcaacaataaaggtcaaaatatcgctggagtgcaagaagcagcattaggaatttttggtaaatcggccaaggatttgacaataccagaggcggcttttattgctggtttacctcaaagtccaattgtctactctccttactcagcagatggctcccttaaatccaaagaaaatatgagctatggtctggagcgtcaaaaggaagtattattttatctttatcgtgggggatatatttcagaggcagattataaaaaatatgtagcctatgatatttcaaaagaatttttacaacctggagttgccgaatcacaagaacatggttatttatataatgtagtttataatgaagcaattacagatatttataattatttgattaaacgtgataaagtttctgcgactgatttaggaaatgatagtacgaaaaaacgttatcaagaactggcggaacaatcactacaaaatggtggttatactgtaacaacaacagttaatcaaacagtttatgatgcgatgcaaaaagctgtaacgggttataacgggcttatgcaagatggtacgggaactatccaaacagggaatgttttaatggacaataaaacaggagctgtttatggctttattggaggtttagatttttcacaaagtcaagtcaatcatgcctttgatactaaacgctcgcctgggtcatcaattaaaccaatcttggcttatggtccagccatcgatatgggactaatgggctctgcaagtgtcttatcaaattatccagctaaatactctagtggacaagatattgaacacgtaggctcaactggaactgcaatgatgccattctcagaagctctcaatgtttcttataatattcctgcttattggacttaccaaacgattttaaataaaggaaaatcagttgaaccttacatgacaaagatgggttatgatattgctgattattctgtagaatcacttccgcttggtgggggagttgatccaacggttgttcaacatacgaacggttatcaaacgctggctaatggtgggaaatatgaaccttggtatatcgttgatagtatcaaagatgatacaggaaatgtaatctatcagcataaaagtactggtggcacccaagtttattcagaagcaacttcaacaattatggaatcaatgcttcaagacgcagtgaaatctcaaaaaacaagtaagttttatggaaatttacaaacgattaacccttcactagcaacgaatgttcaatgggctggtaaaacggggacaacggatgattatacagatgtttggatgatgttatcaacaccttcagttacacttggtggttgggctggacatgatgataattcaccgatgacaagtaaatcaggatatatcaataatgcagcttatattgcacaattggttaatgcgattaatgcagctgatccaaacatttttggccctggacaaaaatttactaatccaaatactgatccaaatgttactaaaagtaaagtattggtttctacaggagaaaaaccagggaaagtcatagttaaactagcaaatggtaagactcaagaagtcaaccttggcggagaaacaacgactagcttctgggctactaaagcaggagcacctactactacctatgatttctctataggtgggtcagctagtgatatagctgctggttggaagaaaattttaccttctttcaattttagtcagacttcttcatcaaaaagtaactaaaaaacactaggaatttacctagtgtttttttattagaattagtagtttttgatttctgctactttttcagtattaagtgaagtaataatcgctctcaagaaagtttgagcttggagaaaatcatcaaggttgaaaatagtttgatgactatggatataacgggctaccacaccgattgttgttgaaggaactcctccatttgctaaatgagcggcacctgcatcggttccccctttggccatgtaaacttgtgttttaactttggcatgatctgcagtgtcaagtaagaagttcttcattccaggaagcatgatatgacctgggtcgaagaaacggagcgttgttccttctccgaggcgaccattatcgtcaccgaaggtatcgcttgctggtgaacagtcaacggcaaagaataaatcaggattgaatttggttgtggaaacttttgcaccacgaagtccgacttcctcttgaacattcgctccaataattaatgttacaggtaattctttgtcagctaaaaattcaagaagttcaagaatcattaagcaaccatagcgattatcccaagctttagaaatgatatttttcccatttgctgacagaattgtttctgtttctggaataattaaatcaccttgggcgattccaaattcggcagcttcagcagcattttcaaatgcaccatcaaagatgatatcagagattgctgggatttgaggtgttacaccagttccgcgaagaaggtgtggaggaagaccaccagttacaaccggaatctttttacctgtacgtgtaaatagggtaaaacgttgacctgaaacgactaaggggttccaaccaccaagaggaacaacgcggaatgttccgtcagctttgattgagctgaccataaatccgacctcatccatgtgagccgcaatcatgattcgtggggcattttcgacttttgaagcttttgtcacaaaaataccaccaagtccgtcaaattctggttgatagcctagctcaaccatacgagcttttaaatagtcgcgaacgggaccttcaaaaccagaagtggcttgaatttctgtcagtgcttttactttgtcaaatagttccatttttctcctccgggatactgaaaaatttactgacaaatctgtcagtaattcttttgatgatttacactataattataccaagaaatatgttaaaatttccatatgaaaaaaatactaaagtttggtttgggaattgtcgcgggtgcagccgttgctcacgcagcttatcatggttataaaaacatggaagaagaaatgattcatgagcttactgatagagtccgacaacatttttctacaaaaaaaattgatgctttttggatttttgatgagccaacttctggtgccctttttgaagggggaattgtcagtaatgataaatctattgcttttgaaatcaatgccaaaactttagaagtttttgagaaaaaagaagaacttctttagaaaatggttagaatccatttgaaaaatacgaaaggaaatacagaatgattattccagaaaatattgaaaatttagctgagcttgtcaaaggtccagaaaaaacagtcttctttttcacagctggttggtgtggagattgtaattttatcaaaccgaaaatgccagaaattgaaacagagaatccagaatttagatttgttgaagtagaccgtgatgagtacatggatcttgctatcgagtggggaattatgggaattccaagttttgttgttattgaagatggacaagaaaaagctcgtctagtcaataaattacgcaaaaccaaagaagaagtgaatactttcttagcaagtgcaaaataagactgatttcttgaggtaaaatggagtcaaatactgaccattgataaatccagaaatatattctataataatcactgttaagaaattaaaagggaaaatttaaaaatgattgcaacatataacacaaacgtcggcgatgttttaatgcttatcacggcaaatgatagaggtgaaaaggtaaactttgaacgtaagggaaaagtagcacgtatctttatcgaagaaactggggcaacagtcgcttggaatatttttgaagccaagtcattactgacagacttgtcaggaaatggacaagtcaaattatcatctgatgatgttgaaatcttgaacaaagagcttggaaaatcaggatttagcgatgttcttgtgcatgattcgcaaccaaaatttgttgtcgctgagattgtagaaatgcaagaccatccagactcagatcatcttcatatctgtaaagttaatgttggttttgctgatccagtacaaattgtttgtggtgcaccaaacgcgtcactcggattaaaaacagtcgcagcacttccaggcgcaatgatgcctaatggagcattgatttttccaggagctcttcgaggtgttcaatcttatggaatgctttgttcagcgcgtgaacttgaattacccgatgctcccgatgttcgtggaatcattgaactttcatcagctttggctgcgggtacagcttttgattcagaaactatgtggcaagcttaataataaatctgtcaaaataatttattttgacagatttttttatctaataattaaaataattatttcacaatgttcacaagcgcttacaaaagaaaatagattgacttatgctaaactgaataatgtaaaaagaattttacatttaaaggagatctattagcatgaaaatcgtagttatcggtacaaaccacgcaggcattgctacagcaaatacattacttgaacaatatcccgggcatgaaattgtcatgattgaccgtaatagcaacatgagttatctaggttgtggcacagcaatttgggttggaagacaaattgaaaaaccagatgaattattttatgccaaagcagaggattttgaggcaaaaggggtaaaaattttgactgaaacagaagtttcagaaattgattttgctaataagaaagtttatgcaaaaactaaatctgatgatgaaataattgaagcttacgacaagcttgttttagcaacaggttcacgtccaattattcctaatctaccaggcaaagaccttaagggaattcattttctgaaactttttcaagaaggtcaagcaattgacgcagaatttaccaaagaaaaagtaaagcgtatcgcagtcattggtgcaggatatatcggtacagagattgcagaagcagctaaacgtcggggtaaagaagttcttctctttgacgctgaaaatacttcgcttgcttcatattatgatgaagaatttgccaaaggaatggatgaaaaccttgctcaacatggaattgaacttcattttggagaactggccaaagaatttaaagcgaatgaggaaggttatgtatcacaaatcgtaaccaataaagcgacttatgatgttgatcttgtcatcaattgtattggttttactgccaacagtgccttggcaagtgataagttagctaccttcaaaaatggagcaatcaaggtggataaacatcaacaaagtagtgatccagatgtttacgcggtaggtgatgttgcgacaatttattctaatgccttgcaagattttacttatatcgctcttgcctcaaacgctgttcggtcaggaattgttgcaggacacaatattggtggaaaagaattagaatctgttggtgttcaagggtctaatggtatttcaatttttggttacaatatgacctctacaggactttctgttaaagctgctaaaaaattaggtttagaagtttcatttagtgattttgaagataaacaaaaagcttggtttcttcatgaaaacaacgatagtgtgaaaattcgtatcgtatatgagacaaatagtcgcagaattattggagctcaacttgctagtaaaagtgagataattgcaggaaatataaatatgttcagtttagcgattcaagagaaaaaaacaattgatgaactagctttgcttgatttattctttctcccccacttcaacagtccatataattatatgacagttgcagctttgaatgccaaataaaaaatagaaatctatctgcttgatagatttttttattttttagtgacaaatgctcaaactttacgtatagaaagttaggaggattttataatgaataaaaccatgttgattggtcgtttaacaaacgcacctgaaatttcgaaaacaacgaacaataaatcttatgtccgtgtgactctggcagtcaatcgccgcttcaaaaatgaaaaaggagagcgagaagcagactttatctcgataattttatggggaaaatcagcagaaacattcgtttcctatgctaaaaaaggaagtcttatttctgtagagggagagattagaactagaaattatactgataaaaatgaacagaaacactgtattacagaaatcttaggtttgagctatgatttattggaaagtcgtgcgactcttgccttgagagaaagcgctgtaaattttgaggaactcttacttgaagctgatgagctccctttctaatttatttgattaaatctaaatgttttctcttgactaaatctgaccattgagataaaataagaatatgttagcactcaactattaagagtgctaaaaataaaaaatggaggaaagtataatgttgaaacctttagagaatcgcgtagttttacgtgtaaaagaagaagaggaaaaatctatgggcggaatcgtattaacgagcgcttcccaagaaaaacctcaaacagcggaagttattgctgtcggtgaagggaaaacaactaatcatgggacactgatttctccactcgtaaaagttggagatacagtaatttttgagaaattttccggaacgactgtcaaaatggacggtgaagaattcttgattctcaaagactcagaccttcttgcaattgtagagtaaaaatataaaagcaatcaatttttgattgtcttttgtctatcttaaaatctattaattaaaaatatattcttaaaaaaggagctaaaatgtcaaaagaaattaaattttcaagtgatgctagaacagcgatgatgcgcggaattgatattcttgccgatacagtaaaaacaacccttgggccaaaagggcgtaatgttgttcttgaaaaatcatatggttcacctttaattacaaatgatggtgttacaattgccaaagagattgaacttgaagaccattttgaaaatatgggagctaaacttgtttcggaagttgcttcaaaaacaaatgatattgcaggtgatggaacaacaacagcgacagttttgacacaagctattgttcgtgaaggattgaaaaatgttactgcaggtgcaaatccagttggtattcgccgaggaattgaactcgcagctgaaacagcagttgcttcaattaaagaaatggcaattcctgttcatgataaatcagcaatcgctcaagttgctaccgtttcatcacgtagtgaaaaagttggggaatatatttctgacgcaatggagcgtgtaggttctgacggagttatcacaatcgaagaatcaaaaggaatgcaaacagagcttgatgttgttgaaggaatgcaatttgaccgtggatacttgagtcaatatatggtttctaatacagagaaaatggttgctgagttagataatccttatattctgattacggataaaaaaatctcaaatattcaagaaattttaccgcttcttgaacaaattttgaaaacaaatcgtccacttttaattgttgctgatgatgttgatggagaagcattgccaactcttgttcttaataagattaaaggggtcttcaacgtagtcgctgtaaaagcaccgggatttggtgaccgccgtaaagctcaattggaagatttagctatcttgacaggtggtacagtaattactgaagaactaggccttgatctcaaagatgctacactagaagctttaggacaagctgctaaagcaactgttgataaagaccatacaacaattgttgaaggtgctggttctgttgatgccatttctgatcgtgtggctatcatcaaagcacaaatcgaaaaaacaacttctgattttgaccgtgaaaaattgcaagagcgcttagcaaaattatctggtggagttgcggtagttaaagtaggagccgcaacagaaacagaacttaaagcaatgaaacttttgattgaagacgcacttaatgcaacacgtgctgctgttgaagaaggtatcgtttctggtggtggtacagctcttgttaatgccatcgcagctttggataaactttcagaagaaggcgacattcaaacaggaattaacatcgttcgccgtgcgcttgaagaaccagttcgtcaaatcgcggccaatgcaggatatgaaggttcagttatcattgataaacttcgttcagaaaaagttggtacaggatttaatgcagcgacaggtcaatgggtaaatatgattgaagaaggaatcgttgacccggcaaaagtgactcgttcagctttgcaaaatgcagcttctgttgctggattaatcttgactactgaagcagttgtggctaataaaccagaaccagctgctccagctatgcctccaatggatcctagcatgggaatgggtggtatgatgtaataaaaaaaagaacccgagtgggttcttttttttattttttaatgattaatgttagatatcataaaggagacttgcatgttcatggctggtatcaagaatttttaattcattttttgtatccacatcgtgttgttggagataaccgtccatggtaagatgagcaagttctttaatattattatttagacttaagtgtcccaaaaatattttttttgttttattcccatgaatgttaaaggctgcttcggcaccatcttcgttagataaatggccttggtcacttagaatacgttgttttgttcgccaaggataggcacccattcttagaatttcaatgtcatgattagactccattagataagcatcagcattttcaatggttccacgcatacgatctgaaacatatcctgtatcagtcaacataacgaaacttttatcatctttcatgaaacgataaaattgtggggcaatagcatcatggctgacaccaaaagattcaatatcaatatcaccaaatgtcatcgtttttcccatctcaaaaagatgtttttgctcaagaggaatttttcctaaagcgtttttaccatcaagttcagaccatgtatcttcattcgcataaaggttaataccatatttacgggcgagcacaccaattcctttgatatggtcactatgttcgtgcgtaattaaaagtgcatcaatatcatggatatcacggtcaatctccgagagtaaactttctattttttttccagatagtccggcatcaacaagaatttttttcttaggagtttctaagtagaaggaatttccagttgatccagaggctagaatggaatatttaaagccattttgttcagtcataatgactattgtagcagaaaaagtcagggattgctatgagacttattattttattggaaaaaaattgagcttgaaaaaatttttctttgatgaagaagtctatgtaagaaataatagattttttccaaaaaaagagttcactgatttgacagtgaactctttttgtagtttgaattaggaaggataattttattcaaaatcatcagcagcgtcatcccaatattcggcagtttcagaagaatatgggagtgtgaaactgaaagttgttcctttgcctttgccttcggagcttgcaaaaattgttccgccatgtattttgacaatgtcatgaacaatagataagcctaaacctgttccacctacttttgaatttcttgaagcattatctactcgatagaaacggtcaaaaatcttaagtaaatcagattttggaattcccattccttcgtctttaatcgaaattaagacatctcgttcacgagtttcaatggaaattgtaattgtaccaccttttggtgaatatttaatggcattaccaatgatattatcaatgacttgggcgattttatcggtatcaatttctacccagattggcttgtcagaatactttctaacgagtgtaaaattggatgaaattaaatcatttgattcagtttctaaaatctggtctaatcgattaatttgatagtctaaaaaggcaattaaattaatgatttctttattaagaacaattcgatcttggtccattcttgacaatgttaaaagatcagaaatcatccgaatcatccgattggtttcggttagtgaaacaccgatgaatgaagaggctgtttctttatcatcaattgcgccatcttctaatgcttcaagataggccttgacggaagtaagaggagttcttaattcatgcgagacgttagaaacaaaaagacgacgttcacgttctgctttatcttgttcggtcatgtcgtgcaagacagcaataattcctgaaatgaaccctgactcacgacgaaagagtgcaaatttgatgtggagtgaaattgatttattcccagcatcgtgtgtttcgatggttatttcaggttctttttcaagtaaatcataaaagttatactggtctgcgattttcaaaacatcaacaatattcttttccattagaagctcattacttgtgtttaggtaatggagggctgacttattagccatgatgatattaccacggcgatctgtggcaatcactccgtcaaccatgtaggcaagaatgctatctaattgattgcgttgattttcaagattattttgagtccgaacaatgtcctcaccaagcttcaaaatttcttcatataattcattgatttcacttgtcccttttggaattttatctctattcaaataaccgttttttatatcgttcatttgtttagaaacattcacaatcattcgatgttgctgattgagaaaaaccagaacaaaaacgagtgaaaataaataataaccaataaaagtactaagatgaatgagattataatcgaaattgctcatgaaaagaatgacaaaaagaagtaggtgggcaactactcctttaaaaatcattgaattaaaaaatttaatcatgtgggttgctcatgtaatagccaaccccgcggcgtgttgaaacgtattgtggacggcttggtgtatcttcaactttttcacgcaagcggcggactgtaacgtcaactgtacgcacatcaccaaagtaatcatagccccaaactgtttccaaaagattttcacgagtgataacttcgccgaggtgttgagcaagataataaagtaattcaaactcacggtgtgtgaggtcaagttgtttatcatttttgtaagcagcataatgtgctggattgatacggagatttccgataatcaattctttcttaacattatcagtagattcagcaggtgcgacattgatacgacgcaagtttgctttaatacgagctaaaagttcgcgatttgaaaatggtttagtgacatagtcatctgcaccaagttcaagtccaataactttatcaaactcgctatctttagctgacaccatgataataggagtgtcagaggttttacggatttcacgtgcaacatcaagaccgtcaagttttggtaacatcaaatcaagtaaaataaggtcaggttgtacttctttaaaagcttcaagggcttcttcgccatcgaaagctgtaaatacttcaaaaccttctttggttaaattaaattttacgatatctgagattggtttttcatcatcaacaacaagaatttttttcatagttgtcctttcaagtagaaatttttttattgaatattacttggatttatttgatttaacaaaccaagtaatctgtttcagttatattatacaatttttagtaaaattacgcaaaaagtgacccctatattttcagaaaaaagataaaaagtttgattttttgatataatagaggctatgaatggaattttaatttccctagagggacctgatggagcaggaaaaacaacagttttgcaagaaattttgcctgaaatccaaaaaatgaagcgtgaagttgtcccaactcgagaaccaggtggggttcgagtggctgaagaaattcgtcaaattattctcgatccaaagaatacagagattgattcaaaaacagaattgatgctttttgcggcggcgcgccgtttacatatgcaagaaaaaatgttgccagctttacgagcaggtaaggttgtcattgttgaccgatttattgactcctctgtcgcttatcagggttatggccgtgatttgggtgttgaagtggtggattggcttaattattttgcaacagatggtttaaaacctgatttgactttatattttgatattgatacagatgttgcacttgaacggattatgaaaaatcgagcggatgaggtcaatcgcctagacttagaaagagctgagatgcatcgaaaagttcgagagggttatttggaaattgttgcaaaagaacctgagcgttttgtaaaaatagatgcgagtcaatctttggaaaaggttgtagctgatacacttgaagttctgaaaaaaagatttgtcagtgaattttaaagacaccttaatctgtcagcaaatttaataaattgataaatattgacaaaataaaaaaatacgtagatgtcaaaaaaatttttttattttgttatttaaaatagatttggtaaatatttagaaaggcttcttgtggaaatagtagatattcagcctcaactttataagcaattttcaacaattttgcaacatggaaaattaagccatgcttatttattttcaggtggatttggttcttttgaattagcaatttggttgagccaagccctgttttgtgagaatcctgagaattctcttccttgtgggcattgtcgttcttgtcgtctggttgctcaacaggaatttgccgatttgcacattgttgaaccagatggacagacgataaaaacagcacaaattcgtgattttacacaggtttttagtgaatctggttatgaaggaaagcagcaagttttgttatttagggaagcagaaaaaatgcatcctaatgcggcaaatgctctattgaaatctattgaagaacctgagacagaaattgttgtttttttactgacagataatgagaacatgattttgcaaacgataaaatcacggacacagattattaatttccggaaaaacgttcaatttttacaagattttcttgaaaaaaatggaattttaaaaacgcaagcagaactcctagctgaaatttgtaattctactgacagagccttagagttggcccaacaaagttggttcaatgaaggacttcagagaattcaacattttgttaaacttctaaaaaaatcagcagacgaggcctttttatacttgaaagatttggttgaaatttttgatgataaagaaaagcaaaatcaagcttttgaacttttattgcaactatttaatcaagaaagaatgagtcaagaacttctaaaaacctttcaggcaattaaaatgtggaaaagtaatgttcgatttgagtcaagtttaacttttattgttctgtaaaacttggacagcaaccctttaatcagaaatcttatatcaggagaataaaatgatttatgaaataaaatttgcgcatggtgaatctaatatatttgcaacaagtgaggcagaattagtcccacaatcagaagtcatcattcgttcagaaaaaggaactttttacgggaagattattcgtagtttttctgatgatgccaatcttgaaactcatcatacaattgaacgggaagtcactgatgaagatttagaagtaatcttaaaacttgaagaactttcaaaaaaggcaaaagataaggttcgacaactcgttgtggaacaagaacttgagatgaaaattattgatgtggcttacactttcgatcaaatgcaactctttatctcttttaccgctgaaaatcgagttgattttcggctactgctccgtgaattagcaacgacttttcggattcgaattgaacttcgacaaattgggccaagagacgcggcgaaaattcatggcggactcggaccgtgcggacgtcctttatgctgttcggaatttgtttacgagtttccgaatgtttctatcaaaatggccaaaaatcaaaatttatctttgaaacaaaataaattgaatggactttgtggtcgtttaatgtgttgtttaacttatgaagatagtttttataaagaagcccaacaactttttccagattttggtgaatttgtaaccacctcagaaggaaaaggaaaagttgttggcttaaatgttttaaaaaatagagtgaaaatacgctttggagaatatagcaaggattttgaacttgcagagattgaggtgaatcatggctgataaatatgatgtttttgaccaattgggcgagcttgaaaatacattaaataccacattaacgcaaatttcgggaattcgccaagtgcttgaagcatcaatgactgaaaatgcaactttacgcatggagttggaaaaattgcgtgatcgacttgctgaatttgaaaagaaagaagttaaaaaagaaacgcccaaagatcaacccaaccctaatctcattcaaatttttaatgaaggatttcatgtttgtcatttacattatgctgaacggttggctgaaggggaatcttgcttagattgtttggagcttttatatcgctaatggaaaataaatttaatattcaacggtcattcaaaggagtgaaaaccgctggaagtctctacttggtgccgacccccattgggaatatgcaggatatgactttgcgctcactggaaactttaaaaacagtggatttgatttgttcagaagatactagaaacactttacgacttttgaatcattttgaaataaaagtgccccaagaatcatttcatgagcataattcgcaagaaaaaattccaaaattgattgactttttaaaatcaggtcaatccattgcacaggtttctgatgcaggaatgccatcaatttctgaccctggacatgacttggttttagctgcaattaaagaagaaattgatgtcgttgcgctgccgggagcttcagcgggaattactgctttgatagcttcaggcttagtgcctcagcctcatattttttatggttttcttcctcgtaaaaaaggagaacaacaaaaatttctgaaaacaaaacttgcttaccctgaaacacaaattttctatgagagtccatttagagttgctgatactttatccaatatgcaagaaatctatggggatagagaagtggtgcttgttcgtgagttgaccaagatttatgaagaatatcgccgaggaaaaatttctgaggttttgaattctttagttgagcaacccattaagggagaatgtttaattattgtttcgggagcggacgaattagttcaagaaattcaggagccagagctgacagcactggaagctgtcaaaaatttagtggcgcaaaatgtaaaaccgaatgtcgccattaaagaaattgctaaagaacgaggcttaaatcgccaagatttatatgcagaatttcatgatttataataataaaaagttactgacagaattcttgtcagtaactttttgtatttttgattaaatataatttctgtcagtaaaatttaacaatgcccgtcaacattttcattaatccatttttgcttttcttcatcaaaaattcgtaatgacttttgtgaacggacaaaatcaatgatttctttacgatttaagtgagttttactgacagcagatccaacggttacaatttccattttttcaatgagtgattgaagtatttcatattgattttccattgtttgtcctttcatttactgattgtattatactacttttatctctgtttatggaaacaaaataacagcactgcttagtttttctttgaataagcaagaacggtaacgggtgctaaaatgagaacaatcagaaggctgattagaagaaccaaccaggcttcatgaccaaaattaccattatatgccacttctttaaaggcagtaatcaaatgagaaacaggattattttcggcaatgactttcagccattttggtaaagaagtgacgggaatataagcatttgacaaaaaggccaaaaacatggtcaaaaagctcgaaatggttgtcacagttgctgcacttttggcaaggacaccaactaaagcaaagagccaactgagcgcccaagttgtaacgattgcaaggccaattgcaacaagcagccaaccaaatccggcgcttgctcgccaaccgagagctgcacctgtgcctaatgcaaagacagcggcaataatataacggataatatccgagattaacgttcccgctaagggtgcaattcgtgaaattggcaaagaattgaagcggtctgtagctcccttgtccaaatcctcacgaagttgggttccagcagcgccagatgtcataacaagtgtttggattaaaattccgggaacaacaagagggagataagctttgacatttcccatgattgctccaccaaaaagttgggagaaaacgatgatcatgataattggcatgacggtcacatcaaatagtttttctgggctatgtttgactttgagaagttcacgcttggccatgacgataatatctgtcaaccaagattttaaactgattgttttcatcgttgtagtatttttgttaattacagttgtgtccatttttattttctcctattttcctgtcagctcaagaaaaacttcatcaaatgttggtttacgtgtttcaaattcattgatggctatgtgttcagtttccaaaagtaaaagaatttgtgtcatgatttttgtgtcagttactttgattgacaaagttgcaaattctggtagaacaatcacttcaatattgaatttttgttctatcatttctttggcttgtttaatttgactgcttttaatcaatgagagctcaaaagtggtttctcccaaaatgtttttaagctctgacggggtgccttgcgcgatgacgcttccatggtcaatgatggcgatacggtcagccaattggtcagcttcgtccaagtattgtgtagtcagaacgatggttgaaccccttttgaccaactcacgaattgtcttccacatttccccacgtgttctggggtcaagacctgttgttggttcgtcaagaaagataagcgggggtttagtgattaggctaacagccaaatctaatcttcttctcattccacctgaaaaagcactgatggatttgtccttagcttctgtcagtgaaaattgtttgagcaattcgaggccgcgtttttgggcttcttttttggataggccatttaactgaccaaaaataatcatgttttccatccctgtcagttcctcatcaactgaagcatattgacctgtcagcccaataaagtttcgaacttttgcaccgtctttggttaggtcgtttccaaagatagaagcagaaccagatgttacttttgttaatgttgcaatcattcttaagaatgtggtcttccctgcaccgttaggtccaagaattccaaagatttctccttgatggacatcaagtgaaataccatttactgcgtttttaccatcaaagtttttgacaagatttgtagttgaaattgcgagtgccattattatctcctttttcataaggttaccttagtaaaaatattataagcctccctgattaaattgtcaagaaaaaagtatgggaccctgattatattttttataaatgctaaaaaatgtgataaaataagactatgacaaagaaaaaagaaaatacaagtcagggatttattcgttatgttacccttcttttttggtatttgagaaagagtaaaagtgtcacaagaaaacaaacagtggaatattctcgattacaaggacagggacaaattttaaatattctaatggaaaacagcaagatgacgcaaaaaaatctggtagctcaactggatatgcgcccccagtctgccagtgaaatgataaaaaaattggaaaagaaacaatttatttcacgtcaaaaagatgctcaagataagcgtggatttatcatatcactaactgaaaaagggaaggctgttttggaagaaagtgcagaacaaacagaacttgttccaggcattatgacaagctttacagaagaagaaaaaattgaatttgcaagattaattggcaaactccaaagtgaactagatgaaaaaatcagtcatgaagatgaccgaattaaggaacaatataatcgtatagcaggaaattagttgtttttggtatttggaaaataaaaaatcgagattttatgatctcgatttttttattaatcaactataaaagtgacaggattaattattggaggtgtcactttataaaaaaagatggtgattaaccatcttaaaaggagtaaatccacgtgtttttagccccattttttaggaggcgttgactgatgcgaatcgcatctttttcattttcagccagagcaaccatgactccaccaagtccagaaccagtcaatttagcaccaagtgctccattttttcgagccgtatcaactaaattgtctagccgggggtgagaaacaccgagttctgaaagtctttcatgagctttattcatgacgtgaccaaactctttgagtttatcggtcattaaaaaggcttttgagtctgtggctaattgcccgaggtcattaattgagttttgagttttttcgttttcctcaacaagtttttcccgaacaatattgatggcttgactagtaaagccgtgcacaccagtatctccaatgacgataaaaccatggagatttagttcaaagggttcaattgtgctatctttaataaaccacaaagggtgctcagaattaactgtcgcaacatcaattccagaagatttaccatgggtaatattttcagaaaaattggcataaaaaagtaagtctttttgtggaagttcagcatcaaagaaatcataaaaggctctgatgatggctgttgccaaagaagcagaggcacctaaaccacgtccttgaggaatgtttgaatcaatttctaaagaaaaaggcatttttgaagaatgaaatttagcgagtaaacgcatgatgagttggcgaattccttcaaattcatctcccattaaatcaagtcttcgacgaaattcattattttcaatgtattggccatattttgatgaagtaattgtcactgtagttttaagaattgttacaggtaaggcaattgctggctgaccatatacaacggaatgttctccaattaagattagtttggaatgggcaattcccgtccccattttattgatagtcatttttaataattctcctgctagattagtttgtcatttgataaatgtaaactgtaaattagcatatttttggttaaattaagtcagattgaggcaaaaatactcgatagactttcttccaatatcatacattttgaatacaaaaacgtacctgacaattttataaaatttcttcttgaaaatcaagcttttatttctattttgacttttaaattatgatttatgataaaaataagtattttttagacagaaaattatctttgaaaatgataagagataagaaagaattgttttttttgatataatagtttcatgaaaaatattgttactgcacgggcgcatacgaatatcgccttgattaaatattggggaaaaacggatattgctctaaatatcccgacgacatcttctttgtcaatgaccttggagccattttatacaacaacctcggttgaatttactgacaatgagtctgactcattaatcttaaattcagcgatggaagatagcagtcgtgtcagcaaatttttggaaatgatgcgtggacaatatggaaatttccctaaggtaatgattcaatcagaaaatcatgttccaacagcggctggattagcgtcaagtgcttcaagttttgctgcacttacagctgctatgtttggacttttagacttagaaaaagatgattccgaaatgtcacggattgccagacggggttcgggttccgcttctcgttcaatttttggaaattttgctgtttggaataaaggggagaatcatcagtcttcctttgccgaatctttttacaataaagacattgggctttcaatgattgttgccgaaatttcttccgaaaagaaaaaaatgtcatcaacaaaaggaatgcaattggctcaaacagcgccaacttatggtgcttgggtcgaaaaatcagcaattcaacttgcagaaatgaaacaagcaattcttcaagctgatattgaaaaagtgggtctaattgctcaagataatactcttggcatgcatgaacaaaatcgtctatgtcttgaaccatttgactattttacctctgaaacgcaacgtgttgtagactttacaaaagaatgttataaagcgggcttactcgcctttgtgaccattgatgctggaccaaatgtaaaaattattactgaccatgcgacagaaaaaatcttgttaatcaagttaaaagcagagtttccagaattaacttttgatattgcacgtgctggaggcgcttatgagtatctctgataagaaaattaagacaaagataccggggaaacttttttttgctggtgaatatgcggtcacaaaagaaggaaatctcgccctcattacgacaattgaaacaaattttgaaatgagtatttcaagagcgagtgacaaatcgattctcaaaacaaatgttggacttgctgattttgaattctcattgagcaaaattgaatttgataaagaaagtccttggaattttgcgctgacagccttaaaaaatactttgtcagctgctgacagttctaaaaaagagtctgtcagtaaaatttctgagctgtcagtagaaatatgccttgaaattcggagtgatttaggctttggggaaaataaaaaaggctatggctcaagtgcatcagttgtttgtggcgtagtcaatgcggttaaccaattttttgatttacaactttcccttgaaaaacggtttgaaattgcagcaaagacccattttgaagtgcaaggttcaggttcaatgggggatattgcggctattatgtatggtggttcagttttctatcagaatcataaccgtatccttcctcttgagattccttggaaaacctatgttgttcaaacgggaaaagcagccaaaactgctgaaaaaatcaaaatcaaactctctgatgaattttatcaaacttcaaatgagttagttatcgaaatggcaacagcgattgacattcaagattttagcttattcaaagaaaaattatcagaaaatcaacttttacttttggaaaatattccagaaggctatatgactaaagtactagctcttgcattaaacttgctcaatagctatccagagcttgccgctaaaatctctggtgctggatttggggagaaccttattttgtttgctcaaaattcaatggctattgctgaggttcaaaaaaaattatacgaatatggaatcaatcttgaagagtttaagattgctcaaaaaaataactgagtttaacctgctaaaaactaaaaaagaaaacaaagatagatttaagcctgtacgagcttgatttttcttacttttcctgtttttaaaagactaggttttacacttaatgaattgagaaataaatgatgaaaagtgaaaaagaaatccatcaacatcgtaaagacgaacacctatcattagcatacaaatattggaaagaagaaagaaatcagactttgggcctgactttttctgatgtccgaatcattcctaatacattaccagaactttcaactgaaaaagtagagctttcgtcaaaagtttttggtcaggattttgaatttcctttttatatcgaagcgatgactggtggaggcgagcgtgcagataaaattaatcagactttggccgaaatcgcgaaaaatcagcatctagccatggcagttggttcacaatccattgccctgaaatttccagaattagccgcaggctttaaagaggttcgtaaaattcattcttctggttttctctttgccaatcttggagctggacattctttagagaatgctaagcgagcggtagagatgattgaggccaatgctttagaaatccatgtcaatacggcccaagagttgtcaatggatgaaggagaccgtgaattttattggttagaaaacattaatgaaattgcaagtcaactagaagtaccagtcattgtcaaagaagttggctttggcatttcccaaaagacctttaaagaactcgcaaaaacagctgtttcgggaataaatgttggtggagctggcggaactaattttgcttggattgagcgtaaacggagcaaaaatggttttgatttggacgattttggtttttcaactcttgaaagcctgctggaggctaaaacggcagagaataccaaaagcttagttgctactgggggaatttcctctgctcaagatatttttaaatctttgattttaggtgccgatttggcaagttcagcgggttttattttgaaaaatctcatgcaaacaggtcctgaaaaggtagaagaaattcttgagcaatggaagcaagatttgaataaattatttgttctgacaggttcaaaaaacatagcagaatcccacaatgtagatctactttattcagcgaaaatgctcgattttatccaacaaagaaaaaaataaattataaatcaaatcatttggcaatgatttcaaaaacgactataatgagaatagaattaaaaaataatctaactgaattccattctcaatctggtcaaaatacccaagtattaagacttcaaaatggattcacatcttaaaaggagaattactatggcatttacattacctgaacttccatatgcgccaaatgcgcttgaacctttctttgatgaagcaacaatgcgtttgcatcatggaaaacatcatcaaacttatgtgaataatcttaatgcagcaattgaaaaacacaatgaacttgatgaccttaacctcgaagaattattgactgatttgtcagcaatcccagaagacattcgtacagctgttcgtaacaacggtggtggtcatttgaatcatagtcaattctggctttggcttcgtccaaatactgatggttctgaaaaccatgctgacggtgaaattggcgatgcaattgcaaaagaatttggtagttttgaaactttcaaaacagaattcaaagctgctgccacaggccgttttggttcaggctgggcttggttagttgttgatgaagctggcaaattgaaagttgtatcaactgcaaatcaagataatccaatttctgaaggattgacaccagttttgggacttgatgtttgggaacatgcttactaccttaaatatcacaatgtacgtcctgactacattgaagcattctttaaccttgtaaactgggataaagtcaatgaactttacgctaaggcaaaataaaataatcaatgaaagactctcctttttgggagagtctttttattttacagaagaattagaaaatgaaaagaattttctgtgtaaaattcatcttgtattttacaaaaagatgttttaaagagatttttttaaacataaatgcttatctttttgattaaatagtgctaaaatattattgtaatcggttacatttcgtttttaaaaaataagaaaggtaaatacatcaaaagatgtataggaataaaggattatgaaagatgatggaaactcttcaaactttactgatgaagaagagctgtttttgttacgcaataaagaaggaaaaattgtcggaatcaaggatttaaagcaggcaaattttcaagaaaccatgaaagactggaaagaacatctgccaaaacctagcttattatcaattattatttgggtggctgttgctttactgggtggtcttgcttggtcattaattgcgctagctcaaggggaaacgattaatgcgatttggtttgttattgcagctgtttgttcttatttaattggttatcgtttctatgctttatatattcaacgcaaaatcatgcgtcctaatgacttgcgagcaacaccgtcagaagctcataatgacggaaaataattcgacccaaccaatcgagtggttttattcggacaccattttgcatcaatcgctggagctgggcctttggttggaccagttttagcggcacagatgggttacttaccagggacaatttggattatttttggggttatttttgctggtggggtacaagatatgcttgttctctggtattctcatcgtcgtcgtgcaaaatcaattggggcaatggctcatgatgaagtaggtagatttgctggtggcttgacatcatttattgtttttatcatgaccatgattgttcttgctgttttagcgctgatttgtgtgacggcaatggcaaattctgcttgggcagtcttttcgattggaatgacgattccaattgctttactaatggggatttatctaaaatacatccgtccaggtcatgttaatgaaatttcagcaattggttttattttacttttagtggctatttttggtggtcgttgggtttcagaatcttcatttgctcatattttcatgctttcgccaacggctttggtatggtgggtcatgggatatacttttattgcggcgattattcccgcttggattttacttacaccacgtgattacttatccatgtttatgaaaattggtacaattgctattttagcaatagcagtcgttggtgtgcgtcctgatgtcacgattccagctttgacaaatttcgcacataatacagatggtcctgcttttgctggttcactctttccatttttattcgtcacgattgcctgtggggccttgtcaggctttcacgtcatgatgtcttctgggacgacgccccgtttgattgccaaagaatcgcaaacgcgcatgattggttatggcgggatgttatttgagtcatttgttgccattatggctttagtcgctgcgatttctcttaatccggggatttattattcaatgaacaccccccaagccagtattcaaaaactagcagcttcaagttatcaagcagataaaagtgccgaatataatgcttctaaagccattcccaatgttgcgatgatgccagatggctcaaaactcagtattgattgggaaggaacgactggcgaaaaagcgctccaacaagttgcaaaagatgttggcgaaaaatcgattgtttcacggactggtggggcaccaacgctggctgtttcaatgtcaaacattctacataaggtgccagttattggtgggacaaatatgatgggcttctggtatcattttgccattatgtttgaggctctctttatcctgtcggccgtttcagccgcaactaagtccactcgttatctactcaatgatgcgcttcgaggcttcaaaaaattaggacggttgggggatgatgattggctaccaagtaaaatcgtgacaactgcggtcattgttggtgtttggggagctttacttttgatgggcgtttctgaccccaatggtggaataaaaatcatgtatccgctctttgggatttctaatcagctgattgcagctgtggctctagccattgtctgtgtcatggttattcgtaaaggttatctcaaatgggtttggattcctgccattccattggtctgggatgtttgtgtgacctttgctgccagctgacaaaaaatcttttctacggatgtaaatattgggtattttgcttcttattcagcagcgaaaagtcaagtagattcaggaaaattgacaggtttattattaaccaatgcgcaagcaaccatgcgaaatacgatgattcaaggaattctgtcagtaattttcttgctttgcgtggccatattattagcaatttgtgccgttaaagttgtcaagattttgcaaaccaataaagtcggtgataagttcagctcagaagaagcttttgaagagtccaacctttttgaaacttcaagtttctggccaagtcatcttgaacataaggttttaaaaagcaaagttaaaaattaatgatgaatagaaaatgaaaagttactgatagaaatttctgtcagtagcttttttatggatcatctgatgctttgattatttcaatcgatacaagtgtggatagaatcatcagcaaagttgataatttacttagccacaatctgaccacacactgcaatcatggtcagctgtcagtaatttttagtagaagttttttaaagctttgtccaaattttcttttgctttatcaagaattttatttttagctaaagtggcggtaccttcagcccggacaatttcaaaagtatcaaagcccatgatttctgaaaaaatcattttgagatattgtggagcaaagtctaagtcttgataaaaattattttcgctataaactgaaccactagcaaagagtaaaagcgctctgtaatcatcagtcatcaatccggtagatactttccctttctcatcagggaaatcaagatatttgaaggtttcacgagcaattaggatattgtcaatgtaatctttaaggcgtgaagtaatattaaaattatgcaaaggtgtgacaatgactaggcgatgatgttccttaaactcttttaatagtcgttcagaagtctgggcaatattaagctcgtcagcagataattttttgtcagcagcttttttgtcccaaattttgagcagttgattttgctcaattcgtggcaaattgccatcaaggtcataaagattaaaaatagtcagatcatcttcggaaaattgactcttgtaattagctaaaaatagttcttgaagttgattggaaaagtgattaaaattattaaaatcgggatgagcgttaattaataaagttttcaatgatagttcctcatttcttttgataaaataattataaagcataaaggtgataaaataagacacctttaaaataaaggaaaatattaatgaaaaaggcagaacgattaaatcaggaacttatttttttaggaaataaggaaggatttcagctcaaagatttgatggaagaatttcagatttcaaaaagaacagccctaagagatgttgaagaattacaagggatgggtctgcccttttataccgaaaatgggagatatggcggatataagttgattaatcaaggcttatggacaccggtttattttaataatgatgaaattgaagctattttctttgccttagatgccctaaaactactttcaagtagtccttttgaaaaatcttaccgtcatattcggcaaaaattatccgcaactttacctgaaagtcagcaagaatatatcagtaaaatgctgacagtagttaatttttacggaattgcgcctgtcagtaaagtgactgatttgaaattactgatgacagcgattttgtcagagaaaattgtcaaaatgacttattcacagtatgaaataaaaaaaattgagcttcaaatttacgaaatattttatcgaaatggcttgtggatttgtagtgcctatgatgttaaccaagaaaaatggggaacttatcgttgtgattacatgtcagaggtcgaaatcattgatgatggtcgtcaaactaaaaaactatctgaattaaaaatgatacaagagacttatgagaaaaattatcatgacatcccctttcgctgtcgactgacagattttggaaaggagttatatctcaagcaccattatccgaatatgcacctagaagaaattgctgggattgcttatcttgtaggtgcttatcacgtggacgagctgacctatatgactcattacctttgttcttatggaaatcatctagttattgaagaaccgcaagcactgattgacagctatctcaaacagctttcggaaatgaaggcggtttaccaagaataagtccgtcacaaggggaaggacaggtttcttaaatgttttttttctgatataatagaaaaaagtcccttccatggataaattaatgtttaacagatattcgttaatttttaaaatgtaacgaatgatcctcaacaaatgaaagaaaaaaatgaaatttacagactttaattttaaagattatatcaaccaaactttagagaatatcaaatttgaaaaacctactgaagtacaacaaaaattgattcctattgtcctttctggacgtgatttggtaggggaatctaaaacaggttctggtaaaacgcatacctttttattgccaattttccagaatattaatcctgaacttgatgaagtgcaagcagtcatcacggcaccttctcgcgaattagcgacacaaatctacaaagctgctcaagaatttgtgaaagtaaatggcaaaattcgcgtttcaaactttgtcggtggaacagataaagcccgccaaattaaaaaattagaagcagcacagccacatatcgttattgggacaccaggtcggatccatgatttagttaagtctaatgccttggttgttcatacagcaaggacatttgttgtcgatgaggcggatatgacacttgacatgggctttttggcagatgttgaccaaattgcttcaagctttggtaaacgtgtgcaaatgctagtcttttcagcaacaattcctcaaaaactgcaacctttcttgaaaaaatatttgcataatccagtcatggaaaaaattgcaaataaaacagtcatttcagataccattgaaaactggttagtttcaacaaaaggaagttcacataatcaacttttacttcaattgactaaagcactcaatccttatatggcaatgatttttgctaatacaaaaggacgtgttgatgatattcatcatttcttgacaagtaatggtcttaaagtggcaaaaattcatggtgacgtgccaccacgtgagcgtaaacgtatcatgaattcaattaaaaatcttgattatcaatatgttgttgcgactgatattgcagcgcgtggaattgatatcgaaggagtttcacatattatcaatgatgaaattccaaaagacttgactttctttgttcaccgtgttggacgttctggacgtaatggattacgtggtacagcgattacactttacagcccttctgatgattcaagcattcgtgaaatcgaaaaaatgggtgtaacttttcaacctaaggctgtcaaagatggcgaaattgtagattcttatgatcgtgaccgtcgtgaaaaacggacgaaaaaacaagatgaaatttcacttgctactcgtggagccttggctaaaggaaagaaaaaagtcaaaccaggctataaacgtgctattaaatggcaaattgaagaagaaaacaaaaagaatcgtcgtgcagagcgcaataaaaatgcccgtaaaacacgtgattctcgtaagcaaagtttctaattgatgaaaaaatttatcaaattttaagcttttttcttggagcaattctattgattttgcttgtttgtttaggattgatttttagtaagtctaatgacagaacagcggataaagccagagatattgatacgattttagtattaggttcacggataaatgctgacgagcaaccggcaaaaataactcaagaacgtcttgacgcagcactcttacttgccgctaagaatccacaagcaaaaatcattgtttcgggagctaaaggagctgacgaacctgtcagcgaagcttttagtatgaaaaaatatttgatggcacacgcgattagtgctgacaggattatcagtgaaaataaagcgacagataccgcagagaatttgagctattccaaaaaatattttcatgggaaaacagtggtggtgaccaatgattttcatctctatcgtgctttgtatttagcaagccgtcaagggctaaaagtagagggatatgctgcgaaaactgaggtgacaaatccgctttattatccgaattattatggtcatgaagtacttggtttaatttatgcttttgtctttggaacgggataaaaataactctgtcagtagatttatgttttagttagatactttatcagcgaatatgataattagcaatgagactgataattctatcctaattaattctaaacatggagaataataaatgatttttctaccagaacaaattagtaaacttaatgagcttgaaaccttagtttttgatttcatcataaaatcacccgaagaagttcaacaaatgaccattcgggatttggcaagtcaggttcacgtgtcaacgtcaacaattgttcgtttatgtacaaaacttggttttgaaggttgggctgacctaaaattttatcttaaaaatcaattgaaagaaaaaacaccagaagaacagcactatgataatatgcttgaatttaatatgtttttaagtcgaatgaatacagataattaccaagccaaacttaataatgctgctcaaatgattgctaaagctgattatactgtttttttgggactaggaacttctgggtcattaagtgagtatgcaacgaagtattttgtaaatacaggcctgcgaagttttgtcatctctgacccctttcaagctgttcaagttcaagggatggggaatgttgttgcggtgattatgtccgtatccggagaaactgaacaagttgtcaataaagaattagaatttaaatctggtggtgcaaaaattatttcaattacgaataatgaagattgtacggtagctagactcgctgatcatcaactctcttataatcttgttaatgaatggtctaagcaatatcctttaggaaatttgactactcaacttccagtactcgctattttagaaattttagctcacaagtcaattgattatcttgttaaaaaatgataaatttgttccaaatgaagaaacaaatatttcaaaatcctactatttgatagtaggatttttaatatattagtccaaaagctcaaaaaggctgatttaaagcagatgagtagacttttcaattattttgtaaagcactttcaaaaaaatagataacgcttgcattatgaaaatgaaaacgttgtaattatttttataaagaacgttaaattataaaacgttaagaataaggagaaataattatggcagataaagttattgcacttgcatgtgcagccggtatgtcaacatcacttttagtatcaaaaatgcaaaaagcagcagcagaaaacggaaaagattacgaaattttcgcaaaatcaacagcagacatttataatatgcttgcaggaacaggttcaccaaaaccagacgttttacttttaggcccacaagttgccttcatgaaaggtgaagttgctaaaaaggcagaaattgctggcgttccaatggacgtgattaaaatgcaagattacggaatgatgcgtggggataaagttctcgcagctgctgaaaatttgatgaattaagctttggtttattaaacctgtgggagggcgaaagctcttttactatgtaaaaataagtataaacagaaacggaatataagaaatgactgataagtacgagaatccaacaagtgatgactacatgggtgtggtaatgggcattatcatgagtggaggaaacgccaaaggtttagccttccaagccattcaacaagctaaagatggaaaatttgcagaagcagaaagctcattaaatgaagcgagtgaacaacttcgtgaagcccatgatgttcaaacagatctcttaacacgtttggcacaaggagaaaaaatcggctggaatctttacatggttcacgctcaagaccatttgatgaatgctattacctttaaagaacttgcagtagaagttgttggtcaagaacgacgccttcaagcacttgaaaacaaataatacagctcctagcttattagaaaagcaagattaaaagttgcggagacgcaacttttttctaacaaaaatcgttgagtaagaaaggagtagaaaatgagtttttttggaaatgttgactttcaaaaattaacctatacagaaaggacttgctacagttatcttcgcgataatgttgataaaatcccttatttacgcgtccgtgacattgctttagagtcccatgttggaacttcaagcgtcatgcgtttaatacataaaatgggttatgattcatacacggattttaaagaatatattattgataaaaaagagctggaaaaaggaatttctaacactgctattcctttctcattagatattttttcaggagacgttgaacagcgtttagataatttagcgcaacgtgtgattgaaagtgataatatcatttttaccggagttggctcaagtggtttaatctgtgattatgcagctagaagattagctggtgtgggcattaatactttttcatttagcgatgtaacttatccgattgcttcaaagttgcaaaatacaaccaatactttagtaattgctttatccatttcaggtgaaactaatgaaatcattgaagtattgacgagtcttcggtcaaataaagatgtttatatttcgagtatcacgcccaaaattaattcgagtatcgccgaactgagtgattttgtcctgacctatcgaatcaatgaacaccgaattaacacgcattatgacttaacgagtcaattacctacggtctatttgacagaacgtttaacagatctcgtttatcaacgttcccattaaaaaagccaatctggcttttttctatgctcagtcgttcctaatggtttgatatctaaaagtaaaaaagttaaattgagataacaaatataattatcaaggctgaacctcgcaagcttaaaggaaacttatatgacaattttggtacaggagtcttcaaaagtgacacagaaccaaagtgatggaaaaataagaaaccgctttctttgctttgcctattaatgctataatgaaaatgtagaaaagatgaacgtgaaaccagttcatcaaaaaaagtaaaggagactgttcaaccatgaacaattttattcaaaacaaaatcatgcctccaatgatgaaatttttgaatacccgtgcagtcacggcaatcaaaaatggtatgatttatcctatcccatttatcattattggttcagtattcttgattcttggtcaactgccattccaggcaggacaagacttcatgaacaaaatcaaattgggcccactctttttacaaattaataatgcttcatttggtattatggctttgattgccgtgttcggtattgcttacgcttgggttcgagatgcaggttatgaaggagtacccgctggtttaacaggtgtcattgttcacatcttgttgcaaccagacacaatccatcaagtaacaagtgttactgacccaactaaaacatcaacagcatttcaagtaggtggtgtcattgaccgagcttggttaggtggtaaagggatggttctctcaatcatcgttggactcttagtaggttggatttacactggctttatgcgtcggaacatcacaatcaaaatgccagaacaagttccagaaaatgttgccgcatcatttacttcacttgtacctgcaggagcaatcattacaatggctggtgtggttcatggaatcacaacgattggcttcaatacaactttcattgagttagtttataaatggattcaaacaccattgcaacacgtaactgacggtccggttggggtcttcgttattgcctttatgccagtatttatctggtggttcggtgttcacggagcgacaatcattggtgggattatgggaccattgcttcaagcaaactctgctgacaatgctgctctctacaaagcaggacatcttatcctgtcaaatggcgcccatatcgttactcaatcatttatggaccaatacttgacagttactggttctggtttgaccattggtttagttatcttcctcttagtgagtgcaaaatcagttcaaggtaaaactttaggacgaatggaaattggacctgcagtattcaatatcaacgaacctattctgttcggacttcctatcgttttgaatccaatccttgctattccatttatcttggctccgttgatttcaggaattttgacttacttagtgatttatctaggaatcattccaccatttaatggtgcctatgttccttggacaacccctgcggtcttgtcaggatatctagtaggtggctggcaaggtatggtttggcaaattattattcttgctttgaccacagttctctattggccatttgccaaagcttatgacaatattcttctgaaagaagaagctgaaacagaagctggaattaatgctgcagaataattgcaaaatttagatgagctcaagacttcttgagcttatcttgttaagaaatgataatttaataattctaataattacaaggagaaattatgactttaaaaaaagacttcctctggggaggagcagttgctgcacatcaacttgaaggaggctggaatgctggtggaaagggagtttccgtagcagatgtgatgacagcaggtagtaatggcgtagaaagaaaaatcacaaatggagtaattgagggagaaaattaccctaatcatgaagctattgatttctatcaccactataaagaagatgtagcgctttttgcagaactcggtttaaattgttttagaacatctattgcttggacacgcatttttcctaagggagatgagtctgaacctaacgaagagggcttgcaattctatgatgacttatttgatgaatgtttaaaaaatggtattgaacctgtcattactctttctcactttgaacttccttatcatttagtgacagagtatggtggattccgaaaccgaaaactcattgatttctttttccatttttcagaagtagtgatgaatcgttataaagataaagttaagtattggatgactttcaatgaaattaataaccaagcaaactttatgcgcgactttgctccttttaccaattctggtttgaaatttccagagggagcaagcgaaaaagagcgtgaagaaatcatgtatcaagcggctcattatgaacttgttgcctcggccaaagttgtagagttgggacataaaattaatcctgatttccaaattggttgtatgattgccatgtgtccgatttatcctgcaacttgtaaaccggaagacatgatggcttcaaccgttgctatgcaacgtcgttattggtttgcagatgtccacgttcgcggacattatccaagctatttaaaggcttattttgaacgcaaagaatttaaacttgatattagtgatgaagacttagaagttttgaaaaatgaaaaagttgattatattggtttttcttactatatgagttttgcaattaaggaccatggaaaagcgccaacttttgattataacgaagataaagatttagttaaaaataactatgttaaggcttctgaatgggggtggcaaattgacccattaggtttacgttatgcgatgaattggttctatgaacgttatgaaaaaccccttttcattgttgaaaatggctttggtgctgtagatgaagttgaagctgatggaagtattcacgacccatatcgaattgaatatttaaaagctcatatagaatcaatgaaagaagctgttgaatatgatggggttgacttaatgggatatactccttggggctttattgacctcgtttctgctggaaccggtgagatgaaaaaacgctatggtgtcatctatgtggacaaagataatgaaggaaatggaacattaaaacgctctaaaaaagattcatttgattggtatcagaaagttattgcaaccaatggtgaagaactttaaaattgaaagacacgaaagtgtctttttatttttactataatgtaaaaaaaacacttcaaaataggaaaaggtagtataaagggtacatctgtgtattttatcaatattttaaggagacaagaagttttgtaagataaaaatttcggattattagatacttgattgtaaaaaacgttttcaatatgcaaaaaagagtgattaaaattctaaaaggcttttgacaaattcgtgcattttgctaaaatatctttactgagtagttcatgtgtaacagaaaggggtttcatgcaagcaaaaatataggggacagcttgtagaagtctggaaaatttcgcatcaaccaattcgtgaaatatgggttagacatgcctttgaacaggcacgactgtcttggaatgaatagaataaaaatgtcttaaattttgagtcaatatcaggtgatttggctttagttggcgattttttaattcaaaaagatggaaaaaggttttatgttgtcagcagggacaacgtttatcgcgatttagtatttatagacgaagaaacaaattttgaaattgaaaattagattctcatcaatactgaggaatatcaactcgtcgcactaaagaattaataaaacttttggaatgtattacaagaagtgttgttttaaatgattgaaaaggggcgttgtagttcatgcttgccataaatttatttttccgctataatagttaatgttgtggcggcgtagtgaagtggtaacacatggctctgcaaaagcttaatcgtcggttcaaatccgaccgtcgccttactaaaaaaataaaaacttgcttaaaagagcgagtttttatttttttattgaatcaatttattaaagaaaacttagaggatttgatgtgttttggtaatcatactaacccgtcttttgtgttaaaataggagctatgaatatcgagtcaaaaattaaagagtttacggatcagcttaatcaatttgcctatgaatactatactttagatgagccgtctgtagaggatagtgagtacgaccgcctatatcatgaattagtgaaattggagcaagaaaatcctcagttagtgagagcagattctcccactcatcggactggtggcgtcattttagatggctttgtgaaatttcgacatccttataatctttatagtttaggggacgttttttcgcgggaagaattatccctttgggaagagcgtgtccgcaaagagattgttaatccagaatacatttgtgaattaaaaatcgatggtctttcgctatctctttactatgagaatggcttactcgtgactgcagcaacccgtggtgatggaacaactggtgaaaatatcacagaaaatgtaaaacggattaaagacgttcccttaaaattaaaagaagccattgatattgtggtgcggggagaggcttatttaccgcgtcaaaattttgctaaattaaatgctgagcgtgaacttgcaggagcagctccttttgccaatcctagaaatgcagcagcagggactttacgtcagctagatacaaaaatcgtagctaaacgtggtttggcaactttcctttatcaagaagcaagtccggcaaccaatgatacgcaagaagaagtattagaatatttcgaagaacttggatttcaagtcaatcctgagcgtaaatttgctcgaaatttggatgaaatatgggaatttattgaagaagcaactcgcttgcgtgacgaattgccttacgatattgatggtgtggttatcaaagtcaataatcttgctgagcaagaggaattaggttttacggttaaagcccctcgatgggctatcgcatataaatttccagctgaacaggcggaaacggaaattttatctgttgattggacggtcggccgtacaggcgttgtcacaccaacagcaaatatgacacctgttcttttggcacaaacaacggttgcaagggcaactttgcataatgtggattatatccaagaaaaagatatccgtaatcatgataaagtaatgatttacaaggcgggagatattattcctaaagttggtaaggtccttctggagaagcgaaaaccagctaaacatcttcgtaaaactcatcgagctaacaaatatgtttggacaagatttggtagacgaagtgtagagaaaggattagttttctcaaagcgagaagataatcgtgtaaaaattccaactcaatgtccggaatgtgattcagatttgatccattttgaggatgaggtggcattacgttgtgttaatcctttgtgtcctgctcaaatccgagagaagttaattcattttgctagtcgtgatgcgatgaatattgttggcttggggccatcagtaatttcacaactttttgataaaaaattagtcactgatgttgctgatttatatcaattgaccgttgaagatttactgaccctcgataaagtcaaagaaactttggctcaaaaaattgtatctgcaattgcgcaaagccgtgaaaattcagcggaaaaattactttttggtttaggaattcgccacgtaggtggtaaagctgctaaattattattagaacgttttgctaatcttagagctctttctcaagcaagtgaagaagaaatttcggaaattccgtcacttggtggggtaattgctacagctgtggtttcatattttgaaacagctggagccaaaactttactggatgaactagagaatgctggtttgaattttgcatatttaggcgcagttaatgttgaaggaatattatcggggaagacggttgttttgactggtaaattaacgaccttgaaacgaaaagaggctaaagaaaaattggaagctttaggagcaaatgtttcgggctctgtttctaagaagactgatttagtggttgctggtgaagaagctggaagtaaattgacaaaagctcaggatttaggaatcgaaatctggtcagaacaagatttacttgatttataaaataatttatcttggagtttagagcagactttatataaaaaagagatttactgacagaattgtaaaagcctaagggctactctctgacaaagccgtcagtaaataatttaaaaagaatggatgagaagttttcgggggaaatgatgaaggcgagattgatttacaatccgacatcgggtcaagaaattataaaaaaacatattgctgatattttggataaattagagcaatatgggtatgaagcaagtgcttatcaaacgacagcagaacaagattcggctaagaaagaagcagcacgagcaacgcaagctggatttgatttaatcattgcagcaggtggagatggcacaatcaatgaagttgtggccggaatttctccctttgagaaacgaccacgattgaccattgtcccaacgggaacaactaatgattttgcaagagcactgaagattccacgaggaaaaccactggaagcaatcgaaatcattggtaaaaatcaaattttaaatattgacgttggtcatgccattattaaagagaccaaagatgagcaatattttattaatattgctgccggtggaggattgacagaacttacttacagagttcctagccatttaaaaacagcatttggttatttggcttatttagctaaaggtgcagaacttttacctcgtgtccgcaaagcaccagttcgtgttgttcatgatgagggtgtctttgaaggtgatatttcaatgttttttgcggcactgactaattcagttggtggttttgaaaagattgcgcctgatgcaaagttagatgatggactgttcacacttattttagtaaaaactgataatttatttgaattgattgctttacttgcaattgtagccaatggaaaacatttggatgatgttaatttggagtatataaaaacaagtaaaattgagatagaagctttaggtggacaatcaatccttcttaatttggatggtgaatatggcggagatgctcctgttcaatttgataatttaaaagggcatttggatatgtatgtcaatcttgatgaaatcaatgatgaccattatattggcgatgaagaaactttagctttggaagcagttgctcaaaaatttgctgaagaagcaaataagattaaagatgaagatgaaacagattaataaatgataaaagttgctgacagagttgtcagtgactttttttgatgctgtcagcaaaaagaaaagataattttaaatttatgaataagagtgtggtttaattgctagcctgtcagtaatttgtgcaaactgcccaaaagatttaggcacttatcttattgtttttagaaaacgtttacagtagaatataaacaaagaacaaaagttactagaggagaaataatgacaacacttgttttagacaaaatttacaaaaaatatcccaatgccactcaatattccgttgaagatttcaacattgatatcaaagacaaagaatttatcgtattcgttggaccttcaggttgtgggaaatcgacaactttacggatggttgctggacttgaagatattaccgaaggtgaatttaaaattgatggtaaggtcatgaatgacgtcgctccaaaagaccgtgatatcgctatggttttccaaaactatgcgctttatccacacatgactgtttttgacaacatggcctttggtttgaaacttcgtaaattcaaaaaagatgaaatcaaacgtcgtgttgatgaagcaggagctattcttggattgactgacttgcttgatcgtaaacccgctgatttatcaggtggtcaacgtcaacgtgtagcaatgggacatgcgattgtccgtgatgctaaggtctttcttatggatgaacctttgtcaaacttggatgctaaactccgtgtttctatgcggacagaaattgcgaaaattcaccgtcgtattggtgcaacaaccatttacgttacccatgaccaaactgaagcaatgacacttgctgaccgtattgttatcatgtcttcatcaccaaactcagataagactgggacagtggggcgtgtggaacaaatcggaacgcctcaagaactttacaatgaaccagcaaataaatttgttgctgggtttatcggaagtctagctatgaatttctttaatgtcaaagttaccggtggaaaattgacaaataatgaaggattaaatatggaccttcctgaaggaaaagcaaaattgcttaaagaacaaggttacgaaggaaaagaagtgattcttggaatccgtccagaagatattcaagcaagcaatttggcacaacaagcttatccaaatcaaaccattgaggcagaagttgtcgtttctgaactcctaggtgctgaaacaatgctttatcttaaagctgattcaactgaatttgtttctcgtgttgaagcgcgtgatttccgtaatccaggagaaaaaattacagttgctttgaacttgaataaatcacatttctttgacgctcaaactgaacaccggatcgttgattaaattttaagccctctaaatccataagattctgtcattaattgatggaatctttttttctatgtaaataataaggttactgacagagcggataaccaaggctttaacaaagataatgtcaaagataattgacactaagcaggttcaactttttaattttaaaatgctaaaatgaacatagtcaaaataatattattaggaaagctctcgtctttttcgatttagtaataaatcacataaagaacaccgacaccgctctttatgccgtaaaaatatcgaataaatgctctcctgagaaggtttgaaaaaatgaaaaaaacaatggacggaaacatggcggcggctcatattgcttacgctttttcagaaattgccgtaatttatccaattactccaagttctccgatggcagattatactgacgcttggtcagttgctggacgtaaaaacatctggggacaaagagtaaagattaccgaactacaatcagaagccggtgcagcaggtgccatgcacggtgttcttaaagcaggagggcttgcgacaacttatacagcttcgcaagggctccttttgttgctcccaaatatgtacaaaatggctggagaacttttaccagcagttattcatgtagcagctcgtgccgtagcggctggggcgctcaatatttttggcgaccagtccgatgtcatgtcggccagaacaactggttttgccatgcttgcagagtcatctgtacaagaagtcatggatttgtcagcagttgcacacttagcaacactagaaggctcagtcccattcttaaacttctttgatggctttagaacttctcatgaaattcaaaaaatagatgtcatcaattatcaagatttactaccaatggtcaaccaagaaaaattggccgattttcgtgcacgtgcaatgaatcctgaccatccaacggtttcaggaatcaatcaaaatgcagatatttatttccaacaaagagaaacagtcaatgcatattacgaagcccttcctgaaattgtccaaaaatatatgggcaagattaatgaacttcgtggaacagactatgacttggtcaattattatggtgcacctgatgcgacagaagtcattgtttctatgggttcagtcgcaggaacaattgagcaaacagtggactatttgaatgctcaaggtcgcaaagttggatttttgaatattcatctatatcgtccatttccaatggaaaatttccttgaaaaattgccaaaaacagtgacatcagtggccgttttggaccggacaaaagaagcaggatcaaatggcgaaccgctgtttcttgatgttcaatccgcactttttaatagtaatgtcaaagaagtgattggtggccgttacggaattggtgggaaagatactcgaccagagcacattgtcagcatctttgatgagttgcttaaggaaaatctaaaacgtattttcaccattggaattactgatgatgtcacaaatttatctcttgaaaacctgtcagtacttgatttgacaccatcagatacttttcaagcaaaattctggggctttggctctgacggaacggttggagcaaataaggcagcaatcaaaattattggagaccatactgacaagtacgttcaggctgcttttgagtatgactctaaaaaatctggtggtctgaccatttcgcatttgcgctttggcgattcaccaattaattccgaatatatgactgccactcttgattttgtggcctgccataatatgacctacgttcgtaagtacaacctaactaagggattaaaagcaggcggagttttccttttaaatacaagttgggatttggagcatttatcaaaaaatcttccaaatgagatgaaacggtatattgctgaaaataatattcgtttttataccattgatgccatgaaaattgctcatgaaacaggaatggaacgcagaattaatacaattatgcaagtggcttttttcaaattagctcatgtcatgccttttgatgaagcttatgaaatcttgaaaaaagatgcacaaaagtatgctaaaaaatcaccaactattgttgaacaaaatttgaaggccatggcccttgctttaaatgggttgcacgaagtgattgttccagaaggctgggctgaaactacagaaaatgttatagaagcagttacgaaagaaacggctcgtaaaaaatatgtttttgagattgtaaataaaaccaatgcctttgagggggatgagctttcagttcaaactttagtagataatggcatgacttttggtgacgaacctttggggaccacggcttctgaaaaaagagggattgctttggaaatcccagaatggaatgctcaagcatgtattcaatgtaatgaatgctcgttcgtttgtccgcacgccgctattcgtccatttttggttgatgaagacgaatggaaccaagcacctgaaggttttcatgttatggattacaaaggatctgatggtttaaaatatcgtattcaggtttcagttgaagactgtacaggatgtggtttgtgtgttgaagcttgtcctaaaaaaggtgaagcattgaaaatgattccttacgaaggtcaagaaaaagaatcagtcaattgggcttttgcacaaacgcttaaaacaaaagaaaatccagctcgcccagggacaattgttgccagtcagtttgaaaaaccactctttgaattttcgggagcttgctctggctgtggtgaaacaccatatatcaaattattgacccaaatgtttggcgaccggatgatgatttctaatgcgaccggctgttcagctatttatggtggaacacaagcgaccccttatacaacaaatgagcaggaacaaggaccagcttggtcaaattcactttttgaagataatgctgaatatggctatggaatgtggttggcatcgcaaacgcgtcgccaaaagctagcatcagaggttcttgaagcacttccagaaatgtcggctgagttacaaaatctggccaaagattggctggaacatttagaggattcagaaggaacacgagcacgtgctgaaaaaatgaaaggcatgcttgcttctgagcacttcaattctcctaaattagacgcgatttacaaacaaaaagaccaattcgtcaaacctactcaatggatttttggaggagatggttgggcctatgatattggttttggtggattagaccacatcgttgcctcaggtgctgatgtaaatatcttggtgatggataatgaagtttatgctaacacaggaggacaagtttctaaagccactccggcctcagccattgctcaatttgctgctggcggaaaatctagtaccaaaaaagatttgggcgcaatgttgatgacttacggagaagtttatgtcgctcaaattgcctcaggtgccaatatgatgcaaacaattcgagcttttgatgaggctgaaaaatttaagggtccttcagttattattgcgtatacaccatgtatttcacatggcctttatggaggaatacatttagcgctcgatgaagcgaaagaagcagttaattctggttattggcaactttatcgctacaatcctcttcttgaagatttgggggaaaatccgatgattcttgatttcaaaaaacctgattttggtaaagttagagactttttacttactcaatcgcgatttggaaatttattgaaagtagacgcagagcatgctgagaatctctatgataaagcagccaaagattcacgaaaaagatttatgcgttatgctcgattatctggcgatttggataaattcttagaacgtgaagccaaagccttggctaagaaaaatgctgacttagggataagtacagagacaaatcttaaaaaagaaagaaagacacgcccagttgaccctgaacgtgaagctagacgagcagctcgaaaagcagaacgggcggctaaaaaataatttaatggaaaattactgacgaaatgattgtgtcagtaattttttatatcgtcagccaaaaatctataaatatactagtatatttaaaaaaggagaaataatggatcgtaacttatggactatttcaaaagaaagtaaagagattataaaaaagattaaatctctccctgtagcacctgtacttacctttaataacttcaaaggcggagtgggtaaatcaacgttaattgcactttttgcttttataatggtaaaattcaagattaaagtattgctgattgatagcgacccccaaagaactttaaccaaaaaattaatgaagaactttaccgtcaaaaatgaagcttctcaaacatttatggaaggcatcaaaaataattctttaaaaaattgtattactcaattggacgattacttatatatcgtgcaaggagattgggaactagcaaaacttgatagatacgctcgtacaaatctaaaacaaagcaacgagtactttctttattcctatctaattaatgatttgaaaaaagactatgattttataatttttgatagtgtacctaccacttctctttacacacataactgtatagttgcaagtgattatgttattgcaccaactcaagctgaggaagaaagctacgagaatacaatatcttatctcaattatttgaatgacatgcgacaatacaatgagaagttagagatactaggagttgttccatatttaactaaagatgataattcaacaaacaggtcatttttaaaaaaatactatgaaacttttggtgaccttacttttcaaaatataataaaatatagtgctagagttctaacttggggtacgaaaggtatcacagaaaatcaaggatatgacaaacaaaccttggctatgtatctttcagtttttgaagagtttcttgaaagaattaacaagtaaagtaaagtaaagtaaaataatatattaatatacaagtagattattaaattaatttacttatatgagctttaaaatatgtgaggaaaatataatgggattagatgattttttagaaaaaacaggaaaaaaagaaacaccttttgaagtgaaagaaaaaatttcacaaccaacaaaattaattaaagttgacgaagatattcataaagacttaaaaatatattctgcaaggacaggaaaaaatataaaagaaacggctgagcaagcaataagagaatttttggaaagaaatagttaaactagttaataaataaactagtatatttgaatactagtttatttattaactattaaaccttattcactatttgctaaattgcttacattatgctagaatctagttaaatattaaacgaaaaaatttacagagtgaacaaaaaaatctcaccctaatgagtgagataaatttaacagtagttgtaacgaaactacttagcctatcaaagttttatcttggcggactaaactttgacacacatttcattcttaattatactaacaattataccgtattgctcctaaaaaagcaaccacaataattaaagtaaaattaagcttgaaaaggaaaaagactaagtaggtataggctgcttagtctttttttgttgctctaataaacaaggagtacgaagttatgagccaaccgcaattttacaaagccaaagaagtttatggcgaaacatactatcaacttccaaaggttttatttagtaatattaaatataaaaaattaagcaacgatgcaaaagttgcctatgcgttattaaaagaccgttttaattattccgtacaaaataactgggttgatgaagatgataatttatactttattttcacaaatgaggaactaatggaaatgctcgatagtgggaatcaaaaagtaattaaaatcaaaaaagaacttcaaacatcagaattattatttcaaaaaaggatgggagtcaacaaaccaaaccgtttatatttgttgcgtccagttgttgaagcaactgatgtttatgtgcaaagtacccctcaaacccttgatacgagcggaagtgtgaaaatcacacttccagaacaaccccctcaaacccttgatacgagcggaagtgtgaaaatcacacttccagaaaatgaacctcaaacccttgctacgagcggaagtgtgaaaatcacacacaatctatataaagaatatttagatacctctttagataatattaaagatactcaaaaactagatttttcttcttccaatttttcggcagctcagcttaaagcacaaaatcaagatttagtgaaaaactcaaaatctttcctcaaagatgggacacatgaactgtttcttagtgaagaagccattaacttacttcaaatgtggtgtaactcgcctcaacaatttagaaagatggttggtattattcttaatgctaaaaatgctgtatgcaaagagaatgaggaacttggagtattttttgtcctcgaagaagaagcattacaagaaaaaattcttaacactctaagacgctactttaatgccattagagctaaagaaaataaaataactaattacgaaaactatttatttgggtcaatgaaaaatatgtttgctgaatactggaataataaagctctcaaacaaagtttaaactcaaacgaaacaaataaagagaacctaaatatggatgattctgtttggttaaattctaattatgagaatgaaaccagccaagatgatttagctcgtcttgaaagagttaaacttgaagctctagcgaaaatcaattctaaagcaacatgaatcagggtactattttaataaaaaaaagtgaaaatcaataatgtttttcactttttttttatactttttcaattggagtaaaggcttcaataacttttccaatgattcgagtattctcatctcttggaagaagaatatcaggaaatagtcgatttccttcaaaatctatatcatcattcaaagagacaagtctaatataatcatcttccacataaacagatttaatatatgctaagcctctttctacatcatctacggcataaatatcgccattaatatcaacacaactctgatatctaattaaagcgatttgaccataatgataatcgggctccattgagtttcctctaattactatggctctatcatgtttaatatctttatcccagtaaacaacttctttacccacttcatctgtgtaggcttctcctcgtcctgctgatagagcttgttcttcttcaacttcataaggtatcaaagaattataaaggtgaactattttgtcttcttcagtctgttcgatgagttgtttttttgcgaattgaattgttttctgttgccgaggtacttttaacttttccatgatctcgtcaatttcagagccacttttaatatttgtttcacctaagagatagccgactgaaacattaaagacatttgctaggttttcaatgctctcttttttcggttgcctttctcccttctcccaccgttgatatacttggtatgcaacatttaattttaatgctatttgtttttgtgtcaagttcttttctgttcttaattctttgagcctttcagataagttcataaaaaaatccttttctaattgacgaatacaccaaaatggtgtattatatatttatagggaaatgagaagactactcattgtataaaaaatattttaataagtcataataaaccttgctctaacaagatttatggcacttttaaaaagcgagtttcaacttttatgaaactcacaaaaaaactcttgtctcttgtttaaacaagaaatcaagagtcactgggtgaaaaaatagattgttattaaattatgcaaaacgtaaataacaagctattctacttacaatgcaaccttcattataacattttctaacgataacgatatcactatttgatatcaaatagtgatatacattgcctatcttgttcaattgggaacacgagttaaacaattcgatttttaaaaatagaggttcgagtcctcaagttgggtattgctagacttgtttctagcacattagcaattgctaaaggcagtaccgattatgttggttaataataggctacgacatcccagtggtcgtctattgcaggttcaattcctgtcggtgctataaaaaactaaattttatcctaatgttatttttgaaaaagaaatgacattaatatcagactgggagatatgggatgtattttgacaaagttatttttgtcgaacgtatataactctattctctcatatttggaatagagttttttcattgattgacgacaaaaaaaggtaaggagaacaaaatgggtattaatagtgtttgtgaggaatgcgggaagatgcaccatttgcctgactatcatgttagctgtcaattttatcaaaaatcagtagtgataaataggcgaaatgtcacaagaggaaaagtaagtatttgtgacaagtgtctaaaatgcttaacgagggtaagggatggaatttagaaaagagattaaaagagttataataatttcttttggaattgctttattttcagtcattatcaaatacggcttaccaattatcatgaaataaatttgaagagaagaagctaaaggagtaaggaatggatattttttcaaaaggggcaatgatacagcctagacaattaagacgactcaatggtaaaacggtcgttttccaaagtggagaacaaggacgaattgcttaccctttagtcattatcaaacgaggaaaagaattttgtcatgtgagcttgaccaaccgtcgtgttttcaaagaaattacacaaattcgattaggtaaaaccattattgcagaaagaatcacgcctaattcgccactctatgcgacaggaaaaggcgtaaaacaagtcaaatctaaatactcttactggcacgagggaaactaatgcgttttaaatttaaaaggaaataagctcattgggagcgctagagaaattctactaaggttcgaatcctttatttccaatcttcccgctttgtggaacattagaactttaagaatgttgcttcagattttttgattcatgagaaaggtgaagtaggttaagcacaagaaaccaaagcaaatggaagttgttctttgaaaacttaaatagtcggcattaactcggttaagatggtattaattgagcttggttaatgaccgcccccctcatcagcgtggctactaaagggggcaaaaggggagtgtgagttgattaggctttcttcttcccttttggatgaaatcacaccgtgtcccttgaggacacgtatacgtaatcagtccactaacagaaagacttgccaatgagaaaagtcaggacgcctagatgtgagagaacattgggagaaaacctactgcctgcgggtcagggtgaacattgccacagttgaggtcgctgaatgcgtaaaggagcctcagagttaggggttaactagaaaccctgcgtaaattttattaacgtcataacgacgaccaaaaagtgttataaaaaaatattgaaaaatgttatactaaatgtaatttaaaggaaatgtaagtgaaagaaaaggagaaaatatgttgttcttagctgtaatcggtctttttatcttaggaatcggagcttttctctctgttttcctcaatgtaatggtcagggtaatggctgtctttatgtttttaatggctgctttacttgttggactagctaaactttattatcaattaagagattttgtaattaaaacaaaaaaaatgggctggtaaaaaacctaataataaaaaggaatgggagaagttaatgattaaagcaattgatgtattaagagtcatggcagaacataaagagagtgaatttgaatttagaatttattctccaaatacagaacaagggtattctgatacagaattatcaaaactcccagcttatgtggaagctcatagcacctttgcaaaactgagagggaatgaaaaaatggccattcaagtgaccgagttttttgaatcagactttcaaaccattgctttattgacaatggacggacagttaatttgtgaaagaaaagcctacggtcagccaatggaagctatcaatcatgctctttttgaacaagggacttattcagaaatggttgaaaaacaattcatgggattgagaacaggtcgaactttacttgttcctgagatgaacgagtcaatggccggtggactaatgaaagagttcatggcttggagaaaagaagggaatcaataagacaatggataaaaactttatgaaaaattttgcggaacaaatcaataaaaaatttacgaaaaagcaaattgggaccagttcagttattctaggagtgctagtggttggcggtgtgactgcaggagtggtgacacataacaacaacgttcatgcccaacaagtagctcaaaaggcaaaggtcgaagcagacaaaaaagcaaagcaattagctgaagaaaaagaaatcgcacaggaaaaagaagtggctcaattacttgaaacagcttcaaagaatccaagtgatgcgacgattaaagcagcaaaagaagcaatttcaaagctgacagatgaaacagtcaaagcaaaagataccaatcagctcaaaaccattgaagggcgtctcgcactaattaaggctgcacaaactgcccttaaagattaccaagctcatgcgacagactcaaataaacaaaaagtagcgcaaaatgcaatcaatgccatcaaagataaaaatgatgaaaaagtgaaagcagacctacaaaaagcctttgacgcaagcaataaacaagcgcaagaagctgccaaagcagaacaagctaaagcaagccaacaagcaagtgctaaatcgaatcaatccgcttcttcaaatgattcgaaacaaagcaatagaacagctaacaataatacttcagacggtacaaataatcaagccagttcaaatggtgggtcttctaatggttatgctcaaaatagtcaaggaaatcaaagctaccaagggaatacaaatacaggtggaaatacacaaagcaatccgaacactggcgggaatagccaaggtggaggaaacagtaatgctaattcaggcggaagcacaaataataacaataataactcgactccaacacctactccgcaaccgaccattaaatacatgggttgggtatccgtagatggggtagtaaaatacagtcaaaactttaatagtgatgcagaagccactgcttatgcttctggagtatataacagtaaagctgttgaagaccttatgtttgcgggacactcaataagttggggagttcgcccagttcaaggttaaaaagcaagaataaaaagttcaaggataatttttttgaactttttttatttttcaaggagtagtcatgggacttcaaattgaatgacggttgaatgaaaaatttgaagggggttcaactccctctacttctatcagtcctctaagactttaaactggataataaaatactggctcaaggtcagtttttttgtttaagcttaaacaaaaaagaaagaaaggagttttacatgggtaaaacaaaaaagaccaaaagtttatttggtttgaaaaaggataagcggttgttcttatttggggcaactctgcttaccgtcgtaggacttggctttgtttctgttcacaatcgaaccgaagcggttgcgtcttctcctcaatccacttatcctgaccctccaaaggatacacatgtcaattacaaagataacgcctctttgctccacttgattttagaagatggaagcacagagtcgctgacttatctttatttagatgataatacgcctgtcttttgtgtggggctaggaatccccttggcttcagaatctgtaactgcacaagctgatgcgacaaatcaactgtttgcgaaattgagtagtgaacaaaaagccattgttaataatgtcgcctttcaagctcgacaaaaaggaaatatggaagggtatgcggagggacgccttgccatttactacctcctagaccaatatggtatcgcaaagcataagccagttgagttaaaggcggttgaaggctctgagcttcaagacatgcaaaaagtcaaagatggcgctaatgcaatgataaaagaagctcaaaaaatgcgtcagttaccaagtttttctgggaaaaccgttgaagtcgttcaaggggtcacaaaaacagtaaaagatactaataatgctctctcaagatttccctatttaagagttaatcaagacggactaacagcaacaatagatggctctaatttaaaccttaaagctggaattacaagcaaacttggagaaataaaaaatgcagtccaacttgtgaataagagcaatggactaaccgataacgaccttccatatttcatattttctacaggaggcgactctacaggaaatgaaagccaatcagttattgctactaaagacccttctagtgcattggcaggcttaaacgttaatattgttggtcttggagaaactactctcttaaaacaagacgcagacaataagaacacagacacccaaggggacgcatggcttacaggctctgtttggggcttgtataaagctggaacagatacgttggttaaatactcagatggacaaaacggctatcctgtaacccttacaaacggcgagaaagtggatgataaagaagtccaaatcaaattaaccgatgttactaaaggagtaggggttaaaaaccttatcaataatgccgactatgaatggggtgagcttcaagcgccagaaggttacgaattatcaaccaaacgttataaagtgcattttgatgcctcagataaatttaacgacaaaacaagcaattacattgataatgtgactgcgaccgaccgtgttcttcgtttcaactttggttacattaaagcccaagatgtcaatggttcattgactggtttaaatggacggacgttccgattaactccacaaggggaaacaaaaggcgacccagtagaagtgacttctactcaaagtgaagacgctagtggctttacaaacaacggtcaagtgaacttctcaaacattgtttttgggaactatctcctcgaagaactcccacaagacaatgacaagctccaactcatcaatccgattgcggtcacaaccacgacaagcaaagacaaagacggtaaaattacaggatataccgttgaattcaaagatacggtcactaaacaagtgattaccacgctgaatgttccaatgagtaagattacagataacaataccatgtttaaagtcaatctcggaactttagtggataaaccagtaactcctgttgttccaacgattaagacccaagcacactctaaagatggtgacaagattatccaaatcaatgaagtctctgaaaagactgaaatgtttgatattgccgactttaccaatgtggtcaaaggcgaccaaattctttcatatctccaccgtgtcgttactgacaagtttggaaaagtgacagaagacaaaatcgttcaaactttaaaacacgtgtctgatgatgaaacggtcaaaacccaacaacatcgttttgacaccacccaagatacaaccaaagattttgaccttccagaaggctctaaagtgacttatgtctttactgaaaaagattttgacggtgagtcaaatcctgaaactgacgaacctaaagccaaacatgatgacttgaaagaccaagaccaaacgttgacggttgaaaaagtgacgccttccattgatattgaaaaagccaatgcaaaagtgccagatgcaggaaatggaaatcataccgacaaagataacaatgtcggcgtgaatgaccatgatacagaaaacacttattttgaagttaaagcaggagacaagacagaaatcttcttccgtggcacaaataatggaacagagcctttaactcatattaaagttgtcgataaaacgaccaatggctcagtcaacatcaaaggaatgagttttacttttaacaagaaaaaactgaccgttaataaagacggagagtttgaacttgacggaaaactcttagtattgcaacctaaagaatcaatcattggatcaggaacacttgatgcgcttcctaatggcgaacttcatggcgataaagtcacgattgatgggattggagtttactctaagaaacatgtctctgacgatgataaatggtacggcaaagtagaaacacccatccaaaaagtcgcaaacatttatcttccaaaagcaggcgacgccaaatcaatgatgactgccctcggtgcatggttgattactattgcccttgttgggggcgttgtgcttaatgaacgcaagcgtcacaccttgaaaaaagggattaacgcttttaaacaagcgcttaaattgtagaaaagctaatctaacttagcttttttttgattaagaaaggttttttatggaaaatcacatcaatcgactccgccagctcattcgttctccaagtgagaacgtcctttttgccttatcctctctaatttttgtttccgtgctttttctagctatcgtgaccgttttttgttcaggaattgggagagataaaacagcccagttcccctcaaagcctgtcgtcattcatcaatccacgggcttatccagttcgtcaaaagtcgaatctgcatcatcgactgcgtcagctcaaccaagagaaagccaagagacaaaagcaacaacatcccaacaagtcgcttcaaaagtagaagctccaccaactccgcaaagcacagtttcgacacctgtccaaactgtcccttctccatcttcttcaacctgtccgccagctcaaagcaatgaagcacaagcactaagagaggcgcaactcaagcaggaggctgaaaatcaaaaagaggccgagcgattgaaagcagagtatgaggcaaaaggctatcaagtgaacattattgttcaagaaggagagtgaaaaatgattgatttagtttttgcaaaattaatattatctatttgcgggttattgggaacattattattgatgatattacttctagattttaatgatagggagagaatagaacattactatggtttgttgttaattggaatagtaggggtaatatttgtgattttaggactaattgttttgtggtaattggttcacaatttcaaatatttacaaacagagaaaaatcgatttcacacaaaaggagaaaaaaatggtttacacacaatcggagcgtaccgagcataaaaaaaacgcaaagaaaatcgcaagtctgttaggcgataacttttcagatattgaaaaagaagccttagaccttcagaccgaccactttaaaagttatgcgcaagaaggacaaaaacgcttagttgaagccttagaaaaaaacaactttagtttagcgcaacttgaaaatcaactaacaaataaacctgagccttcaacggttcatcaggttacaaaagaggagacacacacaaatgaaaattactgattctattgtattagctgatgcagccattaaccaagatacgattatcacaaccgttggaaatattttaagcattgtacaaatcgttgggattggggtcattgttttatctgcggttgctgctttggtcatctcagttgccgcaagtgagagaagtaaggacacttggtacggacgagctaaaatcgcctttgtaattgcggtactcgttgttaccattccgcaacttatcaaatggctcttaaatattttaggacaaggcgacaaatataaattgaacgccttgggagccttggcgaaagaaatggccatctctcctctagccactctcaaatcactgctataaaaggagaagccatgtttaatttaaaaataacttctgagaaagaaaccaccacctcacctgttgagaaatcagcggttcaaattagtgagttccaacaaaagttgaaagaggaaacagaagtcgtctttgccctttttgatgagcaggagactgtctggacagataaaatattgctctcgccttatgggccgagcagtttaaaagcatacattaaggagtccttagaaaaaaacggtgtcccagcccatgagattaccgcttttttgtcggagctttttgaggcttcaaagaaacaagaagcccctaaagaaactatctcagaaccaaaagaaacggttattcctgagggtacgaacacttggagtccacctaagtctgatgttgaagctgagaaaattgaaaaggaagtccatcatgtgactgcgcaggcaggacaaaaaacaattggggttattgcaagttggcaaatcgcactgatcgttacgctcttacctttaatttatcttagcgctttactcactttgtttgtgaccctccactatcaaaatgtttgggtcattggtttgactgtcattgtttcaggttttatcttagtttggtacttagccaaagtgataaaatcggcgcaaagaaaagtgctggagaaaaccattaccaaagaagtttttctttatgtgggacaagaacaactcaaacaacgtgaaaaggtagcgaaacaacttcaagtttatgatgacctttttggaaattctaacttgaaacgactggcaactgccgatggcgttcattctgccgagcaattgcttgaagaaatggcggtcgtacaagatgaatcaacgctataaacaatggaaaaagtggttagctgaaccaaagctcttggttggtttagccacttttgtttttattatgacctcggtcgcctttaatgtcttctatcatctcataagtttctttattgatgcgatgaaaggagcgactcccttaagttatagtcaaaacatcaaggtttttggttatcaagtgaaaactcattgggtgtcacttttctttccttattggacgaaacgctcctactggttgctgtatttactcgtgctaattcttgttggcgttctccttgcaattttaagttataaagctcgccgttcctacagagatttgaataaaggaacaaaggggacatccaaatggacaaccctcgaagaaattagaagacaatatccaaaagcttcaatttcgaaaaccgttgaatttgattcgccaccggggttaccgattgcggttgacccgaaccgtcaagaaatttattttgacccagccaataccaattctaaaacgatggggggaacacaaacagggaaaacacagtatattacttaccctaccattgaccttaatattcgctctaaacaacctgattccatggtcattaatgatattaagggcgacatcacaagacggacatgggaacatccgatggctcgtcggaagtttaatatgatgacctttaatttggtcaatcctaaaaactccttgcgttataatcccctccatgaagtcgcaaagtattggctcacagataatgaccgtgcgcaagaagccatcagaaccataagtgctgtcctgtatgatgaacctgaagccaaagaaccgatttggaatatgggggcaaaatcagtctttgaaacagccgtcgttttggtctgtgaaattgcaatgaaagagaataagcctgaatggataaatctcacttctgtcgcagatttcgttgatttaacgacacaaacaaaggacttaaataaaaaaggcgaatatctcctcgaccgctatgtagaacaactgccaagaacgcacgtggctcgaaaattctaccgtcaagccaaaaaaggaacagaacctcaaagaaaatcatttgcaatgatttttgacgggaaattgtctttcttgaccacttcgtccatgattcatttaacaagtggcaatgacattgattttagtgagttggtttatccaaccaatggcaagcccacgcttttatttgtggtctttccttatgcggatgaagccaatgcgattatgctcagtcttttttataatcagctctatcaaactattgcgagaacggcgacggaaaaaggaaaaaaatatgacttcaggcttcagtccatttttgaggaatttccaaatattcctccaatcacgaacctcaataagcacttgaatgttggtcttgaagctggagggatttttagactctattctcagtcttaccaacaagtctatgaaaattatggtgatacgctaggaaaagttattttacaagcagctggcaatagtatttttatccagtcggatgataaggaagacgccaaagattttgcggataacttaggggatacaacggtgattgtggaacaacgctccggttctccaatggacttaaataagagtttcacagaactcgaagacggacgagaactcattaacacttatgaattaaggaagttgttggagagtgaaattattcttgaccgaaccaagaaaagaaaagacttggaaggacgagatattcgtccccacccgattaaagcctataaaaaacaaataagaaaaggggatggggaaaaagagtttgacaaatttgaagattatacaaacatgcttggggcttgggaatatttatttgcggaggcgggaggcgactttgacgaccacggaaaagggctcaatgaatttgactttaaaattgagaaagattcaaatgagcctttaattactgaggaatcaattgccaaatatattaaagacccatccaagtctgaagaggaacaatctgaaccagaaaataatgcggatgaggtgtcccctcaagaagaagttgagaatcagtcgagcagttctgctcactttaatcaacccgttgaaccacaagatgagcgcagaacctctcctcgagttgaagaactctttcatcgagaaaaagtggaacgcctgattgcgcattactttggagaggtcattcagctcttttttaaagaagaagtgacttttgttttccaacttgaccacttaatcgaacaaaacaaagtaaaaatatcagaacaagagtttaaagagtttttaatgcttttagctcaatcaaaaaaataaaggaggaagcgtgaaaaataaaattaaagtgctgttggcaatactttcagtcgttttatttgtctcattttcaacttccagtccagtcaaagcctttgactatgatttaccaacggactccactttacctgcgtttaaagatgacaccgctaaagagggagaagatgataatgtcatttctaatggaacagccgctgaaaagtcgacaggagataccaagaaaaacttggagaagtgggggagcgatttagaagtcaatgacccccttaaaagtatttttagaggatttggctggtgggtcatcattcaaggcggagatattgtcaatgggattactggagcatcaaagaacacctttgacttattaaatatttacggcacagaagaaaatccaggcccgcttcaaaaaaccattgatgattacatgcccatctttgtggcggttggaacactcgtttttgtcctcatgaccttaggaattgtcttttctaaaaatcaggaagtggtcacacttttgaagtcgttacttttgtccacttcaattgtcgtcctacttcctttttgttttggtcaattttcaacgttgactagtcaaacagggaagttggtagcgacacaaagtaatacgggttatgcggtcattaataaaaatgttcgagacctgtatgccatagataagaattatgactgggtgctgcccacaaccgaaaccattgatgaaacgactaaaaaacaaaactttttaggtagtccctcaaaacaagaattacaacgaatggatattaatggggttgccgacccctctaaactcagtaaaacaggggcagatattactaagaatatgcttgtcgtcaatgaaaaagggaaagtagccgtcgtttctttgaatgacggagttggaaaaagttggtggcaatcgcttttgacgggcgatgccagttactaccgttaccatgttaatttctttaccattattttctacgagttgctcgttttaatcgtgtcagccttcttgctttataaactgattaagattgagtttgagattgtcacgaatgcagggattttacaagctaccgcaatgactgataccaaagggaagagaaactgggaactcatcacaaaaatctcatcaggctttagtgccatgattatggtgctgtttttacaagtgctattctcagatggttatgcggtcacttctacgttaaaaggcggcgtctttgttcagtttgttgctggaattgcccttgcttttgcggttattgaaggcccgaatgtctttcaatcgctctttggtgtttctgctggacttgacacagggctgaaagacttaatgactctctcacaaggctcaatgctcgccaagaacatgatttcaggagggaaagccctcggaggtggaattcttgcaggaggcgcttatggtgctggcggaatcgctggattggcaagtggggcttttagtcaaggcgaaaatacggataacctaggtggaaacggtaaagcgatgcattccgatgagactgactctgaaatgaacgaagaagatacacaaaatcaaaggtcagacattaacaatgatgaacagtttaaagataaccaatctgcgaacatgaatagtgatgagcaattaaataggaatcagtcagaagaagttaatactgacaccccagcagagggtactgaaacgaacgattcaactggctcattcgatgattctgaccctaatcttgcaagcatggcttctgaaatggaaaacgctggaagtcaaacagaatctgaacaaggggcttatcaagcctttaatgacactccaaacgaacacagtacaggattcgatggtagtgcttcacatgcggctcaaatggacgataaggccaatgaaagaatgagccaaggcgatggagagccaaaccctaaaaacgacacgacaagccaaaatatgggacagagtaagattcaggatactcctccaagctccgctgctcgtccaatgacttttggaacaaccgctaagaatatggcgcagggctatgtgaataacaaaattaactcccctcgaccgaacttaattcaacgctataacagtgcttatcagtcaagtaaagccttgagtcaaggggcggttaattccgtcactaatcgtatcaatagaaaaggagaaaaagatgcctgaccaaattcaagaacccacccgttataaagtcaaaaacggattagaaaatgacctttgggacgagtcacaattagccgtccttgtcttttctgccgtttttgcactgttaacttcgtttttcgtcattcctattgacctagtgagatacctgtggctggcttttattgtagggctagtcttttggctcacgatgcgtagtcgctcaagtaaaaatatgcgcaactatcaagtcatttatacttatcttttttgtcaaagaggacgatttgacctaacaaaaaatacaaaaataaagcaataacatttcaaactcaaaggagaacaccatgaagtacgatttcattaaccaaaatgcagaagcgacagaaactcaagaaacagaacgtgtggaaattgccacatctcaccaaagcccccaatcatcgcctgaggttactcctttaagtgatgagccttttgactttatcgcttttattcaagaagagcgcacgcaagcccttcaagaagaaaaagagcgccacctatctacaacacaggaaattaatagcttgtttgatgaaatggagcggcttgaaaaagagcgaccagaagcccttaaaaaagcccgtcaaaaagctaaggaaacgcttttagcgattcaaacgctgattgccacccgttcagaagatgtagaacttgaagtgaatcaagtggcgagccaacttcgtgaaaaaaccaatgccattgtaggagaactcaaaaatgaaaacttataactttatggaagagcctgcaagagaagcgcctgaaaaaaagagcgttttttctttttcaagaatggctcgcaagaaaaaagctaaaacgcctaaaaagcaatccaaaaatgaaaaaacggatgctaaaacagctcctcaaaagaaagattccttctctaaaatcaagcaagattttgataaatacttcaaaattaaaaaaagcgatttgttgacgtatccgcttgaccgtcctattgattctgaaggacgacttcacactaccattgatggtaaagacgaattttcttatcttctctcggttaaaggttatgacttagcaggacagtccgtcgaagagtataaagcaattaaagctaaatattgggcatttcagaaaaattatacttacgcttttaaagagttttatatgaacttccctgaaaataactctaggaatcaaaattacttgcgctctaaattctcaggagaaaagggaatgcgacgcctgagtcaaatcaaggataattatctcaaagaagaaattcgcaaactcaaagtcgttgaagaagaattcagaagtaaacgctccttcattgccatttatgggaaaaccgaagaagaacttgaccaccgactgcgccaagtaagagaagctggagggtcactccttggcttacagaagttagaacaagacgaagttgaacttctgtttgaactgttgaatcgtggagaagcacagaagaggtcaggacatcaaacactcgctgaaaaaacagcgcctgaagatatttgttttgattacgccacgcatattcccgttaatgggcatgaggaggcgatcgttgtggtcaccaccctttcaacaaccgttaaaaatggctggcttcaaacctttacacatcacaagtatgcggatgcggcaacggtcgattatcgaacgaaagatgaaattgattatcctaaaattatttcagattccatcgaagtctacgaaaaaaaatataaaaaaggagggaaaacaaccaataaagactatttccaacaacaatatcaaattttaagacaaaaaaattatgatattgccaatgaaggggaagtcattaaagaagtgactattcgcctgcttgtttccgctcctgatttaaagcacttgaacgacaagatagacaccattgcacggaatatgaatgggaaagggacaaaagtccaagtttatcaaaacatggccttttatgattggtcgagtcgctttgtttcttcggattttcaaaaagagttaaggacatcaagagaaggcgtggagcgttcagcgctcgctttagctcttgggtttgcacataatcaaacctacttaagtgaccccacaggacagtattttggacgaaccaaaacacaatgctcagtttatttagatacttttacaaaaactgaggaacgcctctcttatgatatttttatttctggcatgaaaggaagtggaaaatcaacctttcttaaaaagttggtcttatccaattttattgtgggtcgctttgtctatgtgtttgataaagccagagaatttaaagaactgtcacgggtcttggggggcgattaccttccgctcgatggaacaaaaggcttggttaatatgttacaagtcttgcctttacagtccttagggggcgatgagagtgacgatgtcacgaaagatatttggggaagttacaaccttcatatttcaaaaaccattaaccgttttaaaaactggattgacttgacgaaagatgaggtcttagatgtcaactctattcttgatgacttctatcaagacttctttattagaatcaaaggctatcaatggaaaaaatttgatattactggcttagccaatcaagattatccgacctttgatgatttttatgcttttctgatgagtggaaaggtgaaagatgttgaccctaagaccacgcaacgcttaacaaaaatggctaaaaatgtcgtgactcgcaaacgttcaacctttgtggggcatacgacaatggataatcttttaaccagtcaattcatcacttttgatatttcaaatatcacgactgaagcaacaggggacgctgacattctctttgatgtgacgctttcgctcttattttcaatggctcaaaatcgaggacgaaaagaaaagaaccgctatgaaacgggtcaaaaaacgtttgatgaaattgtccgttccctcattgtggtcgatgagtgccacaatgtgttaaacccttataaattacaagccaccgaaatgtttttagaagccttacgggaaaatcggaagttctattatggagtcgcactagctacccagcttattgaaaccatgattcctgataatgctgcacaaatgagtgggaaagctgggcttgcggtacaaaatctgaaggctatcattggactctgtcaatacaaagcatggatgagacaatcaaataccagtattcaaaccattaaaaataacttttcaggctactttaaagaaagtgactatcaagccttacagaactttaaggtggataaaaaagtcggaagtgagttgattctttcaggaactggagagcgagggcttgaaatgtatcattatgccactcctcatgaactttctatcttccaagggggggcttaatgaaaaaaggaataaaaataggtgtggtgattggcttaatcgttctttttttagttggtggctttgttttttggttttcgactttacccaaagcccaagaagttgccccacccaaaaagtttattaccacgcaaaaaagcaccatacaaaagattgaagtcaaacctgagattttaaaaaaaaccaatgcttttgtatcgactttttttctttttgaccaagaaaaaatgaaagattaccaagctattcaaggcgtaacgacagataccgctcaatattttgaacagtatggcaaaggaactggaattacttacacacttaagcaggccacgcaagataatgcctctaacgtgttcatcacttatgatgtgacaggcacttaccaaaagaaacaacagaagttttcaatggtcattaatgtgggacaaacttatagcaccacattgacgatacaaagttatacggtggttgcctatgaatagaaaaaagatagcgctgtgggtcatcagctcactcacaggatttagtgggctgtttttcacggttcttgcgattctcgtttttcttttcttaggcatggcatccttaaaaaataatacctctaacgatgtcattccaaacggaaatgcgcccgtttcagggcaagctttggttaatgcgatgggaattgtttccgagatgaaaaaagaaaacgccccgctccaacagattgcaggaacgctttctaactgggacgcagaatcaggaggcgaccccacaagtgttcaaaaaagaaattggggaaccattaccacagcggatatgtacaaccaacccgcctttgtgatttcagataccaaaaaggcagccatcagttggtttgtttccacttatccaagcgggaattatcccgcagatggaataggatacgctggtgggatgatgcaatgggatggcccacgtttaattggtttaatcaattattccaaaaaaataaataaagattggtggcgcattgatacgcaatttgcatatttaagaaatgcggatagttatgcgccaagctataaaaaatatctcactcaatcttttaaaacggccacagaagccgccaagtggtggtatggaaaccttgagtattccgttggctgggagaatgcgccaagcgcaccaaatggcggaaaagaaaaacacttaagcacggcagaacaatggtacaactacctctctggcagttcaaattcaggctcaggcggtcaaggtttatcggttcttgataaaatcttaggtcaagccttagatattgacggagcatacggcgctcaatgttatgacttgaccgcttattatgccgagtctatttctcattttagaccgattgcaccgaatggagcgtcagggctgtttgcggatagtccagctcaatggacaagtcatcaatggtcaatcattaaaaagccaaaatacacagatttaaaagcaggagatgtgattaattatcaacccggaggcttagtggatggttggtattctgatggttcgtttggacatacaggcgtcgttggtaaagtgctcggcaataataaatatgtgctttatgaacaagggggcggagcgcccgcacataccagtacctatacttatcatgccgaaggtgtagcctcaattattagacccccaaaataaggaagaaagatgaaaaagaaatcactaattatcgtcgcaatactactcgttcttgcgctcattggcgtgtttgcttttctccaagcgagaaaacaacccatagagcgggtctcaaaagaatacattaccaatcaatcgacacaacccaaagtttcaacttctgaaagttcaagttcaaccttttcctcaaaagaggcaaaagtggaagtcagttctgaaacaaaagcattggtgagtcaattcttgatgactgatgtaacttatgacttgaccgttaaatcaatccttgctcgttctgaaacgctctctaaaatcatgaccaaagaggcttatgagcaactgaagattcaatccaccacagagagcttagttgcgatgaccaacaaatggttgacgacaaagcaagtggatacttcctcaggcgatgtgcaattggtcagtcaaaaatatcaatcggccaatgtcacgccaagtgcgcaagaacctaatcggttctatgtggaactaaactatgatgaaacgcctgtgacgacaaaagaaactcaatcaaaaactcaattgctttggttatctgtcacagataataaagtatcggatgttgagattatcacgacaaaataaagaaagcgaggatcaaactattgataaatttacatattgtcgagggacgattaaccaagaatcctgattaccgagtggatgataaaaacaaacaagtgtatgcgaatgcgacccttgcttgtacaagaaactataagagccgtgagggaacttatgagagtgactttatcacgattgccctcaaaggaaaagaagccactcacttcgcaaagcattgtctaaaaggctacttagtgagcattactggtcgcactcaaacggatgttgttaccaatcctaacggtcaaaaacaatactataccaaaacacatgtgatgagttggaacttactggcaaaagcaaaagctcaaaccctgcctattcaagaaacaaagcgaccctcatccgcttttccaaactatcatcctaaccaaagttttaacgcagacattgaatcaatgcaccttccaagtgaagaaggagacatgatttaatgtcttttttattatgttgaccttgtcagcaccagattaatttaaaggagaaagacaacatgttacttgtaaaaattcctcgctctttttataaaaaaaaccttcctgaagatgatttatttgtaggacatctcggagaaagcattcaaggtttaattgttaatgatggtttaagaacctacttctcgcccttgctcaatgtggcagaattaacgcatacgctctcagaccctgagagttatgtcaatctatcagatgaagaaaatagtcctcctgaagatattatcgcccttgaaaaaacgctcgtcttagacgatactttttttgatgacgcaattgccacaccaaccctcattcccccacaagactatcgtcagttgaaggtcaaagaaactgaatttatgaagcgcctttcgctttatgttttagattatcagctccatcccaacgacttaaaatacaaacattcctcacttcaattcttcaaaccgcaactggaaatttacgaaagtcagcttgatgttttagaaaaagaaaagcctctcgttcaacccttttatgacattcatactcagaaacaatatgacttgttagaagacacggttgatgcaaatcgtattgaacatcacgaccgagagagataccaaaaatcaaaagaaaaagaactcggcttagagtattaggagaactaatgaaagcattaatccatgataaatataacctacgtttcttcattccgattgtcttatgtgtcctcattgccgtcggttttttaactagtgggttcattcaaaaaaagacacaacctgtggtttctactgcgattggtcgtgtgctaaatattgaaaataaaaccagtaaaattgtgtttgaaaatgcgcaatattatgagaaaagcaatttattggtgactggtttttacttgaaaagtgatgaagttgtcccaacagatacgcttaaaattgatgccattaacggacgtacccaacaaaaaatggaggcgtctgtagagaaaatcaatgccaactattatgtggtttttactccaaatgtttctcctaattttaaacaaatcattaataatatcactttaaaagacaatcaaaatcattccacttccgtaggtggaattgccgttacacaagctaatgtctcaaagaaaaaagacacctatcaagctcaacctttagacttttatgtcagtcaatacaagcagtatgctcgccaagatgtcgaggcaaaaattaaggcatacgacaaagaaattgaacaatttaagactcaaatcaaaaccctaaataaagaaaatcaagtttatttagcggatatgaatttgaaaactgccgaccaacaaaaagagattttctcacaaattcagtctaataacaatgccattaccaacatcaatacccaaatcaaaaccgttcaggaaaatcaaaaaaaggtggaagaacaacgccaactgttaagtgaataatcatcttttgaccaatcttgaccaaaagcaaaaaaagacgaacttttacttagcacttgagttaaaaacatgggaaaaagacacgatgtaaacactatactatgagaaaactctcataattaaagacgattcaaacacgatacgaagctgtggttgagcgattttaaatcctatacaaacactatatatgagaaaaaatctgacccctagctaaaacaagtcgcactgcgacttcccccacattttgggggcagtttctcttatgctcttagataaaaaacacaaaattagattagaaaacaaaaaattctattcaagaaagggaaatgatggaaattaaacttagaacgttgaccgatgaacaagttataaatcttgacataattgcaaaagaaaacaaactttcaagagagaaacttctctcaaaaattattagcgagtacctcgatggaaaaaactttttagctgcacatcgaaccttttttaaagaagaagtcgctaaaattattccaacacttgaaaagaataatcaagtcatggaacgagccttaagatttttagaagaggatcaagcgcatggagattaaacttcgattcttaagcgatgaagaagtcgcaaaattagaccgtttggctaaacaaagaaagattagtagacaagaatatttacgtcggctcattcgacgggagttaatgacggcaggggagtttttagaaattgactctgaaagtaaaattcgattagcccttgcctcacaactcaaaaaaaataacgacttacttcatatcttaattacgcaaatagaagaaaggacttaacgcatggttgaaaaaataaatatccaactcataaagaaaagacaccctaaagtttttagctactttgaatcatttgaaggcactcctttgcaagcacttgaagcgctccttgcacaaactcaaatgcaacaaaaaataattgaagaacgaggagatattttagaagacttcacgcgacttttaaagcccgaactcttacaacttcgtttggcgcttcgagcaactgaaaagcaaacatggatgctcacacaaatcaaaaatacagagttgtatgagcgagaagtgcttcatcctgaccaaccgtttcctaaagcaaaaaccttggcagattatcgaactgagccttacgccattctcgaaagtaaatggaaagacatgctcacttcgattcgacaagaacgagcggagcgagccagttatgaaatggaaaagtgggaagaaggacttaaatgagtagcccgggcgtaatcgattcaaccaaatttgtttcagcaacttctaatggctttcagtcctacttagattatatgaatcgtcctgaagctgtccgaacggaagcttacgcttggtacaatgtcgcaatggacgatttaaaggaaacaaacttcgatacttacaactactatatgagtaatcctgaaaagacctccgccttatttagcgatgctcacgacttcctcacacctgaacaagtggaacaaaccattcaactcttccaacaagctcaaaacaatcgttccctcatgtggcaacacgttgtctcttttgataatgcatggctggaaaaacacggacgatatgaccctaagactcacacgcttgatgaggaggcagtcatgaatgggacacgaagtgccatgaaagaactaattcataatgagggaatggaaggagcggtttggacggctgccattcactataacaccgataatattcatgtgcatattgcaatggtcgaacctgttcccactcgaaaaaaatactatcctttggacaaaaatggcaatcgtctttactctaaaaaaacaggcgcagtcatttgggattataaaggaaaactccaccaaaaaaatttagaccgaataaagtcacaagtggcaagtgccattgccgaccaaagtgagatgttaggtaaaattaacgacctatcaagacaacaggtgggcaaacgcgatgacctttatcatgcccttcgccatgaccacaagctccaaaaaagttatgatactatttaccaacagctcccatcgaaccgttccctttggaaatataataacaatgccctcggttcggtgcgtcctctgattgaccagttcattgacgactatattgagagctaccactccaatgaatttaaacaactcaatgacgctttggataatgccgtcttcttttataaagaaacctacggagaaagtcgttatgatgattttaaagaaaacaaattgaatgaccttaaggcaagtctaggcaatggcttattaaaagatatgaatgcctattataaagccaatcaaacgcaagctaaactccttgtcaagtatcctaattatccgtcttcctttcacggaagagggcgaagtctgaatcacttgaatgcagcctttgagaagtcgtatcatgaacaaaaaaatctccgtgactatgagcggatgaaagaagaaatagaatacgaaaacaatgcggaatactaattcgcatttttttttttgaaaggaaaaaccaatggttacaaaagaacaaattcaagaagcgaatgccaaagacattctaaaaattgcggagtcattaggacttcctgttaccaaagtcggctcaggttaccgctcaggtaaaaaccttgcctatcaatttaatccccacacaaacacctactctaactatcgtacaggcgttaaaggagcagatgtgattgcccttttccaaaacgaaacaggtttagattttgaaaaagcggtcgagcagttatgccataccgatgtcaatcttgttgaaatcaatcacacccctcagcctaaagaaccgtttcgctggtactttaaaacatccccaaatgcagaccgtgccacagaattgctggtcaatcaacgcaagctccctgaaaaactcataaaattgttggtcgacaaacgatacattattcaagataagtaccaacaaatcgtttttccttggtacaagaatggacaagtcgttggcgcagatgtgaaaggaacggtttatcgtccagatgaagaacatccgtattttaaaggaatcgcaaaaaactcggaaaactttggttataacatcaaagtgggaagtgggagagttaaagacatttatatttttgaagctcctgtggacttattatcttattgggcgctccatcctgaaattaaagactgtttattgttctcagtcagtggaacatctaacgccaatcgtgttgagcttgccatgaactatgcgcaagccacttatgggatgagccaagaaccaaaagaaatggaacgctcgattcatatttgcgtcgataatgatgagcaagggagtaaattttggaagaaatttgataaacaaaatgaccttgttcttgaatggaatggcgattgcattctttttgaagatgaccgtcccgaccctgcatttggaaaagattggaatgatgttttaacctaccatgctaaagaatatgaacaaaatctctctgaagcgacgacaaatgaagaaatggtgatgggatgaaaaaagcaaaacaaatcatcgtcttcctactgcttttatttggctgtgccatcattgtccttccaaaagtcttgaatattgactttggagaaaaactttcgcaagtcgcaaaccctaagcctattcttgaacattcaagttctaagcatagtacaagcccctcttccacctcaaaagtatccccttctttagcctttaaagcaacctatcaaataaaactctctcccttggatacattgggaagagcaggaagtgcgcaagtgcagctccaagccaagcatttaccgacacaaaaaagagagcctcggctgacttataaccccgtaggttggcataattacaaaattaatgggcattggctcatgaatcgagggcatttggtcggttatcaattctcaggcttgaatgatgaacccaagaaccttgtacctgaaacagcttatctcaacgctgggagcctcacaggaatggacgattccaatgctcaaagcatgcttttctatgaaaatcgtttagcgacatggcttaaaacccaccctgacgattggttgagttatcaagtgacgcctctttaccaaggcaaagaattaattccaagacaagtgaccctttcctatcaaggctatgacaaaaatgggaaagccttaaaagtcgctgttggtggacatgagaccatcaataatgaaggtgtcacagaagtgatgctcgataatcggagtcctaatgcgacgcttaactaccttgacggtacggcaaaagaaaaataaatagaaatgagagaaaaaaagaatgaatagagaacaagtcaaccaagccatgagtgcttttctaactgattttaattccctttcaagagaagaaaagctagatttcctaaacttcaaccaacgccaccatcacagaaaaattaatgaaattctttctatttatatgcagaaccctgaagcgacgcttttgggttcttttcaatattggaaagatttaagcacagaatcaagtgtcgtatttggtcaaaaagcaaatgtccgcatttgggatgaacaaggacgagtaagagaaacgctctatgacattactcaaaccaccttacatgaaccttttcgcattcaagacacacttgtggacgaaagggtgctggtcaataccattggcgaattgactggacaagattatttgttgggagactttgatttagaagagtataatacttcactctctcaatttatgcagtcttatattgaacagacggtcaaaacacttccgcagtatacggatgaacaaatggatttggcactccatattgcaaaatacaatctcctagaagaattcggcgcctttctcgaagaagacctgtattatcaagaaattgctcaaacagtattgaatcggtttgatgaaatttcagaccaaggcaatcttttgcgcagttttgctttagccaataacttctcacaagagttttctcgccaagtgatacaaaactatgaagcggttagtgagaaaacactagaaaaattagaccaacaaaaacaactcaacgaacagcttaaagcaattgaaacgcaaggtgcttttgaagaaactctagtcgttgaacaagagaaccctaagtttttaacacaagaccctcaacttctttttgaacaaatcattttaaaattgaatttaggcaacacttttaaagtcgacatcgaaccaacaggagatgtccgattggttcgagacagcttgagtgggattctaattgaacctgtggtcaccacagatggcaaagatttcagcttttcagatattgcggattcattgacaggggttaaagattttaaaaggcaattttaccaagtcttagaccaagaatatgaaactaaaaagacggcttcagaagaagtgctaaaggaagtcaacatagaggcgcaagctgccctcgaagaatcccccgttatttcagaagcagaaacagtttgggatgaccaagcacttcttaaagaagtttttaaatatggttcaggttttgcgcaaggcaaagaacgcctccagtattatttttcggaacatgaactgaccttatctaaaacaagcgccatcgcttttttgaaagaggagtgtggcattgggggtcgaggggacggaacttttgacttcatgcatgattccaaaggcattacaatatggcaacccgtggaaagaaaactctcgtggtcacaagcagtagattatcttagtgaggcggtcgcaaaagatgtttatctttcgtcaaaagataaactagagtacgaggaatggaaaagtcacccgaaaaatattgattatgctcaagctcgctggcaagaagaagatctttcatcggaaaaagaacaacaaactgaaatctctctttttgattttgaaaatgacacgattgaaaccgtcattcctgaatccgaaccccttaacaacgggttaaacaatgaaaaacattcagaaatcataacaagacacgtggatgaagcaataaattcaagcgatttagaacaaacgccttcaatttctgagcctcttcttgactattcttttccagatgaatctatttatgcgctgaagatggctgataaggtcaaagataatctcaaagctttaacactcttgaagcacttgaactccgaacaacgaaaggctactgcacccgaacaagaaattttagctcgttacgtaggctggggcggtttagccaatatattctttgatgaaagtaatcctcgatttaaagaggaacgccaacagctcagggagttagtcaccaccgatgaataccatcacatgcgaaagtctagtttgaccgcttattatactgaccctcaaatcattactgccttatatcaacaattagaaaccctaggctttaaagggggacgtatgcttgacccttcgatggggtcaggaaatttcttttctgcccttccagaagatttaaaagcaaaaacagaacgttacggtgtggagcttgacccgctttcaggtgcgctttcacaacaactgcaccaaggaacgcagattcaagttactgggtttgaaaaaacaaattttgccaaggggtctatggatgtggttacgaccaatgttccttttggttcactcatgattgcggatgaacgttatgaagccaactacgccattcatgattactttatcaagaaatcattagacctcgttcgtgaaggaggattcgtggcagtcattacaagtacctttacgatggataagcaaaatgatagttttagaaaagagcttgcctcaaccgctaatttagtgggtgcggttcgacttcccgacacagcatttaaagccattgctggtacaaatgttagctctgaccttttgattttccaaaaaacaagcacgcctgaactcgctccagactggttaaaaactgaccgacagtccgacgcttttggaaacacgatttctgtcaatcattactttaaaaaccatcctgataaggttttaggaacaatcaaaatcaaaacctttaatggggggacattgtctgttgaaaataaaggaacatcagctgaaatgattgagcagttaaataaagcccttaattttcaattgactgccgatgtgccaagtcttgcggtttcagaccctgtctttgaagaagtgacaaccactcaaaaagcgattccagaagaagttttgaacaacattactcctttcacgctttatgttcatgataagcaaccttattatcataatggcaatagggtcgaactttatcagaaatcgtcgtctcttacgcttaatgcaaacgagacaagaaagaaccagttagagcgttacaccagaaatcaagataaaattgtttctgaaaaagaaaaatttaaattaatttatcagggcaaaggttattttgatagctgggataattttattccaacgacttcagaggctaaaaatcaattgcctgagattgagcctgatgttctcaaaaccattgctcaagaagatgaagcaacgcaaaaaggctttcgttatactttggacccgcacacgagtgaattaaagattgaacaactgatcttgacacaatacttttatcatgttccttatcaagccaaagaagtgcaagccattgaggcaatgattgacttaagaattaccttacaggaagtgcttaatgtgcaacaccagcctgattttgaaacggcctatgagccattgagaattgccctcaatcaaaagtatgaccgctttgtggaacaatttggtgcaatttcctctccagcgaattattcgctcatgaaacaggatgactattatcaatttttagcatcgattgaagaagaagtcgaagacccactcacgaaagagacacgatttgtcaaaggggctgtctttcgtgaaccgacgattcaagttgaaaaaggcgtggttgaagtttcaaccgcttccgatgctctgcttgcttcattaaatcataaaggaaaacttgactttgattacatgcaagacatttatggcaaagaaaaagaggccatcattgatgaactcggacaaaaaatcttttatcttggcgctggcgaataccaaacacgagaagactacctctcaggcgatgttaaaacaaaacttgaaatcgctcaaacgaatcaggaatttaatttagagggaatcaattggcagtctaacattgaagccttggaagctgtaattccaaaagatttagcattaagtgacattgcttataaatttggctctcgttttattccgaatcacatttaccaagcttttctagcagaagtcctcgaccaaaaagtgagaggcggctcaaaacctgaccctcaaatggtgaaaattgactacgataacatgaatgatgtttaccgagtagaattagaccaaacttataattttgcggttaccaatacttatgcttatcaaaatcgctcaaaaaaccagtcttatcttgcagataaactggctaccacacttctcaatcaacgctcgcctaaaatttatcaacctgaccctaatgacccaagtggaaagaaacgagtcgttgattctgaggcgacggcctcgattcaagaaaagggaatgcaattgaccaaccaatttcaagaatgggtcatgaaaacccctgaagctcaagcagaaattgtgaaaatctataaccaacgttataatcgttccgtcatgaaacattatcagggcgaaggtttaaccattaacggactggcaaagcagttccaactcagaccccaccaagcagatgcggtcatgcgaattgttcaagaacgtcgagcggggcttgcgcatgaagtggggtcaggtaaaaccttaaccatgcttgcctcttcgatgaaacttcaagagcttggaattatcaataaacctttgtttgtgattccaaagcccttgattgaccaatttgctagagaaatttataaatacttccctgaaagcaaagtgctagtggcaacttctaaagattttgcgaaagaaaatcgcaaacgttttatcagtcgaattgccaatggcagttacaatgcgattgtgattgcggactctcaatttggtaaagtcgcaatgagtaaagcctatcaaaattactacatgaccaacgaaattgaacaagcaagacaaatgcttgagaacatggactccgaccgtaaatatacggtgaaacggattgagaaaaaaattgaaggacttgaaaaaagattagaagaccttcagaaaaaagagaccgatacctttattaattttgaagagctgggcgttgatttcctttatgtggatgaagcacacaacttcaagaatttagcaccttatacccaattggaaaacgttaaaggcgtttcagatactcgcagtcaaaaggcgatggacttaatgatgaaagtggagtaccttcaccagcaatacgataaccgtcatgttgtcctctccacaggaacaccgatgtcgaactccgtggttgagctttataccatgatgaaatatgtcgagccagatatcttagcacgctatggcatgaccaactttgatacatgggtcgcacatttcggacaaattgaagacaacttcgagttgacggccgcaggaacgttcaaaatcaatcgacgctttacacagtttgggaatgtgcctgaactcatgaacatgttcaaggagtcttgggatatccaaacttctgaaatgcttgatttacctgtccctgaagcaaaaactgttccgcattacagtcaagcaacgactactcaatccaattatattgatgagctgaccgagcgagccactcaaattgaaaatggggaagtcaaaccctatgaagataacatgctcaaaattgtgggagagaatcgcaagttaacgcttgatatgagaacccttgatagtcaacgctatacagcgatggactctgataaactcaatcaactcgtgaccaatgtggttcaaatctatcaagcaaacgatgacagtaaggccacacaaatgattttctcagacctttctgtcccttttaaatatcgcaatagcccttcttataaccaagacggttcagtcaatactttttctgcttatgatgaaattaaacgcttgttagttgaaaaaggcattcctgaccatgaaattcgctttatccatgaggccacagataaaaataaagaggcgatgatgcgagagatgagaaccggacaaattcgtgtcctcttaggaagtacaggaaaagctggaacaggactcaatgtccaagataaactcattgcagtccatcacttagatgtgccttggcgcccttccgatattacacaacgcaatggtcgaatcattcgtcagggcaatgagaacaaagaagttcaaattcatcattacattaccaaaggctcaatggacgctttcttatggcaaacacaggaaatcaaagcgcacctgattgaacaaatcatgagtggcaaatcaaccgctcgaacaatggaagaattgaacatggaaacccctggccctagtctctttaaagccaatgcgacaggaaatcctttgcaggcagaattcatgaaactagagatggagttagtcgttttggaacgttcgagaaatcgttattatgaggggaaagccacagaccaaaaacgagttggaacggaaaaagaccgactggctgcttttgaaaagcgtctgaccgccattcaaaaagaccttgaaacaattgaaggcacaaaagaacaccctttcgcccttgatttaacctatcaaggagagaccaaacatttcgattctgaggataaaaaaacagaagtcggagcgttttttgccaagcgtctaaatgggaatgtcatgtcataccaaatgaacgtgggagagcagtccaataccttaagcattggtcattaccgagggtttgaactgcttcataatctaggcgcttccttagaaactacagaaacgcttattctgaaagggcaggcgcaatattccgtacgtgtcgatacttcagcgcctactggtattttgactcgactagacaataagattgatgacggcattgcacaagattatgaaaatacccttttggagattgaccgtttaagtcgtggcattgaaaaaatcgaaagcgctgaaaatcaaccttatcctaaagaagaggaatactttgaaaagcgggaacgccatgccacactcaaagcagagttagaagaagaacgcaataccaattttcgagaggtttcgcatgactatgaaagtccttcagcagacatggaaatgtaaattaatcaaccctaaaacaaaagccccacaacaagtcgtgatggcttgtgtggggctttttttgttataatatttaaggaggtaaaaatgaaaaataaattaaaaaaaattaaatccaaaataactgaattgtctaataagctattcccccgagagaaattcgttgaaacgattgaaaaatcggcaaatttcctattatatctgagcttttcgttgatctcaataccattcataatgcttttgctagaattcattgtagtcaaaaaccgttcaacaaataatttatctaaatatttatttaatagaggaagtgtagtttttgggggagatgcgtcttcattaattattatagttatgacgagttctattattctaggactttatttattgatactcgatatcattatttatgcggtaattaaagttaatgctaaaaataaaataagtgttattatagatgctattattttcataatttctattgtattaactgttggctttatattctttgatggttttagattagataatatattttctattttagcattatgggtagttgctatatgggttatttacaacctgattaaaattattttagaactctcaaaagaaaaaactattgaacttttcatcatccctattttagcagctttagttggttatttatttggaaaataattactaatctaaaagcaccataggtctatgacttaaggtgcttttttgttataatgatgttcgtagatagtttaatagacgatggctctgaaaggtggtggtgcttatgaatgtaagtacagaatccaacggaaaggagcgctcttatggtggctgtggcaatgctagtaactgcaatttgtagtttactaatcaatttgttcacgtttgtcatcttgttgattgaaaaaatcacaaaaaaataagaaccgtcttcaactttggtagagtaagcggttcttagaatctaatctgccaccgacttttaatcggctacactaggacttgttagcgcaagtccttttctttatacttattttatcacaacttcttttttttgtcacttgttctaaccacaataaaaagctgttctcggaattgtaagaggaggacagcttgtaaatagaaaggtacatatttcagggataactaaaatataaaaatattatatcataattaaaaagaatattgttcaaaatttagaaaaaaaagtatattctaacgaatcgtgttttaagttcagaatattttttttacttttgtttaagacactttaaaaatagcataatatttttatatcaacaactaaaatcacttgcaatttataagcgcttttttgattaaaaatatccccatactctcataaacttgtcataaaagtgacttttttagtttttttaaaccttaaaaaaactaaaatcgcttaaccataggttttgttccgattatatgtttcggaaaaacagtaatttttgcgatactcacatcattgtgcagtacactttttttatgaatataaaaattctatgactatatttcaagtaagagaaacctcataactgaagcaaactgcctatctattaatttaaagataagacatcttcatcggttgcaatacaatgtgttccagttatatcttcccaatataataagtttgtcgctggattgtttatattatcaactttttgaagttttttcatttcttgtactgccgaaccgaagtcttcatttattttattttcaatctctagcattgaaatatactcttccttaatattttctttcttagtgtcatgcaccataaatttaggtagttttcctagagtttttttattatcggaattttcttctaaatcgattaatttttttgatatagctttgctacgattccgaaagttcccataaatagatattgtatgatctaatatcttttgaaaattatctttagaatacttaatgaattcgggattttcttgagtatctaagcataaccttaaatatttaatacgcaaaagtaataagctggagagaagagtaaagtaagcatcactatttttatattctgaagctgtattctcattaatactatcaagaatttcataacgagcttttaattttcctgcgtctctttctactaaagccaatcgaataatcatatcttgtgaaaaatgaccgattgttgaatgctgggtatacagttcatctactatatcaatagctgaagacaaatcagctatacttgttatttcttgacgtaacaagatttgattcatttctttttgaataatatctaattttttattaacaactttgaactgctccataataactattgtactcattgcttgcatagtgataagtggtgccactataggcagcgaggatgcgactggaataaagccagactgcctagctatacgtcccccttccataactgcagatcctactcctccacttgacagtttcataagtaagtcagggtttgcagttgccataaatagttttgaagaaagatttttagaaatagcagtaagtcctaatccacttgttgtaattagacttgacatgaccgatggagaaatactcatttgttttttcgtatatcttccggtattaagataattttgagatagtttttgaatcagctgctctcttccctccccatttatttctagcagttgcatactttgaggttctaattttatttcagtcatatttttctcctattttatttttagttctgttgataattttcctcatctatattttacactaaaatggccttataaaaaaactttgcaacaaggggacctacaactgctaaatgaagtcccctcatttcatttaaaaccctgagtcaatgtttcgttcgaggcataagcatatatttgaatcatttgattagcattatttattaaataataaaattatcaaataagtttcttgaaaagactaattttttcaaacaatataattttgtgtactttctccaataaaacttggattttatcttaatctcttttataaaattaaatgaaatttccttgtgaatatattttcaatctaacaggtattatgatagaataaaagcaaattcaatgaattggagtttaaaatatgcatcaaataaaatgtccccattgtggcaaagagttcacaattgatgaagctagttatgctgatatcttaaatcaggttcgtaccaaagaatttaacgacgaaattcatgaaaaattgaagcagctcaaaaaacagcatcaaagtgagctagagcttatagaagaaaaggcaaataatgctttagaaaaaaaagttgctgaaaaagaaaaagaattaaaagagctcaacaacaagattgctaactttgctaatgagaaagaaatcttgaagaaagataccgaaagggcgatgcttaatcaaatttctgaaaaagaaaagaaaattgcggagctaggttcaaagctgcaggctcttgaaagtaataaaaaacttgaattaattgaatctagtacaataaaagaaaaagaaattgctgatcttaaagcaaaactacaactcagagaaaaagaagcagaattagaaaaaaattctatcaaagagaaatatgagatcgaaatcaaacaaaaagatgaaaccattgctttttataaagattttaaagcaaaacaatcaactaagatgattggagagagtcttgaacagcactgtgaaatagaattcaatcgtcttaggatgacagcatttcaaaatgcagaatttggaaaagacaacgatgctaagactggtagtaaaggtgattatatttatcgagaatatgataaaagtggtactgaaataatctctattatgtttgaaatgaaaaacgaaggtgatgaaacagccaccaaaaagaaaaatgaacatttcttcaaagagctagacaaggatagaaatgagaagaaatgtgaatatgcaattcttgttagcatgcttgaagcagacaacgagctttataataatggaattgttgatgtttcttatgcttatgacaaaatgtatgtaattcgccctcaattctttattccaattattacactccttagaaacgcggcaatgaattctttgaagtataaacaagaggttgcgctaatgcgagaacaaaatatagatattactaattttgaagaagatttaaaagcttttaaagaaggctttgctcgaaattatgatcttgcaagtcgtaagtttaaagcagcaattgatggaattgataagacaattactcagctacaaaaaactaaggatgctctcctttcttctgaaaacaatctacggctagctaataataaagctgatgaattgacggtcaaaaagttggtaaaaaacaatccaactatgaaggaaaaatttaatcacttgaatggagatttatgattgttactattctgttaaaagaaaaagtatcaataaattttttgataaagaagaaaactttatgagttgaagtttttaagttaggagcaggaatgataaataaaataactttaaataaagtggcaagttataagaatgtcgccactttagaaacaaataaaaaagttaatctgatttatggattgaatggagttggtaaaagcacattgtctaattatctctatgatgttgaggatgggaagtatacggactgctcaattgagggattagatgatgaaaccgagttactagtatacaatcaaaaatttattcaagataatttctatgaggacaaaaaacttaaaggtatttttacgttaaacaaggcaaacagtgatgcaattaaaaaaattaatgatgctaaaatcaagaaggaaaattttagtaaggataaagattcaaaaaacaaagaattagataaagaagaaaaagctctgataaaggaaaaaaactccgcaaaaaacaaaatttgggaaataaaaactgattatagtggtggtgaccgtgtttttgagttctgtctggaaggacttaaacattcaaaagacgtcctttttacatatcttttatcattaaaaaagcctgaaaaggaacttaaaaaaaatataaatgatttaaaaaagaaaattcaatcactttcaggagaaaaagcaaaaaaatacccagagatagctaaaattgaattcaatatgcaagatattgaaatgaatgaaattttccaaaaacaaatagttggtaatgataatagttcaatttctgctttaattaaggaattgggaaattcagattgggtagaagaagggaaaaaatacttacttcatgaggcgcatggcacaggcatctgtcctttttgtcaagaagatactataactcctaaatttattgatgaactctctagatacttcgatgaatcttttttggaggatcaaaacaccattaagtcgttttatgaacaatatagtcgtgcatttgatttactgactactatagatgattatgagttaaatccaatatttgaatcttttaaaagtgattttgaagcaagatattctgaacttattaatatattgagtgataataaaagaaagattgagaataagataaaaactccaagccttcctgtaactttgcaaaattctggttcagtcttagataacttgaatgatgttattgaggatattaactctgcaataaaaaatcataattcagatgtggaagatattgagacaattagagacaaaataaaagactccttctgggaaattatgcgttatgattatgacaaaaccattgaaaattatgaattatctaaaaaacatcataaggagaaaacagatccaattaaaagtgaaatcggtgagttaagacagaaaattgctgagcaagattccatcattgttgaacagcaaaaattaacagttaatgttgatgatgctatagaagaaataaataacagtttaattgatattgggattactgacttcaaaatagaaaaatattccgagcaattttataaaattgttcgagaaatcaaggatggagatgataatagtgtagatttctggtcattgagtgaaggagaaaaaacaataattagttttttctattttcttaaattgtgtgatgggaaaacaaatccaaatactagtgacaagaaaaaaataatcgttatcgatgaccctatttcaagcctatctaatgttttcgtttttaatataggtagacttataaaaaatgaattttttgcaaaacgtaaaacaagaatagataatgatggtaacaagattagtgaatggaagtataaatatgatcaaatttttttattaactcatagcctttacttcttctatgagattactgagataaatcatgaggttcgcgaagaaaaccagcatttatttagaattataaaaaattcgaaaggtagttcaataatttcgatgaaatacgaagaaattcaaaatgactatcaatcttattggtcgattataaaagacgaggcttgcccgtcagctttaattgcaaattgtatgagaaatattatcgaatatttttttaattttgtagaaaagaaagatttgaataatttctttaataacaataaaaatccagcattaaaaaatcctaagttccaagctttttacaggtatattaatcgagagtcacattccttgggccaaaacatatttgattttaaggaatttaattatagtgattttaaagaagcatttaaagatttattttatgaaacaggatataaagaacattatgataaaatgattcgttaagataattattccttaatgaacaacaagaatatattgtaaagtgcccccccaaaaaaaatgagatacaaaaaagagaaataaataattttttatctaggtctggatatggttatctatggagtagctgaaactaattagtttttgtgagtagtaagttctgttgacaagcacgacagagccttcatttgaaaattttcaaatctagcctaaatctgttaatttttaaaaataattaattttttaataaaacggagctaaaaataaactttgcaacagaaccaacacagtaataaattaaaaaaagcagattgctccaaaatcagaaatctgttttttttaattctcatgagacactttacctagataattttatgctatttttttataactttgcaacagaacccttatttttatgtttcatttagactgtttctataaatctttcatatatttaatttcaactattatcatatcaaaatttctattaaaaatgcgttagttatactactatgatacaatagataaagttaaacaaaggacgaaagatgataaaagtttattacagaggtagctgtggttctcctcgacgtgcatttgcttaatttgaaaaatataatattaatgtgcaaaagcaacaaattagtaagatgactaggagtgaccttataaaacttctacaacattacgatgagggattaacagctatagtgaagcatccaagggaagagtagttcataatttaaagatgctctacaatatatggaacattttttccccaataaagtgctagagtgcatactctcacccacttatgttatggccactccaattattatagagggcaattatcactttaatggatataatgaggataatatacggctagttttacctaaagagtatcggcggtatcaaccataaactctataacaacgaattattgaagaaaattaatagaatatcaaactttatatcatatctgtatgaaataaatatcgaagggaattgaatgaacttaatttcagaagtactaataaatacaagaaattttctcttatctcagacaaaagatacgagaaaaaaaataggacaattttttacagatgaacaaacagctttatacatggcaaatatgtttgatttatcaaattataaaggaaaaattagagttttagatccaggtactggtacaggcatcctctctgcagcattcatcgaaatagctataaagcaaaatatttcgaatattgatctagttttagtagaaaataatttagacgtattgcctattttgaaagaaaatattaaactatttaaaagtttaaaagacattaaaatatcagttacgcttattgaagagaattttattacttttcaatctaacagttttagagaaaaaacaccttcaagattaggacaatttgattatattatttgtaatcccccttatttaaaaatacctcgtaactctgaagaaactattaatatggatgaagtaatctctggtgctcctaatctatattttttattcatggcgttaagtatacataacttatttgacaatggtgaaatggtttatatcatacctcgttcatggacatcaggtgcatattttaaaaagttcagaaactatatttttgatagtgcaagtttaagtcaagtacatttatttgcaagacgagataaggtattctcaatagaaaaagttttacaagaaactatcattgttaaatttatcaaaagtaaaatgactgatattgtaacgttgacaagctcagaagataataccttttcaaatgtaataacgcatcaatcttcacagaaagttcttgtacaagggagtagtaaatatgtttttttaccaacttcctcagaagaaatccaattattacaaagaattggaaagtttaataatacgttgcctaaattaggaatgagattaaaaacaggactaaccgttgattttaaaaataaaaacagattaaaaaatcaagctgaaaaaggaacagttccccttttatttccttttaatattgataatggaagaattaattttccgaataaaaataaagaaacatatcaatatttgctccctacaaatggtatgaaacagatcaataaagattatatttttatcaaacgattttcttcaaaggaagaaaaatatagattacaacctgcgatttatctatgtgaagatataaacactcagtttatttcaacagataacaaattgaattttattgaaagaatcgataaacgacctatagaaagaaacatcatttttggtttgttcgttatttttaattctacatactatgatacatattataggatactcaatggttcaacacaagttaattcaactgaaataaatgacttaccaattcctaataaaaatgacctcaaacatctcggacaactgtttaaacaaagtcaaaactttacccgagaattttctgataatctactgggagatatattaaaatcatgacttcaaaaatagatgaaacaaaaataatcttagaacaaataggaatgccaaaaaaacaatgtacagaaatatcagcattaacaatattggcaatggcttctataaaagaacaagcctcttggaaactagcagaaaataattggattcgtatacatgatattatccaatttgtaaacaaccactataataagtcctatgcggaaaacagcagggaaacttttagaaaacaagctattcatcactttagaattgctggaataattgaagataatggaaaagctacaaattcacccaattttagatatagattaactcctgaatttttaaacacactcaaaagttttggttcaaaaaattgggaaaataaaatttctgattttctatcaacacatgaaaccttaaaaagcaaatacgagtctaaacgtattttaaaaaaaatcccccttaccattaatgaccaagattttcaattttctcctggtattcacaatgagttacaaaaagctattattgaggaatttgctcctcgttttgctcaaggtgctgaagttatatatgtcggagatacaataaataaatccctagttttagacaagaaacgttttgaagagttaaatttcagtgttattgtacacgataaaatgcctgatgtcgtactttatcaccctcaaaaaaattggttatattttatagaagctgtaacttctgttggagagttaagtccaaaaagaattattgaaattgaacaaatgactgaaaagtgctcagctggaaatatctttgttactgcttttcctgatattaaaacatataaaaaatttgctggtagtctagcttgggaaactgaagtttggctttcagagttgcctgaacatatgattcatctcaatggtgataaatttatgggaccaaggaaataaaatgaagaaaattgttattaatcttccaattattatacatcgctctaatcacgtaaaaagaacaacataatgttgttctggagctatactaaaaaagacagaacagcgtatgttgtaaattataggcaattatcaaataatttgaagaaaaagtaatggagaaagacacaaataatttttaatctcatgttcagaaaatggtcattttctgaacactcttcttttcctattaaatttctcaaaatcatttacattccttgttcattaacccgtaatttattctatgttcatttatatatatatttctaagttatgatacaataaattaaaatgaaggagaaaaaaatgaatatcggatatgcacgagtttcaactggacttcaaaatttggatttacaaaaagatagtctcaaaaaatataactgtgaaaaaatatttactgaccatatgtcaggaagtaaaaaagatagacctggattaaaatccgccatcgaattttctcgtcctggagatacgattgttgtttggcggttagatcgattaggtagaaatatggaggacctcattaatattgttaattctcttaataataaaggggtaagttttcatagtctacaagaaaatattacaatggataaatcaagttcgactggacaattgatgtttcatttatttgcggcctttgcggaatttgagcgaaaccttattttagaacgttctgccgctggtagagaagccgcacgtgcaagaggaaggcttggaggaagacctgagaaattttcagagaaagacataatgcttcttaaaaccttggtagaaagtggtacgccaattaagtcgattgcggattcttggggagtgtcaagaacaacgatttataggtatataaataaatgaaaattttctcaatctccttatcccttactagaagcctagtattgattaaccgttcttttaatcgttgtaaatatttaaaagctcctttagtttcataaaggagcttttattattaaattagaagctattttttactaagttatttattggtttttacaactatcattccaattttttcataaatctttttataattatttagtaccatgaagaagcaaaatgtgattacaaacactaaaatacctggaagtatattatatcttatgagtaaattaattgagctactcccaagtccaatgtttccacaaatactataagctgtgaaaatccctgcaaccaaagaaattggtaagcgaaacttaggaaataatagatagtttcctttctcctctaaacttaatctttgatagaaatattgagcagaaaaatagaagagaaaagtagttagtataacaaatccatctaatatcagccaatgtgaataggtatcaaatcggacaaaaaatgattgataataaattccatcatttttattattgaaaatattgttgaagacattgttcaagatatctaaaatattttgctttatcaactctaatccaaagacaaagccgatcaaagataaggcgcctgtaatcccctgtcccaaaatagtcccagaaaaaaaacctaaaaaatagtaacaaatggcaactaataagatgcaaaattggtagaaaataattttatctagaggataattaatatattggtgaggaatgcgactataaagaatgactaaattaatgctaacagcagtaattgccattaataataaaggaattaacgacgtcaatatactgctttttaaaatttgttttcttttatacccagacgaaaataaaatctgtaaaaaatttgtcttgtaatttaagaaggatactaaaaatccagcaacaatgaaaaataagctaataagagtaaaaccacgaaacacgtttctggacgtaaacaaatatctaaaattagttaggtccagcgcacttcgcgtgtaaaataatttggcccttatataaccgtaaaattctttaaaagtctgtgattgaatatgaaacttaccagttttagaatcaaatttcagaaaaattcctgcgtcctggttctctgcataatcgacacttccttggtaatcttttgtttctttatattttttatttacatcatcctcttcagttttttgtgcagcaaggtatgaattataatggtctctagcctcttgagaatggataaagttttgctctctatgccaattttttgtggagttaaatccaataaaaacagagattaatattaacagtattcctaaacttaaaacgattggtttggctcgtttccaagtaattttgttcaattttttgttatccattctttcctcactctctttcatcagtcatctcatgacctgaaaacttgcttataaaaatatcttctaaagttaaaggaagttcttcaatcagtagtggttcacaattgtttattcgttccataagttcatcactataattttcaaaaatcactgtgcttactcggccttcatgagtaatatgcttcgcttcttgtttgataaactgaggtaattcatagtctttaaaagcaatctgaagtttacagattgacattttcactgtagaaagattcaatatagaaacaatagagtgttctttaataaaagcgacttggtccgctagcttttccaactcattcaaattatgtgaagctaaaataatacttctctctcgatcactgattgcatcgatcattaaatcaacaacctgtttccgtacgataacatcgagcccatcaagaggttcatctaagataatataggaacaatttgaacaaagcgcaataataacgaggagtaagcattgcatccctttggaatatttttgaaattgatcatcaggtaattgatgtttttcgatcaattccaaaaatctcttactatcaaaaagaggatataatagagaaaaataactctcaattgttcgtaatctcattttatttaatggttgatattgaggatcaaggaaaaaaatatcattctttagactaacctctttgttaatatcttgaccatcaattgataccattccttcatccatcaaataatgactggctatcgtacggaataaagtggttttaccagatccatttcttcccacaattccaaaaatacttcctagagggatggataaattaatatgtttcaaaacaacattaccatcaatcctcttacttaaattttgaatctccacttttactcctcctcctttatccactcatagattaaacttaatggaatttttgcatattgtgcttcaactaaccatgatttaagctgacttcttaattttttttgtgtctgaatatcaatttcttcatcctgaccatcattatttttaacaaaagaacctcttcccttaatagttgtgattacattttgatgctctaattccttataagctttggcaacagtattcgggttaacgcccaactgcttggacatctctcgaacggataggattttgtctccagcatcaagaatccctttggtaatctctttttttatattaaatacaatttgttcgtaaatggcatctttattattaggatcaatatgcatagttctcctttgctatgtgtactattatacaccatacactatacttgtcaagtattaattattttacacctatagctttagaataataatcaattaaaatttaaaataaaaaagctcacaactgttaagttatgagctggttttcatttcaaggcttcattgtttttaacaaatagtatataagtcctccaaataaaatgaagaaaacatccgataatatgactattatatttgtctctttatttatcaaaatataaaataaagataataagcctaaagatacagtactaataaatattggaaaaaaatttgttccttttttattttttttacgttcttttaattctttgttaataataattatacaagctaaaattaaaattgtaaatgcgtagtaatttttatctgaagtagtttcgtcaactttactttttaaggtgtaaaggtagtaaagaaatagtgggacaataacgaaaaatacgtatgttgtttttttcatggcgcatgctccgcaacttgaacatcccaccaattagaagagatcccaaatcgttttatattttatttttaaaaaaaatcctagtagagatgattattgttaggataaatataactactaactccacttttcctattaaaggcaatccaaaaccattaataaaaataaaaaatattacaacaatcgaaagtataataaatataatactataagaaacaagtaatcttcttaatacctcattagcattctgtgctcctcttaatctgagtgacaagaaaaagaccactgataatcctaagaagaaaattatgatatctatcattaaaactcctctcagatactattaaattgtttcttagtatcattaacttttgaaatgtagctataggccgttttcacaacaaacattaaattaacaccagataaaacgccaagcgtctgtaatatagtaactgcacccattatttcaggattagttgcagcaataactagaactaaaacaattgtggcccaatctcctgcaagagcagcatttatctcgtttcctaaaccaattaaatcatctacatcatccgcaaaattactaattggcgtatcccttgtagctggagcaaattttggagatttattattccaccaagctttgagaactaaattatctttactttgactgtaaccaaaatgatctttgtaaaaaggcgcataaactgtgattgaaggtttcatttcagaaaccaatcccttcagaacattattttgagggagtggtgaatcttgaaaaagataatctgttgggttaggagttttagggttataaagtgatacttttggactcaattgaggaagtgtcttcactttaatggcttctggattaggggcgctcgccactttctgttgagcaatcaccggcgctgttttcgtcgttgcgcttgtcgttactttacgccaattatgccaagttcttgcccacttatattgagttccctctaagttaaaataggttgctttagaagaaacatagaaagtatacccccaccatggattccacacttcataataaggcgcatgttttggctgtatattatggtctaataggtcatgtttttagtgcataattgtataaaacgtgtattttaccctctttttggttctaatgggttgccgtggtatactaaaactataacaaagaaaggactttttattatgaaatttaaatttaaaggaatcaattactacgaggactctgaaaacaattatgtcggcgcagtaaacacttgctcaatcgttaaagaattcgctgattttcaagcagcaattgattacgttgcagaccacaaaggatttttaattgctgaagacggaaaaactgctttcaacgtcttgataattactgaaattgattaaaaaattgaatgaaataaaaacactgacagacattgtcagtgttttttatatatttatatattagtaaagttctaagtaattatcaatttcccattgtgatacaaattgtgcatagcttgcccattcgatacgcttcgcctcaacaaagttaaccaaaacgtgttcgccaagtgcttccgttacgattgtgtcttcgcgcaaagccttaaccgcattgtgtaaagtagaaggcaaatctgtaattccatgtgctttgcgttcttcttcagtcatcacatagatgtttgattcaattgcttctggtgcttccaatttattttcaacaccgtcaagacctgctgccaaaagaacagccaaagcaagatatggatttgctgttgggtcaacggcacgaagttctacacgagttgacaaaccacgtgaagcaggaacgcgaatcaaaggcgatctgttacgtccagcccaagcaacataaactggggcttcataaccaggaaccaaacgtttgtatgagttaacagttgggtttgtgatggctgtaaagttataagcatgtttcaaaagtccggcgataaagctatgagcaacatctgaaagtcccatatctccagctggatcagcaaaagcattggcaccatcttcagtaaataaagacatgttacagtgcattccagaaccattgatcccatgaactggttttgccatgaacgttgcatgtaaaccatgtttacgcgcaattgttttaacaacaagtttaaagatttgaatattatcacacgcttttaaagcattagtgtatttaaagtcaatttcatgttgaccgatagctacctcatggtgagaagcttccacttcaaatccaaggtctgtcaatacattaacgatttcacgtcttgtatttcctgcaaggtctgttggggcaaggtcaaaatatccacctttgtcatttacttcaagtgttggttcgtaattttcattaagtttgaaaaggaagaactcaggctcaggcccaaggttaaagttcttaaaacctaatttctccattgatttgaggttacgtttcaagacaccacgtgggtcaccagcgaaaggttcaccttccggagtgtaaacatcacaaattacacctgcgactttaccatactcgtcaccccaaggaaaaacaatccaagtgtcaaggtctggataaagatacatgtctgattcattgatacgaacgaatccttcaattgacgaaccatcaaacatcattttgttttcaaataatttgtccaattgttcatctgttgctggaacttcaacgtttttaagtgttccaagaatgtctgtaaacatcaaacgcaagaatttgatatccttttctttgacgtcgcgacgaatgtctgctgctgtgattgtcatgctttactctcctagttaaattttcgctgtaaacttgcttgacaaattatgtcaaccaaatttacatccgcggttgggtaaaatgagtgggattaggagtcccgaatctcccttgttgggcaaattcgcgttcaagtgcatggtggacttctccgatagataaagtttgagcttttttagcatccctttttgcataaatttccttgatatccgcaatattattgccttcttgcagtaaatcagcaatatcaaaaagggcatctatgtcattgagcgaatacatgcgacgattaccgtcacttcgctctgggaaaataagctcttgctcttcgtagtaacgaatctgccttgcgcttaagtcagtgagtttcatgacagttcctattggaagtaccgccatagagcgtcttaattcacgttctttcaccaaatctcgcctccataggtatcattatagaccttgtctttcgcaaagtcaagcttcaatgtgagattttctcacatcagttctttttatttgaaatttattagacaattttatctaataatttttgacaacctgcattaactagttgataagtctcttgaaaatctcccgtaaaccaagggtctggaacgtcattatctaaaagcatttcaattttatgagccgttccagcgggcgccatctcccttagattttttaagttagattcatccattgcgataattttatcaaacgcatagaaatcaatgctagtaattttttggctgcttttatgaatatcaaagtcaatcccttgttctctcagcttttcttgagtaccactgtgaattagattaccgtgctcccaagaagatgttgcacgactttcaatgataaattcggactcgtgttctgatttcagcactaaatttttcatgacaaattctgccattggactacgacaaatatttcctaaacagacaaaaacaattttttccatgagttccttactttatataatttatagattaactaattttgagcatttattctattataccttatttcatcagatattactgacagaattctaaaaggaaaaagcttgccaaaatctgacaaacttttccttttagaatttctatcattcctcttcattataaacgtaacccaaatgctcataagctctttgggtaactttacgtccctgtttagttctcatcaaaaatcctttttgaatcaagtagggctcatacatgtcttcgacagtttcgcggtcctcagcaatatttactgccaaagtcccaattccaacaggtccaccgtgatacatttcaatcattgtgcgcaatattttttggtcaatataatccaaaccagcagcatcaacatcaagaattgtcaaggctttgtctgtaataactttatccactcgtccatcacccatgatttgggcaaaatcacgcactcgtttaagtaaacgattggcaatccgcggagtcccacgactgcgtaaagcaatttccatagcagcattatcaatgacttcaacctcaaaaatatcggctgttcttttaacaatttcctctaaatcacgctcttgataatattccatgtgactagaaataccaaagcgggcccgcaatggattagaaagcatcccagctctcgttgttgcgccaaccaaagtaaaaggtggtaagtctaaatggaccgaacgtgagccgtcaccagaaccaagcatgatatcaatgtagaagtcttccatggcgctataaagcacttcttcaatctgcatgggcatccgatgaatttcatcaataaataggacatccccaggttctaattcattcaaaattgcgactaaatcacctggtttctcaatagcaggaccagcggtttgtttaatattaaccccaagttcattggcaatcacaaaagccatggttgtttttccaagtccgggaggaccaaagagtaaaacatggtccaaaacttcttcccgcatttttgccgctttaataaagatttctaactgttccttgactttgtcttgaccaatgtattgattgaaaaattgggggcgaagagatttttcaatgccataatcctcttccattggctctttatttaatatatcattcatcgtttcgacttccttttagaaattcatgtgctgtcagtgcttttatcaactttaaagattcacttacgaataacaattacttctctagctgtttgtattttactgacagcctgatcacaggacaactagattttttgtcagtaatttttatttcatcataagttttaaggctgatttgatatattcttcactggttaatccggcttcttgctccaattttttctcaattttcttgagttctgtcgccttatagcccaaagcttgcaaagcttcaatggcttcttctaaagccagattaccagcaggcgcagcatcaagaagggaaatcccaacagctcctgtcgcatcaaatttcccagctaaatcgagcaccatttgcatggccgtttttttaccaactcctggaaatttcgtcaaatacttaatatcgctattatcgatagcattgattaaaccttcattgtcagctgccgcaataatagctagagctgactttgggccgattcctgaaacactaatcaggcgcaagaataaagctttttcggactcattaacaaaaccatataagctatgtgcatcttcccgaataacttgatgaacataaatctttacttctgtattcattaaagcagaccaagcataaggattggctacgctgataagataacctattcccgataggtcaatcacgatatttgttggggaaattttaactaattttccatttagatattcaaacattttttacttttctaattttttgattaactgaccgctgtcagtccttttcttttactcaaaatctttccaagaggccgcttttgaacgatgcgtttcttggatcctgcggaacattttttgaatgtcatctcctgaaaaatggacaatcgttggccgtccatgtgcacaactataaggatttttacaagtggctaattctctaagcaaagctctagcagactcggcatcaaggggatggttggctttgattgagcttttacaagcaaccattgcggctaaatcatgccgatattttttgagtgaaaattcttttgatgagagaataatatcaatcatttcattaattgatttctctatctcagtttcttttaaccaaatcggatgttctcttaatatgaattgattttctccgtattcttccaagaaaacccctgcttcatgtaacaaatcctttttctcagctaaaacaataaaatcatttttgggtaaagtaaataaatatggcgcaagtaaaatttgttgctccatgctcacttcgccgattttatctttccaatattcatacttgattcgctcctgagccgcatgttggtcaaccaaataaagaccctcttttgactgacaaagtaaataagtcgcatgcaattgtgccaagtattctagttggggaaaagttgattgctgactcagcttctcaatattatcaaaatcaactccaaagttactgacagaattttttggggttctgtcagtaaattcatttgaactttcgacagttctgtcagtaattttttcactgacagaaccagtttctggctgattaactgtataatcagtagaattttgttcagtcagagaatctgaattatcgtttttattgatttcaaaaatcgcttcttctctgacaaaaaaatcttgacgaacattgtcatagtataaaggattattctgtaaaggaagttccgtttgaacagaaacagtctctttttccttgactctaccttgcaaattttccaaagcttctggaatcaaaaccccttctgataaggcctcatcaatcgctttagaaattaaagtcatcaattcacgttccttagacaaacgtacttcttgttttgtcggatggacattgacatctgctaatttagggtcaattttaattgataaaacagcaaaaggaaaacgtccaaccatcaatcggttcccgtaaccttctaaaattgctcgattcaacaaaaaattcttgataaatcgaccattaatcaaaatcgtgatatagttgcgattcgctcttgtcagctcgggtaaactgacataacctgtcagttcaaaatctaagtccgagccattaatctcacgcatttttttcgccgttccaatgccataaattgcagcaatcacttgacgcaagtctccatttcccgccgttttcaaaaattctttaccctcattaaccaaagtaaaagaaatctctggatgagcgaggctcaaacgattgataatatctgtaatatgagaaagttcagcctgtaaagacttgatatacttgagccttgctggtgtattataaaaaagattcgcaacagaaatttttgtccctaaccgctttgcaagtggttctaaagtttcaatcgtcccacctttagcaatcagttttgtcccagcttcttcctgagcattacttgtttcaatcgtcatctgactgacagaagcgattgacggcagagcctcaccccgaaaaccgagcgttctaattcgaaataaatcagctgaatctttgattttacttgtcgcatgacgacgcaaagccaaagccacatcttctttttctaagcccaaaccattatctgtgacttcgattaagcgcaggccagcctcttcaacactaacggtaattttactgcttccagcatcaattgagttttcgactaattctttgacaacactagcaggccgctcaaccacctctccagcagcaatttgattggcgagcgcttcatttagttcaataatttttcccacaataatctcgctctcttgtttttataaaattaattctaattataacacaaaaagcaagggctcgcttttcattttttactgacaaaaaatgatagacaagatgaaaattgtctatcatttttgcattaattagtagtttccaaaatcgcggtaaccattatcaaaattattatagttgttaaaagcaaaaactaatatgaaaataagaatcaaaattgaaatcacaaataatacaattccaataatgaatgcaacaaatcctgctcggttccaaccgtccatgaccttacggaactcttcctcatcacgatatttattatctcggttttcaagtgcccatttttcaccatggaaaccaaaaacaatcatccatacaatcccaaaaatccaacctacccatggtaccaaagtaagtagaatcaaaagtcccaaataagcgcgattggcaatcccaaaccacattgttaaagcgaaagctccccagttccatttggtcttaatttcatccccctcttcagataaagtctgaacgggaatatcagcgtaggcagattgtttagataaatccggacttacaattgaactaaaatcagaagtttcactttcttcttgaagaggttttgaaatgacagcttcttcaatcaccggctcagaaacttctccttctgcaatcactggttctgagattatttcttctccaatttcagctttagaaggctcttcttgtgaagtctgattttcagttttcgcctctactactgtctcttcttgtctttcaggactctcattgatttcttgtccttgaatctctttttcattttccatgttagctccttttttcgttagctccgctcaattcatttttaaatgaatttcttttaaacaattatagcgttttttcttaacttatttgtaaaataagcttgttacctaatcagagtgaatctttaagttcccacaagaaattcaaggcttctcttgcagtcatattatcaacattctgtccttttattttttcaataatttcagaagaattttcagcaaaatcaaataaactgagttgttcttgttcgtcagcaattttttttgctggtaaaggtttattttctaacttctgcaaaatcaaatctgctcgctctaacaaagtctgtggcaggccagcgatttttgccacatgaatcccataggatttatcggctggtccatctgtaatcttatgcaaaaaggttacatttccattttgctccaaagttgcaacatgaacattatctaaatgatcaagttctttgtctaaatcagtcaattcatgataatgagtagcaaaaagtgtttttgctccaatatattcgtgaacatattcaataatcgcttgagcgagagccatcccgtcataagttgccgttcctctccccagctcatcaaagataatcaaagagcgacttgtcgccttttgaatggcatgattggactcagacatctcaaccataaaggttgattcccctgaaatcaagttatcactggcaccaatccgtgtaaagatggcatcaaaaattggtaaattagctgttttggctgggacaaaagatccaatctgagccataatcactgtcagagcaaactgacgcatataagtcgatttcccagacatattcggacctgtgatgagctgaatatcagtttgttcaggcagttcaatatcatttgggacatattcttgagctcccatgaccgcttcaactacggcatgacgtccccctttgatttcaacaattcttgagccttctgtaagcgtcggacggatatatccttgtttttctgcaaccacagaaagactttgcagacagtcaatttcagcaatagttttggctagagcttgaagtctgccaatatactgttctgtttcagcccgaagtcccatgaataaatcatattccagagaagatgatttttcacgcgcttccagcataatttcttcaatttcagtcaattcctgagaaccaaaacgctcagaatttttcagagttgccttacgataaaaatgttcaggtacactattcaactgactttgggtgatatggaaataataaccatccttgcgattataatcaattcgcagtgtagaaatacctgtttttgctttttcatctgcttccaattttgcaatccacgaagttccattttcaagagcctcacgatatttatctaattgaacattgtagccttttttaataatgcccccttcggtaatcgttcttgaggcattttcactaatggcagaattaatcaagccagacaattccggaatttcatctaattggcttcttaactcatttaaggacgtttcatcaagaacttccaaaatatttttgatggcaggcacatttgataaggaattagccagctgcaaaaagtcaacaggaacagccttaccaaaagaaacccgagaagctaaacgttctaaatcgtaaactcctttaagtgcctctattaaatcagaacgttcaaagaaatggtctaagaaaacttggacaatttccattcttttttgaatagctgaatttgaaactaaaggacggtcaatccacgaacgtaacatgcgcgtccccatcgctgtttttgtttcatcaagcaaccagtaaagggtcccatgttttttgttttctcttttatttgctgtcagctctaaagaagatttcgtcgcaaagtccatttgcaaaaaatctttaatttcatagtgctcaacttcttgtaagtgactcaagtcacgcatttgcgtttctttaacataagccaataattttgaagcggcttgattttctaaggcggtcagtcctgataattctatcagtaaattttcaggaatctcaaattgttctgaaatcaaaagattcatttgtctttcaaaaacttttacttgagcctcatctaaaggaaaaccaacaacaatctcacgcgctttgagcgaggcaatttccccgacgactgctgaaaattcactgagttccgttactttgaattccccagttgataagtccatataagagagggcgtaacgtttagctttaaaatcaatcgctactaagaaattattatcaactgaatttgcagtatcaattgtcgtccctggtgtaatgacttgtgtcacggcacgtttgacaattcctaccgcttttttcgggtcttccatttgctcagcaactgccactttatagcctaagtcaaccaatttatcaatatattcagttgccgcatggtggggcaccccagccatcggaattggattttcggaattcttgtttcttgaagtcagggtcaactctaatatttgagcggcatttaccgcatcctcatagaaaagttcataaaaatcacccatccgaaagagcaaaaaagcatcgggataatcctgtttgatgtctaaatattgttgcattcctggtgaaattttttcagccatttttttcttcctatcccatctaaattatactgacaaaagatactaacctatctgtcagcaagtctgtcagtattttttcattacatttctactgacagattttcttcagcattttttattcaccagttcctagcaaaagatttactttttcttctaattcaccggtgatatactgcaccaaatcattcacatcttctaattttgtggcataatcctcaactaaggggtgatgtttgattcgtttttcaatcatttgggcagcttgtgatgtttttttataggcctgtattttgccaattttttgatataaaacagcttctttttgtaaatttttcatttcatcttgtgatttaaaaagttcttgatttgccatcaatgcttcttctgcttgttgaaattctttaacataatcgagatttttaattttcttaacaagcaagtccactaaatcatcatagtgcattctcaagccctccttcaattttcattaattactaattatttctttcattaaaactcttagactttataagataattataacattttttcaatcaatccataacctgttttttgatatctgtaaaaaaagcctgaataatcaggctttttttattttgactttatcattctgggcgatgtccctctggccaccaaagtttaatcaaagcttgtgttccatcattttcaaaacctttgtcagctaattgctcataaagttcctttgcccctttagttgccggaagttcaagattcattttatcagcctcagcaagtgcaatccctaagtccttgatgaaatgcttaacaaaaaatccagcactataatcttcacggagtatacgaggaccataattagctaaagaccaagtggcacctgaacctcctccaacagtatttaaaactttgtccaaatctaatccagctttttgggcataagctaaaagctctgtcattccagtcattgttcctgcaatacaaatttgattagccattttggtatgttgaccactcccagccacaccttgatgagtgattgtttttcccattttttcaaacaaaggcaaagctttttgataagttgccaaatcactaccaaccataatggtcaatgtcgcatttttggcccccaaatcgccaccagaaacaggagcatcaagtgtaaaggcaccagcttttttggcttcttgataaatttcttgagccaaagtcggttcagttgtggtcatatcgataagaatttttcctgaacaatcattttaaaaaattccttctgtaccaaaataaacttcgcgaacatccttaggatatccaacaattgtaataacaaaatcggcttgggatacggccttttgttgattttcagcataaactgccccacgcgctacaagaccatccgtttttgattttgtacgattatagacaattaaatcatgcccagcgtccatcagatgacctgccatagcagctcccatcacgcctgtaccaataaatgcaatttttgacataagctctccttttaattatcagacttctaaaatctgtttaatttagttttggtaatcacgacgtttacgggctttatcaccccgcaaacgtttgattttccgattacgatattcatctaactgataagttttcaaccatttttcaatagccactcgtgaattccctgtttcttcgccaatacttgataaagaacgtaaaggattttcatcaatgattttctctagttcttctcttgttagtctagtcataattttccatctcttaaaaagctcaaaagagcaaaaaacggccagcttccagccaaccgtccacttaatcatggggaagaagggatttgaaccctcacgcgatttctcgcacatgcacctgaagcatgcgtgtctgccattccaccacttccccttcgggtcataaccttgtccttttacgtaagtcgcttaagtgactactccaaaggcacttccccttcgggggaccttatcctttttgtaactcaccttgatgagccgtaagagataagccccacaacacttttctataatatcagtttcatagaaaaaatgcaagttgaaaatccgctatgacgccctatctaagcacctccatgccctacaaacattgcaacaattaatataatcaaaaccaaagttgtaattgccacatagagtttatctccttctttagcaaaagccacaattgaagcaaccactcgcaaaacaggagtcaaaattaagaggaataaaccagtcattaaccaagccaatgctttaaattcaactaaaccacttaaaatttccttaaatttatctggccaaactccttcagcgtagcctgaatgaccacttaaaagaaacatcaaaattccaataataatgactgtagtactcacgaatacaccaacacgaagaattttcccgatatttcgctctattttgagtaattcttcttttgtcaattctttacttaccattagaatgatacccccaatcctttaagcaacatttgcaatgccataattaaaataactggaatgaaaatcaaacgaattgttttcgctggcaatttaggcataatttttgaacctaaagcagcaccagcaacaatccctatagcaagaggtcctgctaaacttggattaacataaccattgaaaaaataaaccgttgcagaagctgccgccgtcaccccaatcatcaaatttgaagtcgctgttgacgcttttaaaggcattttcatcattgaatccatcgccataaccttgaagacacctgaaccaatccccaaaagtcccgatgccacaccagcaccaagcataacagccgcaccgccaggaactttttctacttggtaaggaatctctttgccaagttgcttatcataatagcttgagtttaattttaatttttcagctattttatctgactcaacattttgaacgacttcttcacctttgtgcatttttcgccacatattgtagccttggaaaatcaaaaggcaaccaaataagatattcaaaatcgtagcatcaaaaaatccagctaggactgcaccaactaaaccaccaattgtggtaaatatttctaaaaacatagccgtacggacattaatcatatcatctttcaaataagaaatggctgcaccagaacttgttgcaataacggcaacaatacttgcaccaatggcgtatttaatatccacaccaaaaaatgtcgtaataacaggcgtgataataattccacccccaagacccaaaattgagccaaaaacccctgcgacgaaaccaagaagtaacatcaacagagtaaatactaataaagacatgtgttctccaatctaacatccctattctaccaaaaactttttaaagctgcttgttcgtttgattaagaagcttatcaagaacatttaaatcttattctattttttacaataccaatttatgatataattcttataagattaatgcttcacaagagtttttgaggcaacttattggaggttaaaatgaatagacaagaacttgaagcgcgacttcgtcaggagttagccattcgcttttataatgctaaagtagccgaacgtgaatatagtgaggctgagtttcaagaaatgaaagcagaacttaaagctgatattgaacagtatgctcatgactatgtcaacgaaagtaatgctaatggttaaattttactgacagaaattctaataagtctgtcagtgaattaggatttctaattttaatgatatctagctttttatttctgtcagtaaataaattattgttttttaaaaaaggaaaaaatatgaccgaacaaaaacaagcacttttcaccatttttggagcaactggtgacctcgctaagagaaagctctacccttcactctttcgtcttttcaaaaaaggcgaattggctgaaaattttgccgtaattggaacagcccgtcgtccttggacaaatgattattatcgtgaagttgttttagaatcaatcaaagatttgatgaattcaaaaacagaggccgaaaacttcgcaagccatttttactatcaaagtcatgacgttagtgacagttcacattatgttaatttgaaagacttgggcgaaagtctacgtaaacaatataaaacagctggaaatcaagttttctttctcgccatggctccccaattctttggcactattgccgaacacctcaaatcagaaaatattttgacaggtgaaggttttgaacgaatcgttatcgaaaaaccattcggtacaagttacaatactgcaaaatcactcaatgacagcctctctaaagtttttactgaagaacaaatcttccgaattgaccactatctcggtaaagaaatgattcaagctgtttcagctgtacgatttgccaaccctatttttgagtctatttggaataatcagcacattgacaatgtccaaataacttttgctgaatttatcggcgttgaagaccgcggaggttattacgaaacttctggtgctttgaaagatatgattcaaaatcacgttttacaggtcctcagtctgattgcgatggaaaaacctcaaaaatttgatgaagcccatattgtcaaagaaaaagttaaggcactcaataccatgcgtcaatattctccagaggaagctttaaataactttgtacgtggtcaatatgtagctggtcgctttgatggcgaagattactcaggctatcgtgaagaagattccgttgctccagatagccgaactgaaactttcgccgcagggaagtttgttattgataacgaacgttggtcaggtgttcctttctatgttcgctcaggaaaacgaatgactgaaaaaggaactcgcattaatattgtattcaaaaaagaccctgataatctttttgctgacaattgcgatgaccagtctgtacaaaatattttaactatttatattcaaccaacagaaggtttttcactttctgttaacggcaaagcagccggtcaaggtttccacttagaacctttgcgcttgaatttccgtcacgacagtgaattccttggaaattctcctgaagcgtatgaaaaactctttttagatgttcttaatggagatggtacgaacttctctcactgggaagaagccgctcgtgcctgggaacttattgatgttattcgcgaagcttgggataaagaaacctctgaactcccaacttatgccgctcgtactatgggacctaaagctgcctttgatttactcgaaaaagaagggcatgaatgggcttggcagcctgatgtctggtatcaagaacgtggttactacgataaataataaataaaaaatcctatcagtaagcaagataggtttttttacgttttccacaaacttttacacagttttccacatatttgtggaaagacttcacaattctgtggaaaactttatgttttcaatagtaaaataggataaaaaaaggactttacttgtggatttatttttccacaggtaaaattccttttaatttttttatagacttgttttccacacaggttcaccgtcacgttttatcaatttgctccaaactcgtcgttcacgccaacggttaacttgagtactccaagcatctgattcgaccaaaggtttcaccaaaatacttctcacgccagctctgtgagcagctctgatatctgtcattaattggtcaccaaccataatcacattttcaggacgctcatcaagtaatcttaaagctttttttatcccccaggcaaaaggcttcattgctcgccagatataatcaaccccaaacttttccacagctcgagcgactcttgcttgtttattatttgatacaacaacaactttcaagccattctcacgcatttctgaaagccaagccaaaagctctggagttccgtcaggattatcccaggcaattaaagtattgtccaaatccaccattactgcacgaacatttagtgcttgtagacgtttcggatccagttgatagacagcttccactaaataatcaggcttataattatcaattttcatgcccttattatatcaaaaactgacagaaattcctgttttcctccctagaattactgacagctctatcatcagtaaacagaatcatcaaattaatgacagaagaaaaaagtcgcatcaagcgactttttcttatttaaacttatcaaagaatccttttttaccagaaccagaaacttcaataccacttgccttggcaaaagcttgaagagcttctttttgagcttggttcatgttcttaggagtgacaatattaataatgacatattgatcaccattaccagaaccacggagttttggagctccttttccttttagacggaaattagcgccagtttgtgttcccgcaggaatttttaatttcacattaccatgtacagttggaacttcaacttcatcccctaaggccgcttgaacaaagtccatcggcatcttatagtagatttctgcgccatcgcgttcaaatttatctgaagcttctacttggaagacaacatacaaatcaccgtaagggccaccatttacaccagcatcaccttgaccttgtaaacgcattttttgaccagtttcaacaccagcaggtacagtcactttaacagtatgtgcaactttttcatgacctgaaccatgacaagttgtacatttttctttaatttccttacctgttccatgacagacatcacaagttgtttgagtttgcatccgaccaagcggtgtatcacgaacaacattaatttgtccacgacctccacacttatgacaagtttccggatgcgttccagctttcgctcctgagccatcacaagtatgacagagttcttcacgattatacttcacttgcttttcaacaccgaaaatagcttcttcaaattttaaattgattcgatattgtaaatcatcaccctgacgtggtacatttggattaacttgcgctcctcctccaccaaagaaacttgagaagatatcctcaaaaccaccgaaaccgccagaagctccgccaaagcctgagaatccagaagctccaccgaaaccgccgccgccaaagccaccattagctcccgcttcaccatattggtcataggctgctcgtttttgttcatcagaaagcgtttcgtaagcttcttgaacctctttgtacttatcctcagcaccctcttctttatttaaatcggggtgatattttttggacattttacgataagctttttttatttcatcttgactggcatttttatcaacacccagtcgttcataatattcagtattattcatttctaaattactcacttcctttactaaatcaatttttcaatagcactattttaccacgtttttccacttttggcaaaaaaattagcactctttttatcagagtgctaattttattttaaaaattcaatcgcaaattgatttgtttcattgtaaactgaggcaaccgtagattcagctaaccagtatttccctttgattgggtcagttacatgaaactcttttgtcgcttcattgtagccatctaatattactgcatgagtattaaccacgaccttataaccgtagtattcatcataagtaatatcaggactatcaaaatcaattgtcacccacatctcaactaaatgttctgatagaacagcttgttcaattgcatccagactctgaccagacaaatcagccacctgaatattattatcttgagcgaatttcatcagaacggctggccaaattgtcggaaatcctccatcaggaatctcatcatcagctggccacggattcccagcataaccactgttaggatcgcctccccagccaacataaggtaaatcttcaatccaatcagtcactgttttcccttgcgttttatccagataaaccagagcattataaaaagaaacaatttcacacccctggtaagcaccaatgttaagctgatttatatttcctgttttcattaaaacataatcatcttttccttgactatccgttttataaaatgttttggatgcagggcttaattgtttgtcctcttgattttttggattcaacaaataggtcacaagaactaacaaagccacaagaacgaataaaattacgatattttttttaaaaagttttttctttttaattgtcatctagtaggtcattttttcccatcatggataaagttcgatgtacagtttcagcttgtgcatcaattatattatattcttttgttaaatcataagcatcatacaaaactgacagttctgtgcagcctaatatcgttacttcacagttcattttagaagcaacatcagataaaatttcatgataaagttcaaagttgagatttctattttccttgacttcttgataaatcaatcgattaactttttcttgtaactcttcatctggaattaccgcttcataaccttgttcttccaaggcctcacgataaactcccgtcaaaatcgttccttctgttgccaaaacagcgactctcttagcatccgaaaagtgacgaccaatactatcaaccgcaatccgaggcatatgtaaaattggaatctctgtcgccttttgcatttcatcaaaataataatgagcagtgttacaaggaaccacaaagaactttggtgaaagttgactatgaatttttatatcatcaatcaatttttcttccggattttctaatgaaggatttttaatatactctgtccggtcaggaatcgtcgcatggttaaccacgatataatttaaataatcctgatcacgatgagcttctgttcgtttattcaaagtatgaataaaactttcggtagcaagagtacccattcctcccaagattgtaaagaagttttccatcacatccccctgtccttcttattcttaatttttatttgtgaaaatatgttttaaaggccccaatataacgatggaaagcatacttcatcaaaaggtaacgcttaggagagttatccttggaataaaataaagttgttccatagtttcctgagctaacaaaacgacgaatttcctctttaaagctcggattcacatatttaagcaatacttttttaggaactcccaaccaaagcttagtccctttaccataaactgtttcagtaaaagcttcgttgtaaatacggtcagccaccaaataacgggtcaaattatacccatttaaggtaacataaaatgaactgcgcccttgacgtaagttaatttcaaaaagtttataagaaccatcacgcggatcatacttcatatcgaaattcgcaaagcctgtgtactcaattttctcaagaaattcctgaatttgctgatagacttgttcattataatcaggcaaaatcgcaacatagtttccaattgcttttggacttggatcttcaagcaaaggatgacctaaacacatcattcttaccttatgatttttatctacataagcattcaaaacgcgcatattttcatcgccaccaggaataaagtcttggataatcatttcatcaggataaccggcttcataacaacgatgaagcattaacttcatttcttcatttgattcaatcgtgaaagccttcttttgtccttcaaaatgaacgtccaagtaagaaatggaattccctggttttaaaatcattgggtaagggaaagttaaactgtccactagagaatctatttctgattcaggattaaccaataccgttttaggatatggcaagccatactgctcacagatattgtaaaaatcaggtttattttctaattgttgataaagagagtactcaatataaggcacttcaaaaaattcggaaagttcatcacgatatttcgaagcaagtaaagcatagccatccccacaagccactaaaagatattttttatgatcatccttatgtttacttgcgaaatcacgaagaacttggataaaagtttcctcatggtcaaaattttcatgtgtttgcacttcaacgattttcgaatactttgtgggtgccaatccagaagcacttaaagcaagggaagtaatcccaaattcttcatgaaatgaacgagccattccatatacgttgatatcagaacctaacagaataggttgaaattcaattgtttgtgacacaaaaacctcccttaaaaattaaccacagcaggtttttcaccattattgatgaagtaaacatcataccaagtcaagaatgaataaattgtccagagtttacgacgagcatcatttttatctgcaaagttatcatccaacatcttcaaaagtttttcttggtcgaaaaattctgcaacaaagtcttgttcaaacaattgacgaacaactttataatacttctcttcccttaaccagtctttaattggcactgggaatcccaattttttacgatttgaccattcttctggcaaatgacgacgagctgcttgacggaaagcatattttgtattgtgttcattcaaaaggaatttagaaggaatttgttcggctgtgtgcatcaattcaatgtctaacaatgggacacgtaattcaagtgaatgtgccatagccattttatctgctttaagcaagatatctcctggcatccattggtgcatatcaagatattgcattttacgaagttcagaaccttctggtgcttttttataagtttttccaacaatttctttgactgttagagccgcttgaaattcttctttcaaaagctcaactgattcagactcatcaaatacttttgcttgcccgatgaagaagtcctcagctggtgcaagtgattcatatagatgcttttgtcctttgaaatgtttattttcaattccacgagcaattgagaaacgtaaagattttggtaatttcttcaaaccttctgcaaaaacacgaaccgcgcgagaattggtactaaatccataagactcataaccagcaaagagctcatctgctccttcaccactcattacaacccgtacatcacgagctgccaattcagcaaggaaaaagagaggaacacaagaaggatttgaatctggttcatctaaataatattgaatttgtgggaaatatttaaaagcttcgtccccatgaatttcacgagaagtattattcaaaccaatcatatcagttaattgtttggcttgtttagactcattgaaagttccttgaccgaaaccaatagaataagtgtgttcaggacgaagcgttgaagcaacataactagaatctacaccacttgatacaaaagcacccacttcaacatcagcgaacttatgagcatcaacagaacccaaaacggtcttatcaatcaaatcaattgattcttccaagctcatatctttttcatcaactttcatatcccaataaggcttaatatctaaaaccccatctttatatgtaaagtagtgtccttctttgatacgaaaaacatttttaaagaaagtttcatcaagagcagaatattggaaagtcatataaggtttcaaagcttctttatttaattcttttttgaagtttggatgtttcaaaaagcttttaatttcagaaccatacatgaaagttccgttcatttgagtatagtaaagaggcttgatcccgaaatgatcgcgtgcaccaaacaattcttgtttttctctatcccaaatcacgaaagcaaacattccacgaagtttttgaagaagctctacaccgtattcttcgtaaccatgtaaaagcacttctgtatcagcatgagtagtaaaatcatgacctttagagataaggtcttcacgcaattcacggaaattataaatttcgccattaaaggttataagtttagttttatcttcattaaagataggttgatctccaccctcaaggtcaataatactcaggcgacgaaaaccaattgctgctccttcgtcaataaattcacctgaactacttggacctcggtgagcgattgtatccatcatttcttctaaagtttttgatttatcattttgatccatccggtcaataaagccgacaattccacacatttgtatctatccccttatcatttttccttattattataccacaataataaaaaatgatttgacagaaggaaaattattccccactatcaaaccactattttttatttattaagacttttttctagtttggcatcaagaaagtaacaccagacgcacttacagtacgttcatgtccccaccaagttgtaccatatccgccttctttgatagtaattgtaccatctgaattaactgattttacaatagctacgtgaccgtaaggtgagtttgcatatccaacaaaatcagctgagaagcttgatacgataacaccaggagcagctcctacaacatggagtacgccttgggcaggtccattagaagcccattgtccaccattaccaggcatgatatttctgatataaattccttgtgcagcaaagtattgccatacatagtcagtacatccaccaccagcataaggatttccaattggtgaactatttataccgctaccaccagtagatggaggtgttggtgttggtgttggtgttggtgttggtgttgtatcattgttagagctagagctacttgatgaagtagaactgcttgaacttgatgatgtattattgctacttgtacttgaactcgattgtgaagcttgtgcttggctagatgaagcagaagctgatgaagttgctgcttctacagctttagcagttgctgctgttgaagctgcttgtgcttgtgctgcttctttttgttgagcttcataagccgcttgttttttagctgcttcttgagctgctttttctgcagccgctttttcatctaataaagcttgttttttatcttgtgcagttgcaattgttgcttgatagttcaaagtcgcaactttgagttcagcttgttgtgaagtcaattcttgagcttgagaatccaaactttgtgaaagagaaacgaactggttgtagttctttttaacagtttctgacttttggctaagctctttttgctctttttcttgttgttccaacatttgtttgttggcactagaaacagtagcaatagctgttactttttgaataacatctgtcaaagattttgaattaacaacagtatccatataatttgttgctgagctgttaacttgagcactacgtgcttgagcttccaatgtctttgtgcgttctttgatactttcgttcaaagtagcaatttgagcattaagtgctttagcttcgctttcgattttagcgatttgtgctttagtacttgtttgcttttgttgtaagctgtcaacttttgattgcaagctatcaacttgtgcttgtgcttgtgctttagcagattgcgcgcttgaaattgtcgcatcttgtttagcaatatctgaatttgtgtcagcgtaaacccctgacaacggcgctgcagcagaaagtaccactgtagacattaaaatagctgagataatcttttttttcataactgttcttttttaatttttcctcccattaagttcggttgaataaacatattatactattcctgccccaccataatatttctttatgattacaaaacactttctaattgtatcttacatgacttttctttaatctgtaaaagatttctaaagggaattgtaaggctacagctaagataatattgagcaagagtgtaggcgctaactggtaaacaacaaatttgataaactgaagttgggcaaatccgaaagctgtcataatgattgcactaaaaacctcaaaagcggtcacaataataattgttgtaaaaagccttgtccagcgattagtaaatatagttatttgtatattatatacaaaaagagcaataagtgggaacaataaggtcgcaattccgtaaatacctaaataatagctatcatagattgcacccaaaatcgccgctaagataacgatatagcttggtctgtgctgagtgacactatacattagaaaaatcaaaaataaatgactcactggtacccacgtcccactgcttaaccccgttaaaagatgggtaatctgaccgtccaaaatcattaacaaaaaaagaataattggactaaaaaattgaaatgtaaatcgactcactacttaattccttgtattctagttattttctaaacaaattgatgtttatgtttaacctgtaaaaagtcatcttttaaattactgaccgtcaattttgctcttaataacaaagacaaatctaatatcataaagattcgtttcgggtttaacatagaccattttgccaagtccatcactgtcttgcttttcgccaatgacagtccctatcaaaagtccacttggtgttccaccctcactgcctgagttagtacccaaaccactggtaaataccgaatcaccatttttgaattttccttgagaatctatattcttaataacataggcttgttgttgagaatcataactactcaaaataccataaattggagaaccgtcactttcaattctgacaggaattttattttcaattcctttagatgagcttaacagagcaacttttgcgctacttttattgacttgggtaacgcgcccgacaacaccaacattcgccattacaatcatgccatttttcaagccatccttgcttccgctatcaataaccagtgtatcattccatgacgctggctcacgagtaatgacattagctgcaactgtctgatagtcagtaagtgtttcttgaagtttcagagctttctttaattctttattctccgactcaagaccacttaatttattatcatcatcttttgattttgctagttgtgttttcaggctttgattttgctgataagtatccatcaagtttgaaagctcatttgctttgtcttgtacaaaatggattggtgcaacaagaactcggtcaacaaaactcgtcccgtcattaattgtttgggtcattgctgacggatttttattggacttaaaatttttggctgaaataaaaattgctgacatcgctgcaataatgataatgagtgcaataataataagcttacttaagttaatttttttcactattctaggttcccttcagtaatatgtttcaaacccttctcttttaggttcgaaagccatgtgatttcacatcgctttttgcccaatgcaaaaacacctcttataacatctctcttcttgaattatctttttttcactatgatcattgtataagttcttcttactcgtaccttattttatcaaatttgacagaattttgatagaatagtagtaataaatttttgtaagcggttttcacatgatgaaatatttaacttttatcatgtaaatcaatttggggggaaaatttttatgaatcatattccagtttttggcgaaaagaatgaaggaaaagactatcaagcaagatatggcgtctactcaattgtagcaagagagaacaaagaaatttgccttgttcaagcccctaacggagcttactttcttcccggaggtgaaattgaagctggagaagatcaagaaaaagcgcttcaccgtgaacttatggaagaattgggagctactgctgaaatcggagaattcctaggccaagctgatgagtatttttatagttcacatcgaaataaatatttttataatcctgcttatatctatgagactaaaaatgttcactttgattctaaaccactcgaggatttcaatcacatcagttggtttgatccagaaacagctatcagcaaactcaaacgtggctcccataaatggggagttcaagaatggttgaaaaaataaaaaatcgtcagtaagacgatttttttattgactgattatttttactccgtcagaaccggcgacaatcacttttttcaccatatcattaaagagaccatgttccacaactccgaccattaaatcaagttcatcagcaagtttttggggattttcaatttttgcaatatgaaggtcaataataaagtgttgcatatctgttattaatttctccccttcctcatttaaacgccaagtgggagcataagcagctctttcaaactctttaaataattgctctgagccataacgaataacttctaccggaactttaaaagaaccaagattttctgataatttactctcatcaacaatccaaatataatcttttgagtaagtggcaacgattttttccattaaaagtgccgctccgcctcctttaataccattcaagtgagaatcaatttcgtccgctccatcaacagtcaagtcaacataatctacttcatcaattgaagctaaaggaattcccagcgcttttgcttgttcacttgtcacactagaagttgtcacgcctgtaatttctaattgttcttcagcaactcgtctccctaattcttctacaaaataggctgctgttgaccctgttcctaagccgacaaccattcctgatttaacaaattcagccgcttttatcccaacttgtttttttaaattttccattttacctccttgaatatttcgatatcacgctgacttaattatagcaaaaaagctacttaaagtagcttttttatttatttatattaactaatatattcttcaaggtattgaggattataaatcataattttattatcaatcactccaattactttttcatcctttaaatcatgaagaatacggttaacactatttcgtgtagaaatgccacaaaaacctgcaatatcttcattagtgacagtaaaatcaatcagaattccatctttttttcttattccgaaatcatcaatcaaactgtgaagacaagcgcaaaccgctcccttcttaccattgattgtcatcttttgaagaatttctaaattaagtgctagtcttcgtttataaaagtcatcaacaactctgaataaattcaaatcctcacgaacccaattccaaaaatcactgcgtgaaattttgtaaaaactggctgttggagactcaattcgtacattaaataatgctgaaattccatcgttttgtttctcttccaataaagaaacaaagtctggctccgcaacataggcaatattaaattcacgaccatctcttaaaatattgctaatcttcgctacaccatctttgagtacatagatatattctgattcaatcccttgatacatgatataactatgttttttgcgtgttacaatactcacttttttttgttccagtgtattgattagatattcaatgtttacgtttgccatttctttcattttaaaactcatctactcgctattttttattcatttatttcgccatatacagggctgtagcccctttattataacatgttttatgtaaatcatttaaatcaaacttcagagctttatttttgatgtttaccgtgaataagatagtatattatccaaacaattacaactgctggcgcactataaagatataagtttcggaaacctatcatcccatttcccaacatcggaataatcgctccaagaacgattggtcctccaccaacccctaagtctaaaaagccaaagaaggtagaagttgcgacaccaatacggtccttacttgaatcccgaattgcaattgcttgaccaaatggtgcgacaccaccgtacccaagtccgaaagctcccccagcaatcaacaagacaacgaatccaatggctgggctaaagaatccggcaagtccaacaagaagcatggcaacagcaaagaaaataaaggttggattaaagatccagttatcacctttagtatcgaatagacgaccagtaaatggacgtgatacaaaaattaaaattgcatacacggtaaagaataatgaacctgcaagtggaatcttgaggtctgtagaaaatgaacccattcccgttaagatggccgagtcaataaatccagctaagaatgcaataattgagataggaagagctgatttttcaatataacgctcaacccctttgggttcatgttctaaagcataggcacgctctgcatctgaaaattctttgacacgaacaaagaaaatcaagatgaacgtaacaactagcaaaccaagagcaattccaagtaaagagccaaagccaagtgaagaataaatcatgattgataatgctggaccaactgcagctgcaagggtaacggataaggcataataaccaatcccttcaccacgacgtgaagctggcacaacgtgtccagcaattgttcctgacgccgttgccccaatcccaaaaccagctccttgaatcactcgaatcaaaaagagtaagggaatattggttgtcaaataatagccaaaggttaaaacaagaaaaataattccaccaatataaagcaaacgtttcattccgatacgtgtgatattaatccctgtccagacccgaccaataagggccccgataacaaaaacgcttgacaaggaaagacttacaactgttgattgatgcagttgttgaagtgcataagttcctattgaagaagttaagacataaaaaacaatataaaataaaaaactaataagcgtgttgattacgaaagtaggtgtaaaaatactttctttttccatgattttttccatttctaagtaagagcttctgctcttttttgtaagtgaattaagtaaatatgttattttctaacgatgagtgtgttgcatttggcatgattaacaatatatgctgcaactgacccaacaactacacgctctatataactaatccctgttgcgccaataacaatcaaatcgacgttctcttgtttgggaatctttgttgccattgctactttaggtgagccatattccagaagggttctaacatcagttaatccttcctcaagggcttccttagcaaactgttgcaataaaagttttgtcccattttcatgctgttcttcggcaattgtgtcgtaagtgttcacagcaagaaatgaacgtttttcaataacattagcaagaataagttcagcatcattacgtttagctattctaactgcttcatcgaaagctttaagtgattctgctgaaccatccataccaactaaaattcttgaatatttttgttccatactagctatccttatctaattaaccgatggcagagatgtttcttacttcaaaagcaaatttgccatcttcggtttttacaaaaccgtggtgatttgaaacatattcgattgcttcatccatgttgacaaagtcttgaatgacgctacgtacttttgtatcgccgacatagtttggtgttgaattttcttcgtatgaagagagtcctttaaattcaaatttcattttgaaattcctttcttaaataacaatattttttgagaaacaaaggtcagatgttctcaaatgtttttaagttactcaatcattctaaacaaaaatgatacgaagcgcgacaacaatttttgatatcaatctttgataccaaaaattgataccaagaattgataacatttgttactattcggaaaaagaaaatataaaagatactgacaaaactgtcagtatcttttatattttctttttaatatgcttgagcagtttctaatttggactctgtttctgatttttcaactgaatcagaaactttgttcattctttttttagcagtggtcatcattaaacgaattcgattcaattgattgacagcagaaactcctgggtcataatcaatcggcgcaagattagcccctggatactgacgacgaagttctttcatcattcctttaccgacaatgtgatttgggagacaaccaaaaggttgaagacaaataatattattcactcctttttgcaaaagttcaatcatttcaccagtaaggaaccagccctcaccagtgtgatttcctattgaaatcacttcttcagtagaggatgcaacgtcataaattgactctattgaatcaaaacgatttgatgccttcaaagctttattcattggcttttctagcatattgatgattccaataaaggttttagccatgagtttatttttcttactaaaggcaatctcatctgctttccagatttgattgtataaactgtaattcataaaaccaattaaatcaagaacaacagcttcgccgccctcttcttcaataatggaaacaatatcattattagcagttttactatatttgactaagatttcgccgacgacacccactcgtggcttttgaatatcaagaagttcaatttggtcaaattctgcaacgatttttttcatgttgcgataaaattcaaagattgaccctgattctacattttttcgagctttttctagccattttgcatgtaaatcattgaccgaaccttctactgcttcgtaggggcgtgtccgatagacaactcgttcaaacaaatctccgtaaagcacagcaatcataaagcgtgtcaataatggaaccgtgaatttaaagcctttttctgtcccttgatttcccattgagagagaaactactggaacttgcgggaaacctgcatcaatcagagctttacgcaacaaaggaatatagttagttgcacggcaaccaccaccggtttgggtcatcatgacggaggtattgtcaaggtcatattctcctgactggagagcttcgataagttgaccgatagtaataatggctggataacaagaatcgttattaacaaatttcaagccgttatttacagaagtatttgtttctggcagagaaactacattataacctgcagcagcaaaagctgtatccaatagtccttcttggtgaattggcgacaacattggcaagagcagggtatgttttttagccatttcttttgtgaatgctggtgtttctgggactaattcatgaacttcagtcgttgcttcaatattgtgacgtgtccgctctgaaactgctgccttaaggctacgcaagcgaatccgaacggctcccatatttgaaccttcatcaatttttagaacggtataaagcttgttgtgtccacgcatgatttcttcaacttggtctgtcgttacggcatcaagaccacaaccaaaggaattaagttgcacaagttctagatttttatttttgcaaacaacatttgcggctgcataaagacgactgtggtaaacccattgattgaccacgcgcagaccagaaacttcggccaaatgactgatagagtcttctgtcagcacatggaatccttcttgagtaatgatgtcagcaattccgtgattgatttctggatccaaatgataaggacgtcctgcaaggacaatggctttttcattgttcaaattgatttgcatcagtaaatcttcggctttaagacgtaagtcttctttgaatttatccatttcttcaaaaccatgttgaacggcagcttttacttcttcaagactgacagtaaatccttgagccgtcaaagacttatggatattgactgccacaccgtcaggatttgccaaattaataaatggatgaagataattgacttgtccttcacgaatttcgtcaatattatttttaagaacttctggataagattggacaattggacagttgaaatgattttgagcatttttttgttcttcttgttcaaaaagaactgaaggataaaagatagttggcacaccttgtttaatcaaagccatgatatgtccgtgactcatttttgctgggtaacaaacagtatcagacggaatagtttcaattccctcttcaaagagttctttgtctgagcgtgggctcaaaaaaacacggaagccaaggtctgttagcatcgtgtgccaaagcggataattttcgtacatgttaagcacgcgcggaatcccaatctctccacgagtttgttttttcttacttaaactatggtaacggaatagttttttatatttataatcaactaaattaacttttttgtcttttttagcgactttaacttttgttgctttttcagctccacgttcgcaacggttcccggttacaaatttattgccatcattgaagaccgtcagtgtcattttacagttattttcgcaaagtccacagaccataaattctttatgagtggtaaatttttctaattcatcaagctttaaaagctctgattctttgtgcgtttcttcattgtctaaagaaatcaaagcacaaccataagctcccatcaatccggcaatacttggacggacaacttcacgttcagaaattttttcaaaggcacgcaatacggcttcattgtaaaaagttccgccttgaacaacgattttcttatcaagttcttcgggacgttttaccttgataactttatagagggcattttttatgacactgtatgaaagaccagcagaaatatcaccaactgttgctccttctttttgaacttgtttaacttttgagttcataaagacggtacagcgtgatccaagatttactgggtgttcggctaaaagcgctttttgtgaaaattcacgaacgtcatgtttgagcgaatgggcgaaagtttcaatgaaggaaccacaacctgatgaacaagcttcattgagctgaatactagataaagcaccatcacggattcgcatggctttcatatcttggccgccgatatcgagaatgaaatcaacgccgggattgaaataatcagcagctttgtagtgagccattgtttcaacttcgccgtaatccacgtgaagaccagctttaatcaagtgttcgccataaccggttacggttgatttggcaatgtaaacgtccgctggaagtttagcataaacatcttttaaaatattaataactgattcaagtggttctccgttgttagatccataatggtcataaagaatatttcccgcgtcatcaataaggacaagttttgtcgtggttgaacctgcgtcaattcctaaaaaggccgcgccgtgatgctcattgagttctttatagctagctgttgctttggcatggcgcgcacgaaattcatcaagttcagcttggttttcaaaaagtttatccatagtatcttggggaattaaactatcagaatcatcagtttccaaactatgaatgagttcggttgctgttttttggcttgtttcttcgtagagagcagctcccattgccacaaaaagttgtggattttctgggaagataatattttcttcttttaaatccaacgtttcaatgaaacgtttgcgcagttcactcataaagaaaagaggtccgccaagaaaggcaacattgcctttgatttttcgaccactggctaatccggcaatggtttgattgacaacagcttggaaaatactggctgctatatcttcacgacgcactccttcgttcaaaaggggttgaacgtcagttttggcaaaaacgccacaacgtgaagcgattggatagagtttttcatagtttttagctaattcattgacaccattagcatcaactttcaaaagggcagccatttggtcaatgaaagcacctgtcccaccggcacaagttccgttcatccgtaattcttgagtcccattgtcaaaaaaagtcatcttggcatcttcgccgccaagctcaatcatgacatctgtttgtggaatgaatttttcgatggtaatggatgaggcaatcacttcttggacaaagggaacgtcaatgacttctgcaagtcccattcctcctgaaccggtaatggctaattctaaatttaaatctccgtgttcggcaataaaatcattgaatactttaatggttgctgctttaacgtcagaaaagtggcgctcgtaacgtgaaaaaatgagtttataattttcgtcaaaaacgacgagttttactgtggttgaaccaacgtcaatccctgttttataaatttgtgtcaagatggtctcctagttatgtgagaaatatcacttgaacaagtcctctaaatccttaatattcatttttcggcaaattagattttttatctaatttatcttttaggcacagaattttgataaaaagtaatttaaacggtctgttgcttatcttattatatgttcattttatcatttgtcataagaaaatcaaccagcaaaaagggcgtggttgtcacataaacgacaatttaaaacaagctgttgattatgttaaaagactttgacatcgaatgacaaaatgttttgactaaatacttaaatgactttaagcttttttttgattataatggagataatcgcatgatgtgaaaaattagacaaagcagattacataatttctttgcccactagataatggaaagatggttcttatggttaaatcagatgatttgcgcgtaaaacgaacaagaaaattgataagtcaggctttttttactttgttgcacaagaaaaaatttgaaaaaatttcaattcaagaaattgccgattcagccatgattaatcgagcaactttttatgctcattatgctgacaaacaagatttatatgatagtttgattgaccaatttttggctagttttactggtattttggatgaacaaaatttggtcgatggaaataatgttcacgtcaaggaaattgaaactgtcctgagtcgcttttacgaatttgttcaggataaaccagaggttgcacaaatgattactgacagagcacatgatcaacgtttgaaaaatagatttctggaaattttatctgagcgttatactgagttatttgagaaattggaagttagagaaaaagatgttgtagttcctaatgacttcgtgatttcttatattagttcaattttggtcggaacattagattggtgggtctcttcttcgacacaaatgtccgctcgggattttgctcatctcatcatcaaattaatttctaatggtcatctgactgtgcttggagttaatattaatcgtgaaaattaaaaaagttactgacgaaaaattctgtcagaggatagccgttgcactttagcttacggataccttcgaattttcatcagtaacttttatttttttaagttttcaatctcttcgattgttaaaggacgataagctcccagagctaaatctgaatccaaagctaaattgcccatccgaattcgtttgagataaaggacatacatctcaactgcctcaaacatccgtttgacttggtggaattttccttcatgaataataactcgaatttcactgacccagccggattggctatcgcctttgtaagttttctcaacaaataattctcctggtcttgctttttcaccatttttcaaagtcaaaccttcagcaaatttattgataatctcgtcagtaacttttccatcaattcgtgcaaaatattctttttcaacgtgttttttgggttgagttaaatcatggccaagagccccatcattgcttaaaatcaaaagtccttcggtatttttatctaaacgtccgaccgggaaaatatccttacgaacatctttttctgataaaagttgaacaactgttttaaaaacattatctttcgtagcggatacgactccttgcggtttattcaataagtaataataatattcttggtaatctaaaatttgaccgtcaaaagccacctgtctggaattcttatccacttgaaatctgccatctcgctgaatttcaccagcaacggtcacgcgcccttttttcaataaaactttgacttcactccggcttccgaggccactttctgctaaaaatttatctagtctcatgcctttattatagcatagctaataaccgaacgaagcgggaacgataatttcccacttagggtagtccttgtcagcttgctgactaaggcatctaaaaaatcacttgagcgacttttgtctgcgaattcacactttagcctattacaagtattgatactccttattttattggcgaaaattctgtcagtaaaaataaaagttactgacagaaatctggtctgtaactttttttattctccataaatatcagcatctgtaagtttaaaaataaccattgtttcaggtggataagctgccaattgatttgcaaaactgtcatcatcatcttttttgacttttgctttaatattgattgtcaccttttgatgctcttcaacaagtgcgtcatagagtgtctttaagtcagcaatatcttgactacttgctttgggcaaaatggtatatttggtataatctttgtcaaaccaagaaccttctttttcaaaatcaaccgatgaattctcgcgaatttgcaatttagctgagatatcataatcataatcttgctgttcaatcattttagcgatttttaccattgattcataatcaccacttgcttttaattttaaagtggctttataaggaattcccgcgagctctaagcgtccagcaatcataaaaggatctggttcagttcctttatcatcaagttgagggggagcaaaattgaccgagattgagtagcccttggtcagtaattgttcatattgcgtgatgacttcttctaattcgagtccatcaataaactcattaaaagtccgttcagtcagtttgttgttttcagctgcttcttcttttggatagataatttttacttgataagtcatgtctactattatatcaagattgtgtgcacaaatgggaaaaaaggtgaagaaaaatagtaaatttttttggttcagcaagtcattttgcctcgaattgtagttccactatactcttattttgtaagtcaactaggcgctttagcaccctatcacaattggacagcttaacctaaacgcagaaatctctttttcagcatttttatgtgtggaaactcaagcttaatagaattttattttttataaaaaaataaattaaataggctaggaaattcaagctttttgcgttaaaatagtctttatgacattaacacaagaatttgatacgattgcggcgatttcgacaccgcttggtgaaggagcaattgccattgttcgtttatcaggaacagatgccctgaaaattgctcaatctgtctataaaggaaaaaatttagctcaagttgctagccatacgattaattacggccacatctttgaagaagaacgtctggttgacgaagtgatggtttcagtcatgcgtgcgcctaaaactttcactcgtgaagatattgttgaaatcaacacacacggtgggattgcagtcacacaagaaatcttgcaattacttttacgtaatggtgcaagacttgctgaacctggtgaatttaccaagcgtgctttcttaaatggacggattgacttggcacaagctgagtctgtcatggatttaatccgcgcaaaaaccgataaagcagcgaatattgccgtaaaacaacttgacggaagtctctcaaaaatgattaataatattcgtcaagatattctcgaaagtttagcacaagtcgaggtcaatattgattatccagagtatgatgatgtagaaactatgacttcacaaatgctccttgaaaagactgctcattttgaacagcttttggaaaatcttttatcaacagctaaacgcggaaaaattttgcgcgaaggcttaaaaacggccattattggacttccaaacgttggaaaatcaagcttactcaatcaattattacgtgaagaaaaagccattgtcactgacattgctggaacaacacgtgatgttattaccgagtttgccaatattggtggcgtacctcttgaattagtagacaccgctgggattcgtgaaacagatgatttagtcgaagcgattggggttgaacgttctaaaaaggccttagccgaagctgatttggttttgctagttttggacgcctcactggaattgactgataaagatttggaacttttagagctatctaaaaatgccaatcgtattgttttacttaacaaaactgatttgcccgaaaaacttgatattaatcaaatttccggtgattttattcgaatttcagcccttaaaaatgagaatttatctgctgttgaagaaaaaatcaatcaaattttcttcgctggtgagattgaagccaaagacgcaaccgtcttatcaaatgctcgtcacatttcgcttgttgaagaagctttaaaagcactcaaggaagcaaataacgggcttgctcttggcttacctgttgatttgattcaagtcgatgtcacacgttgttggcaattacttggagaaatcacaggcgaagccgctcctgatgaattgattacacaacttttctcacaattttgtttagggaaataaaaaagagttcaattgaactcttttttattggcgaaaaattactgatagtaaaagtaaaaagacaagaagagcaaaaatagaaataatgtaaaatgtgagagcaacgcctattaaatttgccaaaaacacaaagatagctccaccaaatggtactgaaaatgtaaaaatagtcgtaattcctccaccaatttttcccaaattttccgaagaaatgttttccataatgagccggttgactttagggcttgctttggcggaaatgtaagccaaagcaaagaggaatatcagagaaagcaaaccaaaatgagtcaccaaagctgcaaaaagtgcaatcatcaaaaaggtagcaatcattaatttgggaagttcccaatcttttagtttatcccccataataaatgagcccgcgagcattcctagcatcaaaacaacgttgaaaatcatgatagccgtcccgtaactgacgggaaatggattaaattttaacattgccaagctggtcaaaggcccaatacccgccaaaataaagttgataaaaactaatgaaaaaactaacactaaaaaatttgatgaattatttccagtgataacatcacgaatttgtgaaaagctttctttgatattaaatttgaatttttcatcaaaataaacggtcttaaaagtcaaattttttcggaaaatcaataaaaagaatccactaagtaaatataaaatcccattaatcaaaaccaccaaagaaaaagactggtgagaaagagccaaaattgttacccccaaaggctgcccgataatttctataatagatgataggccttgtatttgcccaaaagctggttgtatctcctctgcgtttagattattttgtaaaattggtgcgcgtaaaccagatttatagctggtaatcaggtcggtcaaaattttcacaccagctatgccaaaaaaagtgataaaatttttctccatcatcaaaaaaatcaataaaaagaataatatcgcttgaatccagctcgcacgaatcataaaatttgctttattttttgttttatcagctaaaaaacccgtgtaagcggcaaataaaaccggtaataacaggcatatttcggccaacgaaatcatcatttttggattgggcaaactactcgcataaatcagaaaaacaatattaaataaactcgttcccaacatagaaaaaatcgagctagacagcaaggaagtaaatgttttattttttcttagtaagttcatagttttctccttagctctttggtaaatttatatccctcataaccttttaaaaagctttcttcatatcttttagtataaaaattatatagctttttatttttaacaaataactcgcaagtttttaactgttcatcagcccaatacaaatattttttatttccagttttctgatagagtattaataaaaaatatgaaattcctgataaccctttctcaaaatccattgattttgcaaattttacattcattccatttgctattttaataatctgcttttcatatttttcaaaattatagatcagcaaaaagagtgccaaaccactagagccatttaatatgtagggagagtaatgtttcccagataaatgtaaaaatgaatcacttaattgtgaaagtaaatattcaattttttcattaattaattcatttttttctaaaattgataatttccacaaataaccagttaaaccatttagtcctagatgttcaaatttattttctttgataaatgtgaccaagttctttggttcttccaagtactctttagaaatatgtaaaaaaatatctgatttataaaaataaagttttttagaaatttctaaagctttttttgtagaacttccagtaaataaataaattaataagtcagaaatatttgtttcaacttcaaatctctcaaagattttagcagctaaaataatcgtttcttcaaggcttctttcttgctgattgaacacatttaattgcccaattagaaataaaatcagctgaccaacttttcttaggtctttttccgtttccgtcaattttgaccaaatttttaaatagaatccttttgtttttgcagtaactttttccaattcattaaacttatgagcagattctaaatcaataaaatgaattttataagctttgtcaatcaaaaagttatcggggtgaatatcatctaaaattaccattttatgatgtgcttctcccaaaatttcaattaattgtttaataatttttgaaaaaatcactaatttattctcagtcagattatcaaataaggaaaatttgctttgaaattctctaagtgtttgtccatcaataaacttataaacataataatgattaatccaagcagaaaatttttcaattggttgtaaaaaatcagctgaatttaacagctcactcataaaaaattcgttttcgcgtaattcttctgattttaaattcacaaaagttaatatattggcccgactttcttttacaattattttttgattttttacagttccaaaataaatgtttcctccattattttgtcggataattttcgtcaaatctaaatcatttaacctatttttttcattcatttccttattttcttgataaaaggggtcagatatccaagccggtaaatcaaaatacgttttttgaaagtcttcccaaattttcccattttttacgattgtacattcatctatattttgaaaaaaaccaaatcgataaaaaaccgttttagaattattaaaatttctatcgcttaagatatagaccccctcaaatttgactaaaatctctgataaatccactaaaatcctctcagtagcctttatattttcaggataaatggtaaataattttccactttctgctggagctgcagttttagaaatattttcgataaaatcctcacgagttgatagatatttataaaatacttcttgttttgacaaaaaatttgttgctaatccaaaaacttcttcataactttcaattgtcgcagataagtgaattttaaatccatattttggaagtttataactttctgttgtgaaataagtaaattttcccatagttgttccttataataaaacccaaacctaaaaaggtcgggtacacttagattaaacttccacaataggacaataaaaggtaatattaacatcttcttcattttcaacttctttaggaagaagattaagctcaatcacttgttctttcattttgaaaacctccttaatttaataaatttattttactgcaaaaaaatatcgatttttatcatttcctatatataataaaaaaatcacaacttttgctgcaatttttttatttcttcgcgataaatttttgctttttctggcataaagaacgcttcataagtttttgcaatacgttttaaaatggtaatcgtggcttgaatattacccgacatttcatacaaatctgcttcttgtattgcatatgaaattccgatttcgatatttccaatctggggaatccggaccttaaactgctctaaataatttttcactttttcagtttgattattatgcgacaaaatatagattgcatttctcaaaatcatcagaattaaattattatctaaattattttgctctaaaatattatccaaataaaaaacaatggatttattatcaagttgcgttaaggcaatcgcaaaaaatcgaagatttgagggtttccattcttctatttcgtaaaaataattttctaagatctcctgttcaattgtcgtcagacttttaactttcccataattaatcagcatagattttagtgcaattgcatttaattgatgctgtctttcattcgtttttcgatatatttttcgttcattttcatacaatttgactaattcatcaattttcccagcctgttctaaccttccagcttgctcaaataagagtgatgaagcatcatttgttaaaattgccgaaaattcatcgattgaaatatcaatatttttaatcaaagcaaagaacttgccagttgttaaatcaccctttccacgttcaaaatgcgaaagttgtgaaattgatataactccttcacttgctttttctaatgacagtcctttttcttgtcttagttctcgaaagatctttccaatttctttatccataaaattattatatcagagaattcaaaaaattgaacaaaatcatttgtttttttactgacagaaattcctgtcagtaatttacatcatctttttaatttccctcaaacacttttgcacaaagaggtcagccattccaccaaaataagtgccttggaaattgcgaccgttgatgacgattaattttttatcaagtcgataagcccgaacatacttggccgattttcctagctcttcttcgttgaaaatttcttcgatttcggttcctgcatttttaagtaaaatttttaaattacttactgacagactggtcaacaaaatatcaggctttaaaatctgcataatttgtggaaatttcattacgaattgagattgttgacttttggttaaattcggccagactggctctgttggaattggtgtaaacaagtcaatatgcaaggctcggttaatttgattttcagactgtttgtaagctgcatcaaaaattggaaaaaattttgctaactgattgaaccaagaactgggattatattcaaaatattgattaagatttgacttgtaaatttccagatttactgacgaaagttctgtcagtaatttttcaaaacgttgattttcaccaaattcggcataagatgcatttttactgacggtcagtatttttaagtccgatttttcataggctggtaaatctccgaaccataaaagtggcatgctgttcggaattaagacctcagcactttcgggatttacttttaattcttcaaaatctaaccaaatatccaaaatcaaatcattcaattcattctcattcatcagtcaaatccaccctcaacgttcacttgcgcaatcaaatcaggaaactcgtctgcctttttaaaaatttcaactgcttcttgtctggctacttctaaaatattataatcattgaccaaatctgccgcaataaattctggaagtcctgattgacgaagtccaaaaatttccccagaaccacgcattttcaaatcttcttcggctaaaacgaaaccattttgcgtctctgtcataattttcatccgttgttttcctgaatctgacttaggatttgccactaaaatggcgtaagatttttttgttccccgaccaacacgtcctcgtaactgatgaagttgtgatagtccaaaacggtcagcatccataatgaccatgatggttgcattaggcacgtcaacccctacttcgattacagtagttgacactaaaatatccaattttttagccttaaattcttgcataatttggtctttttcatcatttttcatttttccatgtaaaagcccaattttggcaaataaaccaaagtagtcatttaattccgcaaataaggcttctgcatttttcaggtctagggtttcgctctcctcaatcaatggtgaaataaagtagacttgagaatcattagcaacctcaccttttacccaacttaaaacttcagaaaactgttcatgtttaacccatcttgtggtaatgggttgacgcccctttggcagttcatcaataattgaaacatccatatctccaaaagccgtaatcgcaagcgttcttggaattggcgttgccgtcatcattaatacatctggattttgccctttttcccgcaaaattttccgctgattgaccccaaaacggtgttgttcatctgtaatcactagacctaagttataaaaatcaactccttcttgaatcaacgcatgcgttcccactaccatgtgcgtatgcccactagctaaatcagctaatattttccgtctttcagctgcttttaagcctgaaactaatagtgagatttgcaactcaggaaagagtgcctgtaaatttgcaaaatgctgacgagccaaaatttccgttggaaccatgattgctgcttgaaaatttgccagacaagccgcatacattgaaagcgaagcgacaactgtcttaccagatcccacatcaccttgcaaaagccgattcatgtggtaaggagatttcatgtcatccagaatctcggtcaaagcccgggattggccaccagtcaattcaaaaggtaagtccgaaatttttttatcaatttcttcttgctcaaatataacttgtaaacctgctcgtcctgatttttctttatttttcagtgcctgcaatttcaactgaaacatgaataattcttcaaattttacacgtcgcaatgcctgcttatgagcttccatatcttctggaaaatgcatggccaaaacggcttcttgcctgttcatcagacgatatttttctatcaaaaattctggtaagttctcaggtaattctgacagaagccctgattcaaaaacttgatgaatcactttgaccaattgactttgtttcatacccgctgtcaaatgataaacaggttctaatccatcgtccacctgagccacaactttcattcccatcagttgttgctttgcctgttcccattttccataaaccgcaatttcttttccaacctccactttattagccaaatagggttgattaaaaaaactgacagcaacgacggcttcaccttctttaattttaaatgaaagtcgattacgtttaaatccgtaatactgaacattggctggggtcactaccgttccaataatcgttgctttttctccgtcaacaagctcaaaaaccgaacgacttgcgaaatcttcataacgaaaagggaaataaagcagtaaatcttgaactgtgaaaattcctaacttatggaaattttccacagactttggccccacaccttttaaaaattgcactgaatctgttaatttcatacttttattataccaagatataaggctaaatgcttcaaaaatcaaatataatttactgacagagtattttatcagtaaattttgctgataaattctctgtcagtaaaaaaaataatcagaaaattttctgattactttttatgcttttttaacaaccgaacccttcaaactaatcgctccaaatcctggaatttttgaatcaataaaatgttcatttttcccttctggattgatacgaatgtttttcacttttgtaccctgtttaattggttttggcattcctttaaccggcaaatcttgtacaatgacaagatcatccccagtttctaactcatttcctagactatcaaggacaataaattttccagctgcttcaatttcttcaagcgtaaattcattcccacattcagaacagccaaagctcgtatctgataattcataagtatattcacttgagcaatgaatacattttggtgtctccattttttctcctttataaaataaaaaaaccagcccgaagactggtttttataccgttaaaatcggaaaattatttagcgattttagcgaagtatgcaagtgtacgaacaaggtttgaagtgtatgacatttcgttatcgtaccaagatacagttttaacaagttgagctccgttagctgaagtaacttcagtttgagtagcatcaaagagtgaagagtttgagataccaacgatatcagatgaaacgatttggtcttcgttgtaaccaaatgattcatttgaagcagctttcatagctgcgttgatttcgtcaactgtaacttctttatcaaggatagtaacaagttcagtcaatgaaccagttggaactggtacacgttgagcatgtccttgaagtttaccttgaagttctggcaacacaagaccgatagctttagcagcacctgttgagttaggtacgatgttttcagctgcagcacgtgcgcgacggaaatctccaccacggtgtgggccatcaagagtcatttggtcaccagtgtaaccgtgaactgtagtcattgtaccaactttgataccgaattgtttgttcaaagtatcagccattggagcaagacagttagttgtacatgaaccagctgaaattactgtttcagttccatcaagtacttcgtggttagtgttgaaaacgattgttttaacatctgatccaccaggtgcagtgataacaactttcttagcaccgttagcgtgcaagtgttgttcagctttttctttagttgcgaagaaaccagttgcttcaagaacgatttctgcaccaacttcagcccagttgatgttagctgggttagattcagcagtaactttaacgaatttaccgttaacttcaaaaccaccatctttaacttcaactttaccatcaaaacgaccttgagttgtatcgtatttaagcaagtgagcaagcattgctggatctgtcaagtcgttgattgcaacaacttcaacaccttcaacattttgaatacgacggaaagcaagacgaccgatacgaccgaaaccgttaataccaactttaactaccattagtagtttcctccttatagggattagattttataaaaggcaaaccttttaaattgactaagttaacaatttaacttactcttttattttaacactttttttaaaatttgcaaacataaactaccttagaaagcgctctacaaaagcaaatgaactccccttctcctgaaagcggttaacattaaaaaagctaatacttttggcaataatctttgactttccacctaaaaatatgactaaaaaaattactgagcaggctgtcagtaatttttattcttatttttttccaaataagcgcccaaaaaagcctttattttccgttgttttcaactgttcttgtaaatcagtgaaaaattgattttgatctgtcaaagctttttccattaattcttgctgttttttgatctgttcatctttttcagcgatttgtgcatctttaacatttatttgttgatctttagagataagttgactattcaaacgctcaatctcagcgtttttgtctttcatcaacgcactaatcatttcataagctgcagatgttgcatcatctgctttaatggcaatctcagaacctttgtcagtattttcttctaaaacttcggccttagcagtgactacttttccatataaaccttcaagttcatggattccttcggcattgacgactgttacatttttctcatttttttcaacaaatttagtatctagcgattttacccgtttattcatcgcttggcgagtgactccaaaaagctctgccaattcacttactgttttagttttcatatcatcaataataccatattttcggctaattaaaataaaagaaactctttatcaaacaaaatttcacctaccataagactttattatctttcaaaagttgataggtgtttttatttcatctgttaaaattattgtttacttctagttcagaagtaagattttttataaaatctgttaaggaaatttcttagtaacttaaatcttctccgtttgtcgaaatcacttttttgtaccagtcaaagctccgttttttgatacgtttataatctttatctatataaacaaaaccataacgtttttcaaaaccttcacgagtagagtaaaggtccgttgcagaccatgtaagataaccaatcatttctactccctcgtcaaccgcttctttcatacgagcaatatggtctgctaaatacttaattctgtaatcatcattaaccgttccgtcctctttcaaagtatcccttgcccccataccattttcagtaattaatatcggtaattgatagcgatgataataatcatgtaaataatgtttaaaaccatatggatcaattagccatttccattctgttgcatcaatgtaaggatttttagtaatcacaccattcaaggccctatcttcaaaactattagcttcaattgcagctgataaatagtaacacaatgccatgaagtctggcgaagcactctttaacacctctagatcatcgtcaagtacaatagaagaaaaatctgtcccctcataagacttgataaaaatacctgaataaacgccacggaataagacatccgcaaacccataaccgcttttataagctaactcatccgttgcttcaacatttaccgggtcacaattaagtgggtagagacaaacattcccaagatttccacctactttagcggcaggatcaatttcatgaacaagattcgttgtttttgcatagcaaagattaaaatgatgttgtagctggaatacttcagctctatttttcgccttgtatcctgtcatgtactcagagtctaagtcaataaaattttgttcattaaaaggaatccagtatttaattctccccttaaatgctttgataactgtttcagcataatgtgtaaaatctttaataatttcacgactcataaatcctctatatttttctaaaagatttagtggcaaatcatatgcgtataaagttgctacaggttcaatattatatttatcaagttcatctaacatagcagaataaaaagcaattccttctggattagcttcaatctcatctccatttggaaaaatgcgtgtccaagcgatggtaaaacgatagatttcaaatcccatttctgcgtaaagtttaatatcttctttcatatgatgataatgatctgaagcgattttgaactcattaaaattagattccttatctgctcctggaattactcgaacgtctgcgatagaaactccctttcctccttgtccatggcctccttcaaattgttgtgcattcgttgaacttccccatttaaaatcctttttaaatcctttttcgtcaaaaaacataaactttccccctttttattttttatgttaaagaattggaattctttatcaattatctctttgttctgtttcaagctcagtaatcatttcaatacgtttggcgtgacgcccccctcataaattgcttccaaccattccttgacaatcatttttgccaattcacttccgacaacacgtgaaccgaatgccacaatatttgtattattgtgttctttggataattttgccgaataaggttcactacagacgactgcacgaattcctcttactttattcgctgaaatggaaattcccactcctgttccacaaatcaatactccaccgtcaaaatgacctgccgctacttcctctgccactttttttccgtaaataggatagtccgttcgttcagttgaaaaggggccaaaatctgtcacttcgtgccccaactcctcaagatagtcaataataaggggtttcaattcaaatcctacatggtcgctaccaattgctaatttcatcctctttttcctccattaagctcttaattcattgattattgtttcataatttttatgtttcccaaataaagcggaagttcctaaaataaacccttcaacgcctaacttacttagttcttcgattttctgtggtgaaatcgctccatctaccattactttaaagtcaaattgtttacttaataaaacagccttttcaattttagaatttacatattccagatatttttgaccagcaaagcctggatttactgtcattatcataaaataatcaactaatggcagcaattctattactgcttcaatggatgtgcccggattaatagcgattcctgctttttttcctttggctcgaatcttatctaatgtacgagcgggatggatatctgcttcaggatgaatataaataatatcagctcccaagtcggaaaacatttcaacataattcgacgggttttgaaccatcaaatggacatctaagggtttatcagtcaccgaacgaatcaactcataatcttgcaggcccattccaaaattgggaacaaaggaaccatccatgatatccatatgaaagatatccacaccagcaacttctaaatcttttgtatccttctccaaattagcaaaatttgcacacatcattgatggacataacaatttttttgacattttctcactccttgagataacgattacccaaacaataccatcatgggtaatcgtttactttttttatgattttattatatcatcaggaaaacaacctgtcaacccctcaaatattattagttatttgctaaaattgtttatatatgagagaattatatcaataaaagataacgattactcaaaaggataattctatgaaaaaaacatcaatcaaggatatagcaaaacttagcggagtttctgttgcgacagtctctcgtgttatcaataataatggacgtttttctgaagaaaccagaaaaaaaattcttgatgttattgaagaaactggctaccaaatgaattttagtgccaaaagtttgcgaatgaataaatctttttcagtcggtattttagttccagatatcagtaattactttttctctgatgtggttcaaaaaatagaggaggaactttttgaattaggctattcgacaattatttgtaatactggtagaaatattgaaaaagaaacggcctacttaaatatgctccgaagtaaattggttgatggtattatcgttatttctggcgtagatgaatttgtctttcactatgatgatattccatatatttgtatcgaccgagaacccttgaaaaaagagaaaacaatcgtgatttcttcaaatcattatcagggagcctttgaagcaacagaatcattaattaataatggatgtaaacatcccgcaattttgatgtatgaccgacaatcttcttctgcaaaagagcgttttaaaggatataaagatgcgctaaagaaaaataatatttcctacaacgaatcaagtcatctgttattaagtggcctagaagaaaattttactgaaaatttacaagcatttttagagcgaacagaccaagttgatagtttttttgccgtaaatgatacacttgccatgaaactcttcagctcgttaaaggaactaggggagaaaattcctgaagatttcaaaataattgggtttgatgatagcccactcgctcattattcttcaccaacattatcatccgtcaaacaaaacacggataaaattgctcagcttacagtcaaaaatctaattgattttatttcctctgggaaaattatcaattatcaaactattctagtaccggttgaattagttgttagaaattctagcttaaataattaggaatcaactctgacttttctattaatatttctaaagtactaatctattaaaaaagtctaccagctttggtagacttttttaatttttcttatttatctttctgaaattatcaataaagatttaattgctgtccgttgatccattgcttcatatgccttttgaatttcatctagggtaaattcttctgtaaagacacgccctggatcaatctccccacttaaaactgcttcaagtaagatttccttatttcaccgtgcgacagaggctactccacctccaagttgaatatttttccaaaaaagagaatcaatccattcattgtaatcaacatcatgaggaactcctacacgtcctcccgctcttactgcttggaaagcagattcaatggcttcttttgttccgacacactctaaggcagcatcagcaccataaccattggttatggccataattttttgaatcgcttctgcgccatgctcagcaatgatatctgttgccccaaaatcacgcgccaatgccgctcgatcttcatggcgactcattgcaataatccgttttgcacctaaaagtttagccgaaatcactgcgcacagacctactgctccatcgccaaagacaactactgtgtccccttcgtggacatctgctgctttagccgcatgaaaacctgtgggcatgacatccgctaaagttgtcaacgaagccagctgttcttctgaataatcacttggtcttcctggaattttaacaagtgcaccatcagcattaattgctcgatagaattctccttgatatcccccgttaactccatctttagcattggggcaattagcttcaaatcctgccaaacagattggacagtgtccacaaccatgagtaaagggaacaatgacaaaatctcccgctttaaagtttttaactcccgctccaacttcttcaatgacaccaatagcctcatgacctactggacctggctgacgttcagaaatcccacggaaccaccataaatcagaaccacaaacgcaggcacgaacgatttttataatggcatctgtttcttttacaagttgcgctttgggaaattctctaacttccatcttatttttttcgacaaaataggctgacctcatttttttacttccttttcatttattgaatttattataaaatgaatttagctttttgaaaaatactttttaaaaaacttcttatgctttgaaagcataagaagacctaaataactcacaaaattccaccaactcctcgtccaaagaggttgttactagaaattttttgataaaaatcggcaacttttggtgtgagattatagcgtaatgccaagggcctaagggttgcttctaatttagcaagttcatcagcaagtcgcccttgattctctaattgaactttcgtatgaagtaaacactgacgttcccagtcacgaatatttctatctaataccagattataaagttcatttaaaatttcttgcttttcaaatgttttattcatgaatttattatgccacgaaatcacttttaagaccactaaaaacgcttacgattttaaagctagcgtttttttgtcaaattcatgtttggataatttttaagaattcttcgtaagttatagtgttttaatttcaaaggacggttcttcagaagttccaatacttttttgcggtttggtgcggtttcatgattggtcagcaaatgtttaagacgaaactctttaatagccgcattttctttatcagaatcatcaatcatagccaatacttcttttttggttgaaatcgtaaagataaacgttgatagaaggtcagctccaaaaataattaatatgagaagcactccccaactatgcgtgattgaattaaaatcatgaatccaattttgaacaggtggattaactaatttaattaagataatacaacctacaccccaaaataatgaaacgggaacagctaccctgccttcaatattgaaagggagggttgagtagtcccataacttcatattaaagaatttctctaaaatccaactaccgataaattcaaccacagtcacaatcactattgtattaagataaagactaaataaatttccagtatctggaactaaaagtaagactgctgacacaccaaaaccgtagacagggcaataagggcctaataaaaaacctctaaaaacaaaatgtcggtctttaagtgaacaatagaaagtttcccaaagccaaccaatgaaagaataaacgataaaagtcataaaaagttccatgtgtttctccttgtttgtttaatcttttccattatatcatctcttttggtaatttttaaaattcatattatttcctagaataaaataagaaaaaagctgatggaagtcagctttttttatatttttataatgattttaattttccatggaaatcagcaattgattgatagcctttttgattcattatttcttctaattctttaatgattctatcaaagattgcaggtccttctttgtgtaaagctgttccaatttgaagcattgtagctccacataagaggtgttcaaaggcatcttgtcctgtttcaatcccacctgttccaatgatttgaatttcaggtttgagtcgagtatagaaagcacggacatttgcaagcgctgttggtttgatgtaagctccaccaattccaccaaatccatctttaggcttaataactacgctttctgcttctgggtcaataaaaagtccatttccaatactattcactgaattcacataagtcaatggaaactgattgaggatttctgccataatatcaaaatgtacaaggtcaaaataagggggaagtttgacacctagcggttttgtaaagaaagtaaaaacttcttttaggagcttttcagttgcttcaaaatcataagcaagttgtggtttaccaggaacatttggacaagaaagattcaactctgtaattcctgaaaaataactttcttgaattttcttgagcatagcgatattttctgctacactcatacccgcaatggaaaagaagattggcccttcttgagcattttctttttgattttttaaaacatagtctaagtagtaatcaaatcctaaattaggcagacccatagaattaattgaccctaattctaagtcaacataacgtgggagtggattaccttctcttttttctaatgtggaacttttggtgatataggcccctgcttgagaggcttttaattcttctaaatcctcaatcgtcatacaatggactcctgaagcgttcataaatggattagcgaatttggcatttgcaaaagttgtattaagcattaaaaaatcgttccccttttctatttttaactattctatcacaaaaaagccaaattcaaaatttttaaaattcgagtcaaatgatgaggcggcatttatttcacatgatataattaaattagagcaaatggagtgtaagatgagtacagaaagagctatttttgctggtggttgtttttggtgtatggttgaacctttcgaagaacgtccaggtattttggctgtaacaagcggctatacaggcggacatatcgaataccctacttatgaccaagttctctcaaaagcttctggccatacagaggccgttgaaattttatttgataatgaactgatttcttatgatgagcttttagatatttattggtctttgattgacccaacggatgctgacggtcaaatttatgaccgaggtgcaaattaccgtccagtaatttttgttgaaagtgaagaacaaaaaactgctgctaaaaaaagtaaaatcgccttagaaaaatctggaatttgggacaaaccaatagttgttcctattgaagaagctaaaactttttggccagctgaagaatatcatcaacaatactataaaaaagaccctaaacgttatcaagcgatgcacaaggcacgtgaactttatttggccttacaacgtttcaaaggaaaatttaaatttttaagaaaaaacactagataagctagtgtttttattttatatttggccaatcttttccaaaccattcttggtatagatcttctacaattttaacagttgtcattgtcatttcaggagaaagtttttcactttttttcttaccactattgataagttccgctatttcatcaatctcataactgaattcacttggcattggatgtgaaaactcttcaatcatttcgccatttctaatgagacttgcctgatttgatttccaataatttggaacagaaatttctcctttttccccgtaaattgcaaaagtatttgctttatctaaacgggtggtaagcgagatattaatcataatttctgcttttttcaaaagaatttcataatctaaatctgctttattttcttcaggggaccagtaaattccttttgcttcatcaaaacctgttccaaataaaaattgtagcacagagagtggatagctggcatgcatgataaaggctccgccaccttcttttatatctaaagcccaactctcacggttggtatgaggtctaaaatcgttaattgcaaggcgagatactttaccaatctcattggcatcaagccattttttgattttggtcatcacaggaagaaaaacagatttttgagcttccatcaaaaaaagatttttttcatttgcaatcttaaataactcttgagactctttaagcgttaaggtaaatggtttttcaagaagcacatttttacctgcttctagggcgagctttgctttaggataatgttgtttattgataagtggaatatagattaagtcaatttcttctgcctttactaaacttacataatcatcataaacttctggaattcctaaatccaaagcggctttttctgctttttctttatttctggcagcaattccgataacttctgcttgcccactttcttttacacctgctacaaatcggggaacaatcttagcagcacccatgattccaatttttaacatttaacttcctcctgtgactaagactaaatcccgataatcacggtttctacagtttcaactcctgcagtggtaacacggactctagcaagattttctactgtattaacatcaaaaaatctgtctccactgatatcattttgaatgatttttacagttgcttctggtggaaatttttgtaaggtttcaataagttcttgtgtcgtcataatcttttagtcggccctttctgatagatattcccaacgttcatatttttcttcaagctcttttgttttattgtctaattctttttgtaagtcaagtaagagttctgtattagaaccattttcattcatttctgtgtctatctcagaaattcgttcttcaatttcagcaatttgactttcaatgttttcccattctttcttttccatataagtcagtttggctttgtccgtattttctcttttgtcagcaattacgggactttcagttttgctgacagctttgtcagcaattttttcttccattttgaccgctaaatagtcactgtaagcaccaaaataatggttgatttctccattttcaaaggcaagtaattcattacttactttgtcttggaaataacggtcatgtgaaacggtcaaaacagcaccagggaaagaccctaggaaattttcaagtacggttaatgttgcaatatccaagtcattggttggttcgtcaagtaaaagcacattaggttgtaatagtaaaatctttagtaaatagagtcgttttttctcaccaccagaaagtttagaaatgagtgttccgtggctacttcttggaaagagaaattgctctaatagattaacaattgaaatattctcgctactattattatgagcagccgaagccacttcttcaaggaaatttatcatgcgtttattttcatcaagtccgcgaatttcttgactgaaataaccaattttgacggtttccccaatttctaaaagcccatcagttaattctaattctccagcaatgacattgaggagtgttgattttccaacgccattatccccaacaatccctaagcgcgaacgaggttgaacaattaaatcaaaattgctgaaaatttgtcggtctgggtaagaaaatcctgcattcttaaaattaatcacttttttacctaagcgacttgaagcaatatttaattccaaatcctcttgattttttgaagttttcattgaatctttgaggtctttaaagcggtcaatacgtgcctgttgtttggttgcccgagcttgtggtgatttacgaatccaagttaattcggactggtaaagttgtttggctttatgactcgctgcggcttcacgttcttcatcttctgcttttttcgctaaataatcttgataatttccttgatactcttttaatccggcatcttcaagctcaaaaattcgtgttgcaacattatccaaaaaataacggtcatgggtaacaaaaagaactgttcttcgagaatttttaagataattttgtaaccaagcaatggtctcaacatcaaggtggttggttggttcatcaagtaataacaaatctgaatcattgactaaagcttgagccaattgaacacgtcttttttgtccaccagaaagactttcaatgattgttgtagcttctggaagttgaagtttagttaaaattgttttgacatctgcttctacttgccatgcattcaaggcatccatttctgactgagcacgctctaatttagacaaattttcaaaatccaaaagcgccgcttcatagtttttaattgccctcatttgtggaagtgaatcatctaaaatactatctaaaatacttgctttgggattaaaatctggttcttgagttaaataagtaattttataattttgtggatggtcaaaaggcgatttatctccatcaaaaccagaaagtcctgaaataacatttaagagtgttgttttacctgttccatttactcctaaaagtccaattcgatcaagatcatgaatgatgaaattgattttattgaaaaccgttttttctccaactgatttacttaaattttgtgcgatgaagtctgccattttttgccctaatttctcttatattacttttgattatatcataaaaaagcctgtcagtaacgacaggtatcatttttactagcaaagtgagcgattctttgatgactcctttctgtcggtaaaaaattactgacagaaaagatttgattagtcgtcactattttttttactctcacgaatatcaaagggatgaacaatctcttctaattctttgatatagagttcagcttgtctggttagttgaaaatcgttgagtgaaatccagccaatttctatattatcatcaactgctaaaggaatagcgacaatattatcaccatttaaatcctgactgacaatacctgttgaaatggtataaccatttaagccaatcattagattaaaaattgtggctcgatctcccacttttatgtcttttttagcgtaaacagtcgataaaatctcttcagaaaaatagaaagaattatgctcgccttgctcataagacaagcgtggaaatttttctaaatcttctaagattacaaattgtcggtcagctaatggattggtcgaacttacaaaaatatgaggctcagccaaaaataaggaatgaaaggttagccgattttcttttaaaattttgtcaatcacatttgcgttataagaatttttgtaaagaatgccaagttcactgcgcaaggccttcacatcttctataatttcataagtgcgggcctctcgtaaagtatattcgtattcgtcaattccttgactttctgtttttttaaccatatttacaaaagcattgacggcaaaagcatagtgctgtgtcgagatggcacatagttttcttgatggctttttgtccaaccaccgcgcttccaataaatcagattgttcaacaacttgtctagcataacctaaaaactcggttccttctgcggtcagcgaaattcctttgcttgaacgttgtaaaaggggcaatcctacttctatttcaatgtctttgattgactttgacagactaggctgtgtaatatagagaatctcagctgcctgattgattgagccaatcttagccacttcaataaaatatttgagttgttgtaaacttatcgtcattatttttttcctcattagatttttaattcaaaaatcaaaaatctggtcagtaactttgtatttactgacagaactttcagtaattattttttactgaccaagctttccagtacttttatggctgaaattattttttccccgctcactttttcatcgattaagcgataagattcaacaggactagctgcaaattctgccgcttctttcagttttttcaaattaggattggataaatttatttcttctaaagaagcaggcaaatgattttctcgatagaaaggtaatagtttctcaatttctaaataatcccttgtataagccaattgaactaaaacaccataagcaacttttgaaccatgtaaaatagcgtgcgtttctggacaaagcgaaagtccattatggagcgcgtgagcacctgacattcgcccataagttccagcaaatccacccaccgttcccgaaagttcaatgattgtgtctacaatacgtccaaaagctggacttactttttgcttacttaaatcctccaaagccgcctttgaatctgcaaataatattttaaaaatttctttggcactgacaaaacctaaacgaacggaagctgacaattcttcttgggggacttgacgaataattccttccatttcataccattttgcgagtgtatctccaattccagcaacaaaataatcatagggagtcgctaataaaaaatcataatccactaaggtcaaataactgactttatttaaatatccgactttatcaaaagtatggtctggatgataaagcgcagcaactggtgtataaggtgcacaattcgatactaaagtaggaatgattatcaacacacaatcaagctcttgtgccactactttacaagtatcaatcaaacgcccgccccctatcgcaagaatagcctcaacattaccgatttctttggctagctttttcccgttttcaacagatgctgtgccgtcataatgaaaaataggataagaaagagttttaggataaaaatcttgaaaaacttgaaatgatttctcaccagtaatcacggcaagttccttaaatggcgcaaggtaagcttctaaatcttgcaaaatttcttgaccactcacgtatctatttgctccgggacggacttcttctgagagtttcataattttcctcctaattaaataattatttagaatattctatcacttaaggcacaaaaaaacaacattttttaagtaaatgttgtttttattctaaatcaatgtttttaggcactgtaatccagagttttgattatatttcccttgtcatctgtcaaatcaattcgcagtttgagttgagccactccagccttcttcattgagtctaagactttatctgcaacgtccttaacttgatcaccgcttgcaagtaaaagggcaccaacggttgctttattaagcttagaagattctaaagtataggtcagctttgagtcagtactcgtcgcttttgccgaattgattaatccctgagattgactcttgatggtatccgaattctcatttaatttgcttgcaatagctgacggagtagccgaaccaatttgatccgctgcatccgttaagttttgagaatctggtataaattttgctgcaatattatctgtttgactagaaataacgtgtcgtcctaccattacaataccaaaaacaatcagagccagaaatataataagggagagtaatattgcaaatactttaccccctctgcgtttcttctctgtttttctttttctagaattcatttattttccttttctagctttgagctgtaatagtattatagcattttgaagttaaaataaaactaaaaaagtagtttttcaactactttttaagatcttttagataaaattaatcattaaagtcaaaacgtaatttcatattagctgaaccaagaacgaccatacgtcccaaaagttccgtttgtgctttgaaagcagcttctgctaatttttcattggcttgtgtcaaataagcaattttatcttctgcaagctcaaagtttttatcagtttcattttgaatttcatggaatttcgccatggtgtttaattcaaaagtgttgcgtaaatcaacaaataaatcataattcgcatcaccaagaacagctgttgttgcgctcaaccaatacatatttgttggatcatattctcccttcgcgtcacgataagaagctggcgtatcattaattgctgtgtaaaatggtacaacatgattgaatgtatttgcaccaaaagcaagccattgtacacctgtgagttcaaaaggaacattatttctaacttgcaaaatatgaacactgtgatttcgattgattccgattggacggaaaagttttctttcctctggacgatttgttgtgccataagggtcatattttgtattttcaaaatgacttgacaagacaaatttaacatcttcgacagtgattttacggctagcttcacaaatgaatggaagttcttgattttgtggatcttcagatacatttcccaagaaattttgaccataccaagttcgaggattattataaacagagtctttgattgaagatgaaccaaagatatgacgaagattataatgactttcataaccttcaaaatcagggttcaaatgattttcatcaattaactgtttcaaatcatcagaacacatataatcatcattatcaaatttgaattcgtcaatattcattcggtttggtgccaccacataagaatcatcaggaatgcgaaccgctgcccaatgatgtccaccgattgtttccaaccaccaaacttcttcattgtcagcaaaagcaatcccgtttggttcataggttccgtaagttgtcagtaattggcctaaacgttcgactccttcgcgagcacttttgatataaggcaagacaagagtcacaaggtcttcttcgcccatcccattttccacataagggtcaagtccgagaattcttggattcgtagtaattgtttctgttgctgacatcgcaacattttcactattaattcctgctgcaggccaaattccttcttttaggacagcattgggtgtcgaagtatagcgcaaaggattatctggcaaatctaattctaaaccagataagaccgccttataatgacgaacttgattttctggttcaatgacaataaagcgttgtgggtcaagcgcttcatgaccatcatcattacgggcaatcattgttgacccgtcaattgaggcttttttcccaacgagcactgttgtacatgaccctttacggcgattttcaattttcatattagttctccctttatattttatagaatacattgacaaaaatatcaacaattgtgtttctagcagaaatacaatattaattgatttttttcagaatttctatcagtaaaatttgtttacttttatttttcaagttcaagcatttttttaacttctgttaaaattgcaatttgctcatttttcaactcatttttaactatttgttcttcaatagtttttaatatttttcccaactctggtccgggcttaagggaaaattcatccatcaaatcttttccagcaataacaatttctgatttatcatgaatttgcaattggtcattaataaaaactgctcgttctctgtcaatatcccttccaaaagcaattttcaactcatcaaccagaagtgctttttccaaaccaaaatgataaagactgaccaaatcccaattttcaagttcataggctgaaacaaggtcagctacatattttgaaaattcatttgatactttccatttgcgcaaaaaagccttcacatcaatatttgaaaatctagtcagtaaggctgcccatgcttgttctgaatttttaaagtgaaaatctactgacagctctgtcagcactttttttaaggctaaatcttgaaaatctggtaagtatttccacgcttctgattcaatcaataaagtcagaccattgcgccattcactccccaacaataatttatctaattcgataaatattcgctcaaccgaaattttttctaagaggtgagaacgctcacgcatggctgaaaaagttttctcttcaattttaaaatccaaagtggaagcaaaacgcatggcacgcataatccgtaaggcatcttcattgaaacgctccaaagcgctcccaacagctgtcaatcttcgttcttttaaatctgttaaaccatcaaataaatcaatgatttgaccctcaaaatcacaggcaaaagcattaaccgtaaagtcgcgccgttttaaatcctcacgcaaatctctgacgaaatccacatggtcaggtcgtctgtaatctgtatattttgattctgtccgaaaagtagtaatttcataatgctcggcttccgattttccagctaaaacaagaacagttccatgctcaataccgacatcgatagtataaggaaaaatatcttttatctcctccggataagcactcgttgcaatatctacatcgtgaatctctcgcccaagcaatacatcccgtacagaacctccaacaaaataagcttcaaaaccatgctcgcttattttttctaaaaccggctgagcctgtacaaactcctcgggtaatttttctaatttcatatcttttattttatcattttttatagaaaaaggggcatagccccattataggcttccaattttactgacagaatttttgaatactattaaaatactgaccaaagcacataaacttctaagtaaagactagtcagtaagaaaaaagcacgcaagcccaaaaaagggttgacgaactttttccgatttttatcagtaatttttattccattgacttttccaaattaatccaataacgacaaatttcgtctccgtcaattttcacagtattttctaagattccaccatttacttcaatcgttttacgactggccacatttcccttgtcagcagaaatcattacttgagaaatcaaacgtttttgatatttgggcagggcaaaattgaccattttttcagcaatatgctgacctctaaaatcaggagcgataccataaccaatatgtccgccccattctaataaaattcccttttcaatttgccaacgacaagatatttcaccagcaatttgtccattaatgaaagcaaagtatttagtagctgttgaccagtctggcttttcagcacttatttcctctttccgaattttttccacatattccgcaaaattatccaaattaacctcggcataagtttttacagcatcaatcttaaaaggacttgtatctgttgaccaattatgaatataatccataaatgcctcagcatcacttaagtctaatctacgaatttccaaattactcataaagcaccccactaaaggttttattatagaaaagctcttgcaaacttactctatcgtcaaaaaaattataaatctaaaaagtgttctaagccatattttagctcagaaacggtcatcactttacgaattccaagtgcaattccagtcataaagcttgaacggtcgtaagagtcatggcgcaaggtcaatccttcaccttttgagccaaaaatgacttcttgatgagccaccagacctggtaagcgaactgaatgaatcctcatcccctcaagaacagatccccgcgccccaactaatgattctttttcatctactgccccttgatgatgagccagacgttcctcagccatcaattctgccgtttttacagcagttccagaaggcgcatcctttttaccatcatgatgtaactcaataatttctacatctgggaaatatttcacggcctgtttcgagaattgcattaataaaaccgcacctaaggcaaaattaggtgcaattagtccacccagttctttctccctagaaaattttattaaacgagccacttcatcctcagtaaatccagttgtgcccacaacaggtcttaagccatgttccagcgcaaaataagtattctcataagcaacctctggagctgtcaaatccaaccaaacgtctgcttcaatattctctagctcctcttttcgattgaatacaggaacatcaaaggcctcagaaacttcttcttttctccctaataaagcgacaagttcaaaattaggagcgttgagaatcatttgcacagccgtcgaacccatttttccacgaaatcctgccacaaccactttaattttattcaaaatcatatcctcactcaaacattttattataataaaagaattaactaagtaaataaatcagtatttgttagtaaccgctattatttctattattcagaatatttctctttacataaaagcacgtttttacgtgctctatttttttggagaaataccataagctacagtattcaatcctaaatgtgttgcaataacaggaccaaaagtaactatttcaacatcatcaaaaccttgtgataaagcaaagtcatagagctcttgtgctctttcttctgctctagtttgaatgacataaaccttgtagtctgaaggttcttgtacttcttttagtaaaagttctttcatgcgactcattgtttttttcacagtccgaactttttcaaaaacttctactttcccttcagtactaaaagttaatactggcttaatattcaataaagtaccaagaacagccgcaccattagacaaacgccctcctttggctaaccaatgcaaatcatcaacgagcatataggcgcggtcgccctctctttgttcttcaaactttgcaataatctcatcagattctgcacctgcttccgccaaatccaaaacagtttcaaccatataacccaaaggactagaggtaataaaagtctcaggaaatagaactttcatttgttcatattcgctttgtaagtagaaaatattttgataaaatccagaaattgcagctggcaaaaagagacctagaacgtgagtatatccttgtttttctaaatcttttaaaagactatcaagttcagctacactaggctgtgaggttttaggtacttcctgagccttggccataaggtcataccattcttcatgagaaatcttttgtaaatcgtaatccactccatcaattgaaatcggaatatccaaaacaaaaagattttgataagttttatatttttcggcaaaatctgccgacgagtcagtaataacagctaatttcataagtcaattctattaattaaaattctaagttaattccaggctgatctaaagcaacctcggttgtttcataaaccaaacgttgaagaagatcaaacaaaggtgcagcaagttgagctaattcttcttgttcaagttcttcttgttctttgatgatttttccgcgtacataattcaattgacttacaaaacctgaaagtacgatattatccaatacaatcaagtaggttaagacagcatgaatcccagtatctccgtcacccaatttttcaagttgttctttaggaacaagttgaaattgaacatttagatttgtttcgggcgttccattttctttttcccattcataattacgagcatcataatgaaattggttaacaaattcttgttctctttcaattgtcaaagtcattttaaaattcccctatttttattttaaatttagtcatattccaattcatgaacaataagaacacacatttcattatcctaattcaataggcatccccaatattcactaaaattcttaacactacttcattctaccacatcttgaacattttcacgcaataattgtagcatttttagttcttcgtcattaggttcgtatgtatccaataaatctggacggcgctctagtgtttttttcaaagattctctcaaacgccacttgcgaatattctcatgatgaccgctcatcaagacttcgggaaccttcattcctctaaaatcttctggtcgagtgtattggggatattctaaaagcccactagaaaatgaatcatcttcatgactagccgctttccccaaaacgccaggtataagacgaacaacagcatcaatcattacagttgctgccacttctcctcctgttaagacaaagtctcccaaagatacctcatctgtcaccaaagttttaattcgttcatcatagccttcgtagtgtccacaaataaagattagttgttcttcttctgacaattcctcagccattttttgatcaaatttttttccggctggatctaaaagaatcacccgtgcaggcttttcagatttttgtggaattttatccatcgtatcaaagataggttgaggcatcaacaacatcccttgtcccccaccataaggcatatcatcgacatgtcgctgtttatttgtggcattttcgcgaaaatcatgagtatgtaattctaaaatacctttatcttgagccttgccaactattgactggttaagtggaccaaacatatcaggaaaaatacttaaaatatcaattctcatgcccttagtcatccaatccttccatgatgtccacatcaactcgatgctgagccacatctactttcaggacaacaggtgggatataaggtaaaagtaaatcacgttttcctttacgtttaacgacccagacatcattggcacctggttgaagaatttcagagatctgaccaattaaaatgtcattttcataaacatcacttccaataatttcatgatagtaaaattccccatcatttaactcttcttgattttcttgcgcaattttaacaacataacctttatatttttcgacatcattgatatgataaaatccttcaaatttgaccacataaaaattcttttgtaatcgaccagatttcacttttaaatcttgaatatagttatctttatcatcaaaaagtgctaatactgccccttttgaaaagcgctcgttagcaaaatctgttgatggtagtactcgaacttcaccttgaagtccctgtgtattaacaattgttcctactttgtaaaagttttccattccctaattataacatatcaactaagccctgatttaaatgaaactatttttgagcagatttcttttaaagaatacaaaattttaaaatttttgaaatataaagggctcaattttcagcagcaaatataaaatcataaaataaaaaagctattcaaaattaaatagccttttattttactcagtcttattcaagcaggaaagccttcattttgtcaataaaagcatctgctttagtatctaaatgaagggcatgatagccctcagcaacttcaactaattccaaattagcaccagcattttcagcaaaggaacgaatcgctaacggtgaacaaatttggtcttcttctccacaaaataataaggtcggtatctttaactgctcggcctgactttgggcaaaacgtcctgcttccataatttgtgaaaacaaacgtaaagataatagttcatgatatattccatctttagtcactaaatcaactaagtcactccgatgagagattgcatcaactttaagtcccgtacgaactctaatttttgaattaaatttccctaaaacttgagccaacttttgtaggggaatagccggtggatttgtcaaggcaagccaaggagattcaataactgctttttgataaagtttttgattttcaacatttctcagcagaacattcagtgaaatatttcctcccatactgtgtccgaagagataaactggtaatttgggatatcttttgccaattatttttcggacttctaagacatcactaataaagttttcataatttcttgctcgtccttgaagtttaggtttagctgctgctagaaccccatgtcctctttggtcgtgcataaagcaaacaaaaccagcattaactaattcattgattaaatataaataatgacccgtatattcgccaaaaccatgaactaattgcaccacgccttttgctttttcttgtggttcaaaaattccaagacgaatccgatagtgatctttcattgaaataatttcatactgtttcttcattaagcatttccttttactctaaattttaaacttcaacttcaacttcaactttatttttctcgattacttcacttagtactttagtaaattctaaagaatcgttaaatggatggacaaaatcaaaagtctcgcccccattttccacaaaaacttctttattttcaatttctaattcaaataaagtttccaaacaatccgccacaaaagctggagaacaaattaatactttctttgtatcttctttaggaagctcagcaattctatctattgttgcaggctctaaccatttctcaggaccaaattttgattggtaagtatgctcgtattcttcttcctttaagcctaatttttcaacaactagccgcgtagtttcgatacattgtgcctcataatcatctttcttcttcgttacatacgatagtggaatgccatggtagctaagaataagcttatcataatgattggcttgccatttttctctgatagactctgccagtaagtctgtataagattcaatctgatgaaaatctcgaataacattaattttgtcatcaattttcttaacttgttgaataattggctcaacggttgttaatgagtattgaggatagagtgggagtacagtaatatcctcaactcctgattctttcatctctctaatgaccttatcaatgcggggctctccgtaggtcatggcaaagtgaacatcaaagtcttcacgaagtccttgtaattgttctgtttgggctattgtgtaactcatcaaaggtgaaccctcgtcagtccagatttgtttatacatctctgctgatttttgcggtcttacttttaaaataataccattcaaaattggaagccaaagccatcttggtttttgaatgacgagtggatcacccaaaaattcttttaaatattcccttacatcctctgtctcacaagaacgaggcgtccctaaagctactaataagattccttttttcttatccattatccacctatataaaaatcagttaatttatatttatcactgattatttctacaattattaatcaatattttttcattctagcatatttttggggacaataaaaggaaattctaaataactattttatttctcaaaagaacgttccgttttccaaaaataaaagaactcatcaatgatgagttcttttatttttacttattattggtccacgaggagtcgaacttttttcccttcaacaggaacaaagtatacaactgtacgaatggcttgaataatttgaccttgacgtccaattattcttccaatatctccgtcagcaactttgagatggtattccataaactcctcaccttcaataatttccaaagaaacttcatcaggctgagtcaccaaaggttttacaatagttaaaacgagttctttcacatctttttgcatttcttacctctactctaacttgaaagttattcaagtccattttatgtgatttttatattcacgaaaagctgctaaaaagcagcttatctcaaaaattatttagaaagttttgattcgtggaattttttcataacgcccgcttttgaaaggaggttacgaactgtatctgaaggttgtgctccgttgctcaaccattccaatacgcgttcttctttaagagttacttggttttcagttacaagtggattgtaagttccaactgtttcgatgaatttaccatcacgtggtgcacgtgaatcagcaacattaatacggtagaaaggttttttcttagaacccatacgagtcaaacgaatttttacagacattttatatttcctatttcttttttattatatttaatattatagcagactaatttcatgctgtcaagaaaaaatcttgacaggctattattttctcaaattttttagtaaattttgggctacttcttgattcatcactttttctttgcgcaattgttgacttaatatcgcgatttcatccgcttgtgctcctacactcaaagccaaagaacgagcttgtagactcatgtgtccctgttgaattccttctgaaactagggcacgtaaagcggctaagttttgagctagtcccactgcagcaataacttttgcgagctccttagcatcactgatacccagaatctccatggccgcttgtgcttttggcaaaaccttgactccccctccgacagttgccactggtaaaggaatttcgagttcgccaactaacattttctcttgaagttcccagttggctaacccttggtaggctccatcttttgccgcataagcatgaatagcagctgagatggcccgagtatcatttcctgtagctaaaatgaccgcattgataccgttcataatccctttgttatgggtactagcacgataaggatcaatttttgaatattgggaagcagccataattttttgaccaatttcatatccatctgctttttttgaaaggcgttcaaccggaatttcacaggtcactttcactagtgattcagtagcataatttgataaaatactaaacagaattttttcatcaggaaaccacctccgaaagagttcagcaattccctctaagattgaattaataatatttgcacccatggcgtctttaacatcaaccttgacatcaacagataaaaacttttgactagagaaaatccgactagaaacctctctcaaaccgccacctcgtttaacgattgaagggtaagaaagttcggcttgttcaaagattttttcttgcttttcaagtatttcatttgcaatcttatctgaatttttaacatcataaaatacaatttgaccacgcattaaacgttctttaatttcagctacaaaatttccagctatttttgctccattacttgctgcggcaattactgacggttcctctgtaaccattggtattagaaaactttgtccattaataacaaaattttgggcaattcccattggcaattcaaattcagaaatttgattttctatgagattgtccaaaatagttgtatctagggccatctcacttaaaatttcttgactcttttcggataagtttaacgaattcaatcgctcttgtggcgacatttgataaaatttttttctcatatttcccaaaaatgcccagaaatactgggcaattcctccatcaatttttaaaagtcaggatttttcaataaaatagcaagccctagaccaccgccaatacaaagactagcaattccataacgcttttgttcacgtttcaaagcatatcccaaagttgtcaggattttggcaccacttgacccaatagcatgtccaagagcaatcgctcctccgtaaatattaacttgagaatcttttaagcccaattcacgattaacagcaatacttgatgcagcaaaggcctcattaatttcaaaaagatctatttctgaaagctgaacgcctgagcgttgaactaatttttgaattgcatcaatcggtgatactcccataattgcagggtcaataccaacttccgcactctcaactaattcagcaaaataagaaatcccatgcttttcagcgtaatctttagtagccaaaattaaagcagaagctccgtcattaactggtgaagaattcccagctgtaactgttccattttccttaaaggctgtccgtaatgtagccaatttttccaagctagatgaaggtcgaggagtttcatcaacagaaagttccccaagagctacaatctcgtcattaaaaattcctgcttgactggctgctactgccttctcttgagaattttgtgcgaatcggtcttggtcagcacgactaacatcaaactgctccgcaattgtttctccaataattcccattgaaatgccagaaaaagcatcaattaagccgtcacttaacatgcttaatgtttcttcttctgtattacgatttttaagaataggcgcattagacattgattccgttccaccagcaataacaacttctgcttcgcccaactgtaaaagttgcttagctagaattactgccttcattcctgaaccacaaacttcattaatggttgaagctggaacactggttgataaaccactattaatcgcaatttggcgcgcaatattttgaccattaccagcttgaagaacattaccaaaaataacttgttcaacatctgattttatatttttattttttgacaataaagctgaaacaacgtgtgttccaagtttttctgccgaatactcagcaagagcaccatcatattttccgactggtgttcttaaggcgtcaatgattacaatttctttcacgaatgaacctccgaaagtcattatagcatattttaaactacttttgtcaaagtatctttacattaaattgtggaaagatgtctactaagtgacgaattatctgccttaattttttcaaagcatctatcatttgtaatatctgttctacaagcttgttagagtaaacttccttagtattttatagataaaaaacatcttagctaagaatttaacgtatttttatgataaaattaaagcattccaaagacatttgaaaggagttcctttcttctataatattagtagataaggaaatttttaaaatatgaaagtcggtattgataaacttggattttttgttcccagtacttttgtggacatgagggatttagcagaagctcgcaatgttgatccagcaaaattccagataggtattggtcaagatgaaatggcagtgaatcctgctactcaagatataattacttttgcggctaatgcagcagctagtattttgactgatgaagataaagaaacgattgacatggttattgttggaacagaatcaagtcttgatgaatcaaaagcttcggcggttgttgttcatgatttactcggcatccaaccttttgctagaagtatcgagatgaaggaagcttgttatgcaacaactgctggccttgctttggcccgggaccatgttcttttgaaccccgaagctaaagttttagtcatcgcatctgatattgctaagtatggtctaaatactggtggagaacctactcaaggggctggaagtgttgcaatgctcatcactgctaatcctaaaattatgaccttaaataatgataatgttgctttaactcaagatatctatgatttctggcgaccttttggtcaagcttaccctactgttgatggcaaattttcaaatgaaacttacattgatgcctttgctaaaatttggaaagaatacagtcgccggacaagcttgcactttgaagattttgctgctcttgcttttcataccccttacacaaaaatgggtaaaaaagctttgttgccaatgcttgaaacagagaaaccagctaatgctgaagaactgatggaacaatttgaacgtggaattgtttataatcgtcgtgttggtaatttatatactggttctctctatttaagtctaatctcacttttagaaaactctgataaattgagcgttggtcagcgtattggactttttagctatggctctggtacggttgccgaatttttctctggtgaactcgtcgaaggttatgaaaagcacttacttaaagttgaacatcaatcaatgttagatgcaagaagtcgcttgagcattcctgaatacgaaactatgtttaacgaatatttagacctaaatcacaacatttcatttagtgatgatacagcctattctgtttcagaagtcgttgataaccatcgtaaatataaaaaaatataaaaaaatactgacagcttttctgtcagtaaattaaaaagtcctgataggactttttttattttatttgctcaacaatgataccgcagcttcgtcagcaataacagtaacattcgcatggttttgcaaaattgatgctggaagttcagtagtcacttcaccttcaaccattcctttaattgcttctgctttttcttttccgtaagccattaaaacaatgtttttagatttcataattgatgcaagccccattgaaattgctttacgtggaacatctgcttctgattcaaagaaacgagcattagctttgattgtgctttcttgaaggtctacaacatgagttgtaatttcagctggtgttccaggttcattaaaaccaatgtgtccattttgaccaattccaagaatttgccaatcaattgggttttcttcaataatttggtcataatgttttgcttcagcttcaaggtcagttgctttaccatttggcaagaagttttctttaaatggtttttctccaaacaaatgtttagtcataaagtaacgatatgattgttcatcagaaccatcaagtcctacatattcatccaagtttactgataccatgtttgtaaaatcaaggtctgaattaacgatttgattataaaattctactggtgttgaacctgttgcaagtcccaatgtttttgcaccattgttgattgattctttaagaagatcaagtccgatttttccaccttcaagttggttttttactacgataactttcatttttatatgctccattcctaaattggtatatatcaatttttctacactttcattatatcataaaataagaccatgtcaactaaaaattgtcttcaaaaatatcaaaattaaaataaaaaagctctttaataaagaactattttattttgctattttattgactgattttataattatgacatatattttccaacaaaattccatacatggctccaatataagtcaggatttattttttctgattcaccatgtcctgctccgtgaacaaccaatttttccttttcgaccttagccgtattatagagaggttctaacattttaaaaggaacaaaagtatccttatccccatgaataaagagcattggcgttttactctttgctacttgtttaatcgcagaagacttgaagatattatatcctgctctgatttctgtcatagtattcgcagcataaaggacaggaaatttaggcaagccaaatagttgttttagctgataagtaaaaacatctccggttgaagtatagccacaatcttccacaatggctttgacattagagggaagtttttctcctgaggtattcatgacagtagctccacccattgaaacacctagcagaacaatctctgcttgagggtctcgttgagtgattgtgttaatccagagcagcatgtcttttcggtcatcccaacccataccaatataatctccctgacttttcccatggcctcttaaatcaggagtaacaacattatatcctttattataaaaatgacgtgtccaactagccatatcacttgattgaccaccataaccatgcacaacaatcgcccacttatttgtctttgatttttgaatataatctgccgcataaagtttcaattttaacttatcatacgaagtgacataagaggctgttggcttaacctgagccataaaggcttcattttgctcttttctctctttttcttttttagagagtgttttttgcttttttgaatcattattcccagtcaaaaaagatttgctggtatgcgcattaatagccatgccataaaaataatttccgattgcaaaatatcctccgaccaaaatcacggataaaaccaccagaatccatataatcatctttttccttttttcataatattcccttttatatttatattttactattgtaatattaaaacctcttttttgcaaattcttatattatttagtactaattttacgatacgtcatctttcgtcatataaaaaatcatagacttctcaaagctagtactttcaaaaaatgatataatagtgaagtatgttttttctttttatataaaattattctatgacaaactgataagtttgatgagatagacctgaaaagaaaggcttgaggaaaatctaaaatagtttagcataaaatatattttagacccttgataaaagattggagtaaaataaaaacaacttatgaatataaatgattttgattttgatttaccagaagaattaattgcacaaacgcctttggaaaaacgctctgaatcacgtttattgattctcgaccccaaaacagaagaacttgaagatagacatttttataatattattgatgaactcgaggccggagatgctttagttttaaataatacacgtgtgcttcctgctcgtttgcacggtgaacgtgctgaaacaggtggtcatatcgaactacttctgctcaaagatatgggagaaaatcgttgggaaactttagctaaacctgctcgtaaaatgaaagttggcgaggaagttgtttttggtgacggtcgtttgaaagctgttgttgttgaaattctcgaacacggtggtcgaattgttgaatttaaatatgacggaatttttctcgaaatcttggaaagcttaggagaaatgccattaccaccatatattcatgagcaacttgaagaccaagaacgttatcaaaccgtttttgctaaagaaaatggttctgccgcagctccaactgctggtttgcattatacacctgaacttttagaaaaaattgctaacaaaggggttaaaatcgttgagttgactctccatgttggcttaggaacttttcgtcctgtcagtgtagataatgttgatgaacatcatatgcatagtgaattttatcgtctgacagaggaggctgccgcccaactccgagccgttaaagccagtggtcataagattgtcgcttctggaacaacgtcaattcgtactttagaaacaattggtagcaaatttgatggagatattcaagctgattctggctggactgatattttcattaaacctggttatgaatggaaagttgtcgatgcctttaacactaatttccacttaccaaaatcaactttagttatgttagttgccgcttttgctggacgtgacttcgttcttgaggcttatcaacacgcaattgatgaaaagtatcgcttcttcagttttggtgacgccatgtttgttcgtccaaaaaaataattactgacagaatcatcagtagaaaatgaagatctgtcagtaatgacagacttttttataggaatctttaaatgagttttatcaatattgtcatgttacctgattttatcagtgtcatctccgatggacaaattacgaccaatgaacttctgacgcaaagtcattttaaaaaatttgaaagtaatccgaatggtttcgttgttggaattacaggatttgaattaatcactaataatattcgaaaaaaattctattatcagccaaatttatcttttgaggatgctgagcttttacttagaaatgaactcgaaaaatataaaaataaacaagtgatttttggtcagaatatctcatttaatgcaatgattgctgggtttcctctggcagctccgtctctgccaagagcaatcagttttcacgttgaaaatcaaacgatttctgaacaaaattatgaaaaatcagcagttctttctctagttcctgacgatatcaattttaatcctaatcaaattatcactgataatcttcataagacgaataatatcagcccagttttccaaattcaaactcttcaacgtaatgcactctataaagttgctgaccaatctaaaacggtcaataaagtcatttttcaggaaataattcaagccaaaactactgacagaagacaataatctctctgtcagtaaaactataaatttcgtcaataaaaaaagactgaattaatcagtctttttttcatcatttttctgttgattagcctttgataaagtcaatttaccgtgagaattgtatttttttaataagtcatcaatccgttcatctgtccaataatcggctgaggcaataaaatttccgtctttgtcacggtcaccaataattttaaatcccatttttaatctccgaaaatattgatatttttagtctacaaattcaaattcaaatttttgaattcgtacataatctccgtctttggcacccattgagcgaagcgtttcatcgacaccgaaggcacgcatttgccgagcaaatttcattactgattcatcatggtcaaagtttgtcatgataaagagtttttcaattttctcaccagataaacgccatccaccatcatcatcgcgtgaaactttgaatggtttttcttcgtcttcaaagccatagtaagctacttcatcacccaaggcatcttcgtcataaagtaagaattctggtgtttgagcaagtaattcactcgtacgagctaacaagccttgtaatcctgttttagtcaacccagatacttcaaaaatttcaggcatttcttgatctgcttctaaatcagcagctaatttttctttaaattcggccaaacgttctgctgcttctggcatatccatcttattggcaacaataagttgtggacgttccatcaagcggagattgtaagattccaattcatcattgattgttttgtaatcttcataagggtcacgtccctcaagttcagacatgtcaagaatatggagaaggacacgtgtccgttcaatatgacgcaaaaattgaattccaagtcctgcaccagagtgtgctccttcaattaatcctggcatatccgccataacaaaactatcgccataaccgacttgaaccatcccaatatttggtgtaattgttgtaaaatggtaagctccaattttaggacgagcatttgaaactactgacagcaaagtagatttcccaactgatgggaatccaactaaaccaacatctgctaaaacacgaagttccaaaagtagaatcttatcttctccaggttctccattttctgccacttctggcgctggattacgtggtgtagcaaagcgaatatttccacgaccaccgcggccacctttagcaaccacaaattcttgatctttttcaatcaaatcgactaaaacatcgccagtttcattatctttaacagttgtcccttgaggaacatgaacaattaaatcttcggctccacgaccgtgcatccctttgttcattcctttttcaccgggtttcccacggaagatgcggttgtatcggaaatccatcaaagttgacattccttcatcaactttaaagattacagaaccccctttacctccatcaccaccggcaggaccgccatctggtacatatttttcacgacgaaaagcaactgcgccatcgccacctttaccagcttttacttcaattcgtgctgtatctaaaaataaagacatacagtttctcctctaaattttctttaaatagtttatatattatttttccacaaaaatgcgtgctattcattatagcattttatccagcttttttatagcttgccctatgctaaaaaagtgacaatcctaaattatcactttttttacttttaatttgagctagtcgttgtactttgagtagtactttctccgcttatttcagcctttttagcattttgagccgaaatagaagccgacttagaagtggataattgagaaagataagcatcataggccgctttaggtttcgtataaattcccgcttccatatccactacttgtggagcctgaacttgtttagcaatgcttggataataaggaagtcgatcagccatttgactgagagagacacgaacctgatttccatcactcatatcaattgcgataaaatctttggttgcatctgtaggagttttcgttacattcgtcatcaaagctttgatagctggtttaagagtttcataggctttgacaaaagtctggacttcttcatcagtaaaatcttgtaaaactggcaatttttcaagtttgctggcatcaaccggtgtcttaatcacatagccattatttaagacaagataagtttgattattccttttgacataaacactattggtatgttcttgaacaaccgcctcaaatcgatttggaaaatgatagttaatcgtgacagtagaaattcgaggaaatttttgttcaatcgttgactcaattttcgccttattattaagaattttaaaaatactatcacttgtcttaatttctgaagcgagggctacttgttctgaactttcatttttattccccgatacgttaaaagttgatattttactcaaaggtgaaatcaaatagagagagcccaaaaagaccagaataacaaccaataaagctggccacgttttctttaaaagtggagctgagccttcaaacaactttgaaaatctagctttttttggcttctcttcttcttcgacttcttgagaaagagaatctagttgagcaacaatttgttcattttcagttgaatattcgcttgattggctttcttcttggtttacttccaagttttcatctaacaactcagctgactcagcttgaccttcagtgtcatcaaagtttttttcagtttttggaagacttttaagaaaaggagagctcaagcgagcctttttaggctgatttgctttcttttcttttttagcttcttcagcttttcttttctgatattcaagatgtttttgctgccaaggggttaagttattatctttttcactcatttagttactaatctctttcactagattgtaaaggcgttggctagcatctggaacgcctgcttttagactagatctttgcatttcttgatatttttctgtgttttcaagaatatctgaaatcgcttcgactaaactttgaccattcaattcttcatcttttacaataattgctgctccttgatcaacgtattcttgagcatttttagtttgttggtctgctgtgacatttggactaggaacataaaccgctggtaaacctaaagctgtcacttccgcgattgttgttgagccagaacgccctaaaaaaagttgactttttgctaaaagttcagtcatattattgatgtaaggtcgaatatctaaatttggattttctttatattgatcaaaagtttctttgtaatcatcataataaatctcacctgaagcataaactgttttgaatgaacgtttagccaattcaggcagggcttcaataaaagcattattaagttttaaagctccacgagaccccccaaaaatcactactgttggttgttcaaacttttcaacttgagcagctgcatcagcaacttcttgtgctcttggattccctgtgaaacttgttttctcactaggaaaatattgctccgctgcatggaaacctacggcaattcggtcaacttttttggcaagaaaacgattggtaattcctggaaatgagtttccttcatgaataattgttggaattttcaattgtgccgctgcaaaaacgactggtcctgccacatatccaccagttcctaacacaacatctggcttaaaatccttcataatttttttagcatctgatactgatttaaaaaatttataggcagtttttatattttgtggacttaatgaacgtcttagcccttgaatatcaactgttttcaattgaattcctgctcgtggaacaattttagattctagaccttttttagttccaatataaaggacctctgtatctggttcctcttgttttaaatatttcaggaaagctagggctgggtaaatatgaccacctgtgccgccacctgtaatgataattcgcatatttattcttctccaatggtttggggattcgctgatagatctaaactttttgagctttaaccgctatcttcttcactcaaatcaataaatcgaaaaaaagtggacgacaacgaaataaataacctacgagttagacctgataattgtcagtaaaatgaacttgtttatattaatctgtcagtaaattgagtattcaaattagtcccaattataattgtcagtaatttattctatcatattttttattttaagctctcaaaagcctcgataaataaatcgcctcgttcttcaaaagttttatattgatcccaacttgcacaagctgggctaagtaaaatggtatcaccaacttgcgtttgaggcatgatttctttaagagcagttgcaacattttgactagaaaacacaggaatattcaatttttcagccatcaaccgcaatttatccgcagtttgtccaaagacaaccattccttttaagtcttctaaatctttttctaaatcttcaaagccattgcctcggtcaagtccaccagctaaaagccaaagtttactgttgtcaaatcctgacaaggctttttgagtagccaaaatattagttgctttactgtcattatagacttttcgtccatcaatttcacctagatattgcaaccgatgttttacacctgcaaaacttgtcagtacttcaacaattgcttcattttctgctccacgtaattttgcagcgacaattgccgctaaagcattttctaaattatgatccccaggaagtgaaagctcagaagcctccatgataaattcatctttaaaataaattttcccctcattaacataagcacctgaaactttttctttagttgaaaaagcaaggaccgttgcctttgttttatctgctaatttacggcatttttcttggttaaaattgagaattaggaaatcatctgctgtcatattttcttgaatccgccatttagcagcttcatatgcttcttgtgaaccatggtagtccaaatgagcagaaaaaagatttgtaattaaagcaattttaggtctgaaagtatcaattcccatcaattggaaacttgaaagttccatcactaatgtgtcagtagcttgagctttttgggcaacttctgacgctggaaaaccaatattacctgataacttagcagattgcccatcagcatttaaaatatcagcaattaatgtcgttgttgtcgttttaccatttgttcctgtgatgccaataattggtacctcactcactaaatacgcaagttcaacctcagtaatcactggaatttttagagcttctgctcgctcaaccatgggattatcataacgaattcctggatttttaaccatcagtgcaaaatcttcgtccaacaaatcaatcggatgacttcctgtgatgactttaatcccttcttctaatagtacttgagcttctttattttcttcaaaaggtttgccatcattaactgtaacaatcgctcccaactcattgagcacaagagcagcagccattccagaacgggcaagcccaagaactaagattttttgatctttaaatttcgttatttttttcattttctattcctttttaagttgtcagtaaaatatttcactgacgactttatctaatctattttacccctaatcagcctttttttcaacagtcataattactgacagcactatcaataatttttcaaagaaaacaaaaaaaggctgacccatttgtcagcccatatttaattacaatgcttgggcatcttcttctgatgtccgaatacgaatcacacgttctactggttgaatgaaaatctttccatctcccacttcaccagttcgcactgctttagtgattacattaacaatttgatcaactttctcatcaattgagacaatttctatttttattttagaaagtaaagttgtttcaattcgctgaccacgaacatattccgcaaaacctttttgttcaccatagccaagaacttgcgaaacagtcatgccatgtaccaagccattgtctgatagagcttttttcaaatcttctaatttatccgttcgaataatcgcttcaatttttttcatgttttttctctctcttatctttaaaaatacatttccttcattttttaatataaatttactgacagacttatcaataaactaaaatcaagaatctaaacctaaaaatgttggataagcagtttcttcatgctcactatcatcaagaccaattgcctcagcacggtcagtaactcgaatcggcataataagtccaatcaccttaataataatccaactgacaagagccgtaaaaataactgtaaaaacaaccgcagtaagattagccaaaagtaattttcctgacccataaactagccctacataacctttttctggagccaaagctggtgttgcgaaaattcctgtcataattccgccaaacattccaccaattccatgacaaccaaaagcatctagtgcatcatcataaccaaatttcttcttgactacagaaatcataaaataagacaaaggactaaccaacaaaccaatgattatcgaagaccaaagagagacaaaaccagcacctggagtaatcgcaactaagccaacaaccgctccagaacaagcaccaaccactgaaggtttaccaatcataattttttcaataatcatccaagaaagcatcgctgccgctgcagccgtattagtagtcataaaagcattaatcgcaacaccattggcagcaagggctgaacctgcattaaaaccaaaccaaccaaaccaaagaagaccagcgcctaaaacaacgaaaggaatattatgtggacgataatctaaacgttcatagtctcgcctctttccaagcaccaatgctagaactagacctgtaaccccactagagatatgaacaacgtctcccccagcaaagtcaatcgcatgaatttgagccaagaaaccgccaccccagaccatatgagccagaggataataaaccaaaatcaaccaagctcccataaaaagtagaataggagtaaatctcattctcccaactaccgaacctgtaatcaaagcgaccgtaataatcgaaaacatcatctgaaaaccagaaaaaagaccgtcaggaatgtgattggcaggaaataatgaatttttggccatatctacaccattcataaacaaatggtcaaaatttccaatccaactattatttccagaaaaagaaaatgaaaagccaataattaaccataaaatggaagccagagccattggtgccaatgacatcatcattgtattcaatacatttttacgccttccaagccccccatagaaaaaggccagtgcaggtgtcattaataaaaccaaagctgcacaaattaaaataaatgcaatcgatcctgtgtccataaaaattctcctttaaaatttcgagattaaataagaaatttaccgatattttctgaatatttaatcatgtcataaaatataacacagttttttgttaaagtcaattatttactcatttcatgttatataacataacatgaaatgagcagataaaaaggaattatctaaaagataattcctttttatcatatttttggaaattttaaggtaaaagttgaaccaatcccaagctcagaactaacttcaatctctccttgataattttcggctaaacgagccagaattggtaaacctaaaccagttccgccaatctcacggttacgtgccttatccgctcgaaagaatcgctcaaaaagatgattaatatcttcttcggcaattccgattcctttatcagaaacactagtaatgacaaactgttcatcttctgaaacagtaatcacaatctcctttcgatcatccggagaatacttaacagcattatctaacaaaatgcgtaatccttgttcaaaatgattttcagatatccgggcatggacagggtagataagctgattatcaagtacaatctcaaaatcctcatgtagaagttggaagtttttaagcgcatgattagatactttcccaacgtcacaatccaattcttcactggacaaatctacattttcaagcctagccaaagcaagcatttcttcaagcattttcttcattcggtctacttcatccaaactcgcctgcaaagattcatccaaaacttctggatcattttttccccaacgatttaagagattaatatgaccgtccaaaactgctaacggagtccttaattcatgtgaaacatcagagacaaaccgattttgctgttcaaggtatgctttcattttcagcatcatatcattataaacatgagctaattcttcaatttcatcaccactttcaatttcgataggtttgaaatcattcgtggggtcgctcgccatttcctgcattccctgataaagtttttctaaaggcttcataaaataattcgccataaaataaccaatcatttgcgcaacgattaaagcgacaatttctaaaattaacaagacgactaaaaggagattggaaatccgatgataagttgtcgtgtcataaaatgcctgtaaatagcctacaacctgtcccgtccctttagaaacaatcttcctttggactaaataacctggattctcaccttgaatttctttcatctcattattgccttgcttttgaaatccaaaatcacgtcgattagttgaatatagtaatttatgatttaaatcataaatataaaatgctttccgagtcccgatgatacttcccagactcattccttccgattccccattttgaatctttgatgtcgcttcaatataagtattcaaattagttgaatttaaaggagcatccgcttgttctaatacctcttcaacgctgtccattgaacctgtcaataacctttgttcctccttgatgaaagaacttatggtcagttgataagttaatgttgcaaaaagagtaaaagtaataaaacaaaaaacggtgttagcaaaagcccacctaagcataatagaccgcttagccgaactttcttctaccgtttcctttttcttgttgaaagtgaataattttttcatttttttatttttttatttgcgttcacgcatcacataacccaaaccacgaacggtttgaatatagctgtcttgtccttcaacatcaattttatttctaagatagcggatatatacatcaacaacatttgtttccgttccttcttcatatccccaaacttgtgaaactaaatgttcgcgagtgacaacatccccaacattttgcatcaacgtcaaaagaagatcgtattcacgacgcgtcaaatcaattacttttttaccgcggtgaacggtacgatttgttttgtcaattacaagatcacgaaaagaagtgttttcagcacgttctacagcatgaccatgttcttcacgacggaagaatgcacgaacacgagccaaaagttcttcaatcgcaaaaggcttagtaatataatcatctgctccaatatcaagaccggcaacacggtccattgttgaatcacgcgcggtcatcataataattggagtatctttttctttgcgcaaacggcgggcaacttcaaaaccatcaagttcaggaagcatcaaatcaagcaagattaaatcataatcttttgaagttgcttcttcaagcccagaacgtccgttatctttaatctcagtggcatagccttcatgctctaattctaatgagacgaaacgagctaaattcttttcatcctcaataatcaaaattttctttgatgccatattattctcctttgttaaaaaaactgcataattcgatttcttataatactattataagataaatttaatttatgtacaaactatttaacgctttttttaaattgttttcgctttcttatgcttaacaacagaaattgttaaaaaatgagagccatctaatcaaataatccgttcaaaccatcaaaaggagatttcttttcttcctttttatcttcttgttgcttggcatagtcttcttcactcaaaacagaccaaaacttcccgcttggcaattcttctgcttcttcattttcagctaaaatttgcaacggaatttccaatagaatattatcagtcactgactcatctaaactaatgatatctttatctaaaacaataattaaatcattatctagtaattcctgatttccttttagcgtttcctcggttgcaaaaatttcgttgactaggatatcaattggatatttgactggtttcaaacttcttgaagaaggtagggttaaagtcgtttttatttgataatccaaatagaacaactcatcatcataagcaatttcaccactaacttcaattggtagacaatctaaaatttctgcggaacgtttcacaagttcctcgcgaaggtctaaattctcattgaaagcaatctgttttttttttgttaattcatttaaagaccatttcatcttttaatattctcccacaatttaatcatttttctttattttatcttatttttacattttttcataataaaaagctgtctaaagacaactttgatatttctaaaaataaaaatggtcgaatgaccatttttattattgtttgccgtatttcttttcgaaacgagcgatacgtccgtccgctgcttggaatttttgacgacctgtgtagaatggatgtgaatctgaagagatttcaacacgaatcaatggataagtgtttccgtcttcccattcaacagtttctttagaacctttagttgaaccagtcaaaaatttgtaaccagttgttgtgtccatgaagactactggttggtaatttggatggatattttgtttcatcgttagaatttcctttctgccttggactgtttgccagaccaaagttgtacgaatacttaaacattctatcaaaattcgaagtaaatttcaagctaaaataatcttttgtcaagaaaaaaactttacaaattatttctgtctctaagtaaggttaaaaaccaagtattttcaggctaaaagtttcttggcaaaaagtaaatttactttttaaatcatttcataagcaagctttgactagtctcttttagtcaaataattaaccacacgttcaaacttcttgttttatattcatgacttttgaaagttttaaaagtagttttctcttagattattatacctttttcctttaaattttctctacaggattcaagataggattcattatgctctggatatatgggcaaagtctgagtaatcttttttaattctagataagcttcacatttttgacctctatacaacggatcaaaccagctttcatcaggatgatatcctcttattttcatctcattcatcacttccagatgatattgaaaaagtttatatggagaataattgaagacgtaatttaccgtcgaatgttttttcgcctagccctttccacgtaaggcacaacactctcgatgttgacccaataattgtgctcttggaagtttttcaattaaagcttcatgccataatctcattgcttgtcatccttttctcttatctttttagtccattaatcactttttaatcaaaaaattcccccgaaggagaactttcttttctctatttacaacagatattaactgcttcttccgattgttcaaccgatgagttctagaatgaaacacttaatctctgaaatacagatagttttattataccttgataaaatgatgctctcaagtattttgacttcacaaccttatcccaaaaatcatttcccaattacataacgtaaacgactggcttgttctttgcttaagacttgataagagaacaatgtattataaccggttcctgattgcgaaattaatatagagccatccggacgaattttttctacaaaagcaacatgaccataggtagggtcagcaccatcttgtcccgctttatagctaactgcactatgaagttgaggagtggatgtaacttgatagcctgattgattttgccagtctttgccatttcccatgtaaagaccataatttattccaaattctttcgctcgattatagacccaccatgtacattgcttataggcgtaagtttgagttgaataattttcaatatccatcggtctatcaatagtccaacccgctggagtgcctggtaaactgtcagaaggcattgtcttccacgcagtagctccatatttccagcctacttttagcagactattttgctcaaaaaagttcgttgtataattgtgtgctccggacttagtatttgggttgtaagcaacgtaaagattaaccgttcctgctgaataaaaaaccggtttggccccattatcccaacgccaacctgcttttactaggctttgagcctcataattactcaaggtataatagtggtctccccctttaacgtttggattataaaggcgataaactggcgcacctgaatttgctgcttgccaaccaattccctcatcaagccaaccgacattttttagagaatttccctcataaaaattcgttgtataaaaatgttccccgctgttgggattataaagccgatagactgggcttttagagcttgcctttacttggttttcattagctaccgtgcaagcacttgttgctccaatcatagctaatagtaaataaatctttttatgccgcattaaggtcctccatctggcctaatttaatgtattctatttaaactctataatagctcgagtaaaaagtcgagcgatttcattttgtaaatttttcaaaaattaaatacagcaatttcaggaacaacaccaaatctagctgataagtgagttgttccaatacctgtattcacataaagggtttcatttgtatttaattgataaagccctccagtgtaattatttgaatgtttcatgacagaggcagcttttttctgaacttgagggataaaaggaatatttacctgaccaccatggctatgtcctgataaaatcagttcatatcccttaattctgatactgacttacttcatcaggttcatgagtcaatagaacgtcataagtactttcttccatctgatatgatgatggtaaagaaggatttcctagcaaggcgtcatctaagccagtaaataggattttttcgccgttattcatagggataagtaaattttcatttcttaaaagagtgaaaccagactccgacataatattcgcatattctctggaagctcctcctccataatccctgtttccccaaatcgcaatcttaccatattttgctttcattttttggagttttgaaatgacttgttcattttcattatagtgagcgtaattatcgtataaatctccagaaaacacgataaaatcaggattttgttcattagttttctgaataactttatctaaatgctttgcatcaaaatctttttttttggcggtttttttatttctgtcagtaaatatatatcttcaaaattactgacaggctcttgttttcttattcaaattcaaaacttttatcagcaatatatatttgatttttaggaataccaacggtttttatctttttattcttactaataaagattgctccataaacttctggatgctctgtcagccaattttcaattggtccgtcagcaaaaaataatctactcgtttcaatctctccatcaatggattttctcgataagaccgtgacacttgcaagtgaattggggtgaggataacctgtttctgggtcaataatatgatgataacttttattattgacttttaaataacgctcagtaattcctgaggttactactgaactttcctcagtcaaaatctgtaaaataggttctttgcgactacttagtggatttttaactccaacacgccattttttatttgtctgatggggtgcttcacccattaatagaagatttccgcctagattaatgatgcctgacgagacgccataagccctccaaaaatccttgatccgatcagcaatataaccttttgctattgcccctagatcaatttccattccttttttaggaagaaatattgaaaattcttcatcctttaaaacaatctcatcaggattgataagttttagtttttcagagatttctgcttggcttggtactttagcatctgaaaaaccaatgtgccaaagtttaactaaaggcccaattgctgcattaaatccgaaatgttctttacttttttctaaggaaatttttgtcagttgatagacaggttcagtaacttgtacactttctattcctgccatctgattaacagtcattaattcagatttttctcgatttacagtaaaaatatcttcataatatttgattaattgataactttggtctaaaattccttcgtcttggcaaccatagattgttaaatcaataactgttcctaatgctcgataagattttgtaattttgtttgccgcttttttttctaaagatttcattcgttttcaaaagtcccttttgagtccataatatcatcgggccacaaatcttcctcaagaaattgagtataggctgatatttcaggctcattcacttcttcattttcggtagctcccgtatctgcatctgaaaggagaggaaaaccaagactcgtgtcttcaatccaccaatcttcatcatcagcagcagcttgtttttcctctttagctttcgattttttttcaacttctttttcatcttgaatctccaagcgcatcggttttattgtcttactataaagcataaaattactaaaacaatgctctaaccagctaatcgtatgctcatcaatcaggttatcctgatgatcaaaagcttcggtggcacgccccaagagaaattgatttgaaggcaaaacaaaagcatcaagacctggtgaacttaagatttggcgaagattttcttgagcaaaaacggttcccatatttcctaacgaggccccaacaatcatgactggtctattgttcaatggctgatttttcccccaagagagccattcaactaaggatttcaaagcagcagtgatggcatggtcatattcaggtgtggaaaaaattaccccgtcggcatcttttatcgccagagcaattttctttactgattcaggaaatacttttgtatcctcagaaaatagtggaacatctgtaatttccactacatctatttgtgcttgatttttgaaatgttttttcatataccaaagcagttttcgattatatgaaaaactagcattggtccctacaatggcgataaatttcatcccatttcctctttcaattgataagtattctgtaagtgtattctatattttattctttattaatagtagcctttatactatattgatgtctatttcgacttactgctctttatattataaataaaaaatcacaactctataagaattgtgattcagatattatttttctcgacttaaatcgacttcttcaagtggaataatttttgtattatacttccatttataaccaaaataaagaacaatgaaaatcggaatagccgcatataaagctaagccttcaccccagtgctcactaaagagcatggctgggtcaagattaattgcgatggctgcagtcatcaagagcgccacaattggtccaaatgggaaccattttgctttgtaaggaagatcttccaatttttttccttgagcaatataagctcttctaaaactaatgtggctgacagaaattccaagccaagcaagaaatcctgtcagtgaagacaaatcaaccaagaaaagatagatttgcgttccaaatattcccgttaagaaagcaatgaaacaaatgattgtcgttgctagaagcgcataaaaaggaattccatttttagccgtgcggccaaagaattttggtgctcccttttcttgacctaaagaataaagaatccgagttgaagcgtacatcactgaatttgctgacgaaatgacagaggtcagaatgaccgcattcatcactgaggctgctacagcgaatccaatatttttaaagactatggtaaatggactcatgacagctgttgagcttgggttcaacaagcgagggtctttgaaattaataatagctgctatgacaataattgaaaagatgtaaaagagtaagattcgccagaaaatagaattcattgctttaggaatcgttttccctgggtcttcagattctcctgctgtaattcctaacatttcagttccttggaaagagaagcctgcaatgagtaaaacaccaacaaaacctgaaattccaccaacaaagccatgatttcctgctgtcaaattggcaacaacatcaacatttccttgtcccaagacttcaaaaattgttagtagtccaatggctaagaagagaataatcgtaatcactttaatcgttgatagccaatactcagtttctccaaaagcaccaactgccataacattaataataaaaattagaactgtcgcaattcctgaaaaaatccaggaaggaaggtgtgggaaccaaaactgagtaatcaatccagccgtcgttaaatccacggcaatcgtaatggctccatttagccaataattccaacctagtgcaaatccaaaggcagggtcaacataacgtccaccatagtcagaaaatgaaccagaggtaggcagataagtcgccatctctcccagtgaagtcattacaaaataaaccatgattccaataaaacaataagcaaggactgctccccaaggacccgcttgactaattgttgctcctgaggttaaaaacaaacctgttccaatggttccccctaaagcaatcatagtaatgtggcgctgtttaaggttgcgcttgacctgattttgattttccataatctttactttctaatctcttgttttttttacaaaccagagcacgagcaaataaaaagaccagttgtctttacaaccggtctcttgagaatcaccggcatagatacttgagcgtactctaaagctgtatctatacctactgtatgacacaactcttatctatgcaaatgatgatggcgcaatgagaagttattcatttcgtgattctcctttcgtgatttttctatattctatacctttttttttgaaattgcaagaattaatttaataaaaatttataattactcgtttttatgataaaatattcctatgaatacgaataaaaaaaataacaccattctttttacaatctttgggattgtcctaattgttgtcgttgggctcttagttttctttgcaaatcgcccaaaaacagatgatagttcagcaagtagtacaaatacttcttcttcaagtcaaaaagttaactatccaacaaattataccttaaatgctgcagtaaaaaattcaagtactgcccttaatgatttaactttaccccaactttcaacaactgttggtgaagacgaagctgaagttcaaatcaaaacaagtgctggaaatatcaacattaaacttttccctaaattagctccaaatgccgttcaaaatttccttgttcttgccaaaaatggttactacaaaaacaatgagttcttccgtgtcattaaagatttcatgattcaatctggtgacccttcaaacaaaggaactggaacagcttcaatcttcggtgggaaaacatttgatacagagatttcaaatcaactctataatatccgtggagcacttgctttagcaaatacagggcaagcaagctctagcagttcacaatttttcattgtccaaaaccctcaggatatgactagtcaaatccaagataagagcaaatatcctcaaaaaattattgatgcttataaaaagggaggatatcctagtttagatggaagttacactgtctttggccaagtcatttcaggaatggatgttgttgataaaattgctaaagccgatgtaaaaacaaattcttctggggaatcctcagcaccgattgaccctgtaaaaattaaatccgttaaaatccttaaagactggaaattttaatcaataaaaagttactgacagcttttctgtcagtaacttttttttatttcaataagtttttcatatcatctggcatgtctaattccacatgaaccatttcgtcagtaaacggatttaaaaattgtaaatgatgacaatgaagggcttgacgtgaaatcaaatcatgattttcaccgtataaatcatcaccaactaaaggatagccaagatgagaaaaatggacacgaatttgatgcgttcgacctgtatgtaaaataatatcaagaagcgctaaatcattttttcgctcagtcacaacataagacgtcagtgcattttttgatttttcatcaaaacgcacttgccgctctataatcgaatcatcacggcgtccaatcggtaaatcaatttgaccagaatccggcaaatctccatcattaataatggcgtaatatcgtttttctaaagtctctcgaaacttatgctgaaccattaacgcatgagcatagcgatgcttggctagaaacataattccactggtatcacgatctaatctagtaataatatgcacggtttgattgggataattttttctagaaatatatcctttgacagcattggacattgcccctgtcggatgaagagaccctgtgattgaagcctttcccgctggcttttcaacaaccagatagtggtcatcttcaaacaaaacattaagtggaacatcgtcaggaattaatttttcgttatctggttcatcaggtaccgtaatcgtaactaaatcacctttttccagacggtaaatagcagttttttcaataccattcaccataatttttccaccatcaaatttaacttttgtcagtaatctcctagaaataccatgacggcctagcattgatttgaccatgcttccttcaatctcgtttctaaaagcaaactgcattattcaacctccccgatgaaggatttactgacccgttcccaaaatggtgtatgggcgcaattagcaaaagaaatcgttgttccatctaaagaaaactcaattgacttaatatttttatattcaaaagttaattggtcaaaagttaaactataatcatcttctggcgcaggacaaaccgtaattgtatctttctcagccacaatcattggtgaacctaaagtccgataaacaacattattcaaactcgcaatttcagcaatttgcatggccttcacacgtggatggactactgcccccccaattgatttattataagccgttgaaccagttggtgtagaaatagataaaccatctccccggaagcgttcaaaaagataatcagaaattctgacatcacccaccattgttttacttgcacgtcgaatggttgcttcattaaggacatgacgaacaatttgatagccatcagtaaaactaacttgaacacgaattagtggatagtgaatggcttgagctggattttcgtcataaagtgcttcaacgacttcaaataaatcttcatcagtaaaatctgtataaaagcccaaatgtcccgtatgaacacctaaaaaacgtacccggtctagttgatactcgtacatatgcatggcccgtagaagcgttccatctcctccaactgaaatcacaatttcaggattaatatcatcaaaaacaaaatgttcagctttcaaaatcttgctcaatttattgagtatttttttagacttctcacttgaatttccaattagccagacttttttaccaaagttcattttcttcaccattttcttttttaaagtcttgtttttgctgagggctatcaaaaagtaactgtgcttcttgaatatcttcccgaatttcgcccatttcagaatcaagctgtgcagcttcacgcgccgcatttgtcaatctagctttgacatcctgaggaattaatcctccatatttataattaagagaatgttcaatcgttgcccaaaagttcatggccaaagttctaatctgaatctcagcattaacaatttggaagccatcaatcgtatcaatcggatattcaataatgacatgataagaacgataacctgaagctttttgattattaatataatcccgttcttcaattattttaaaatctttacgtttacgtaaaagctctagcacatcccagacatcatcaacgaactgaaccattacccgaacgccggcaatatcttccatttcagataaattttctcgggtataaccacggagttttgctttatttctgattgattctcgacgcttcacgcgccctgtaacaaactcaattggagaatacaagcctttcttgagatattgtttacgaacaccacgaaattttatttttaattctccgacagtttggacgtaggggtccagaaattcttcccaattaaacattttttcaccttgtaaaagcaatcgccctcacatactcctttctgatgtatttaaatattaaaacgttttctgacttcttttttattagaatcacatctaatattttaacataagtttctattattcacattattgttacttaaatggattgagctttttacaaaaaagaagcaaactttttgcttcttttagtcattaataatattttttatttttatcttttgtgaaaaatatctctgtagttcaattacaataataattgaaacaataatcaataaggtccaagaagaaattttccctaagtcaacgaatttccaagctttcagctggtaagaataggtccaagcgctgaaataagagccaatattttctgcgaaataaatgaaaagaccaattaaaaagaagcttaaaatagctggcatttgataacgctttgtccttaagacaaaagtaaattttgttttccagaaaataatcaaaataaagagataaaataaatttctaaagtcaaaaccaaaggttccgctaaaaaaattcaaataaatgattgaagatatcccaattgaaataaaccattttggccaatgaatgacttccaaatcaaattcttttatcgcccgaacaatataagagccaattgctgaatacataaaggcactatagagaggaacatccataattttgaatataccagcatctggataagaccaacttccatgtctgactttaaaaatttctaaaatcattcctaaaatatgaaaaaccattatcgggattaaatcatatacacgctcatatttactgaccaacaaaataacttgaatgaccaaaacacaaatcaataacgtatcataacgagcaagatgtggaatctttataaaggtggtcacaattaatgacaaaataatcgtaattccaaaaattgctgaccgaaattgttttaaaccgaaatcccagaaatctttcaagcggtacttctcatttacttttctcataaaaacaattctatcatattttcattttttagctaagctccttaaattttggggatttttccctttatttatctgctttgagagggatttgactgtcgttataagcggggcagaactttacttatagtcagccttttgatatacttttaattaatatatcgtttaaacctattgaaaggaaagatgttttcttttgaaaataatcttaaaaattaattaatgagtacgaacttggagattgagtataagtcgctattgtcgctggctgagtatgaccagctcaaaaaactctttactcacgtaacccctgttagacaaactaaccactacttagattcaaaagattttaaattgcgcaagaaaaaattagctttgcgaattagaacttttgataagtccgccgaaatgactttaaaggttccacaagaagttggaaatatcgagtataacattgatctcagccttgaagaagctcaacaacttcttggtgaacgaaatattgtttgtggggctactgatttaagtgaaatatgtgaattattgacggcacgcgatatcaatcttgaggaaattaccttgattggaagtttaacaaccattcgttatgagcaacaccttccgattggtcttgctgctttagataaaaatgattacttaggtcataccgattatgaacttgaacttgaagttgatgacagtaaacaaggtaaaaaagacttcttcgatttcttagataaaaatcgtgttgaatatcgattttcaaaatcaaaagtagttcgattcttagactgtttaagacatttacgaaaataatttttaaatatttactgacagcattctgtcagtatttttttataaaaaaaatgtctgattctatcaggcagttttttcaatttgttctaaatattgttgtaagagtgcatgagaacaattttccactctcaaacattctttgtcagttaaaattaaactggctggtgaagtttggaaattgttttttcgaaagtcttttaaaattaaagcaagatgttttttggcaaaagagcgatattccagaaagttgagtgtagaaaccccaatttcttgtaaaatttgctgacgaatttgagctgtatagtccaagatagttgtttcttccaaaaaatcttgaagtaaaaggagaaacaaacggccctgtttacgtccatataaattaacagttagataatcaagcgatactttttgcaagcggtcatagcaagcatttagtgagctaatagttttaggcaaatcttcctcatcacgtaattgcttagcagcaggtaacgtaacaattggatataaatgccaatcattatgatcaaattcttccaaatggtctaaaatgggagtgaagtaataatgagtctccaacatagtttttttccttggctctggtctatttttcatatttttagaaaaagaaatataaagcaatttatagaatacatcaatttcacagatttctttgacttctatatgaagtcctacaactctaccaagactcctctctttttttactatcttatcaaaaaatgcctgcccactcaaacaatatacaagtttattttctagtgagcacaaacttccctagtcacctatcagtgttcaagttcttctttcacttcaagatttgtctgaataaaagcttccgaaaagttttggtcgagttctttaatatgacccacacgtacctttttgacaaatctcaactcttttaatttatttaataaatcggcaacttcatcattattcacataaagtaagctatagtgcgatttctggctactataaacaatatcaccaaaacgactaagttgtctagttcctttataagagtaacaataaacataaaccgccacacgctctcttatataaagggggcgaatttcttttttttcaatgttttccatgatgtcgtccatgctgccctcctttcaatggtaaattttcatcaacataaatctgttcagaaatactctttgtaatttttttagtcaaatctgttaaaatttgctgaacgtcattttctgccaaacgtaaggcataaactttctcattcgtattaatttcatgctgtaacgtttttaattctggacgaaaagaaatgtagtcagaattatcatttaaaactttcaattggttttgcaaagtttcatctgccataaaatcagcttttgctttttgataaagcttgatttcaggaaattccaagaaactatccataattttttctaacaaatcatctatttccactagattttcatcgataattaacataaatttattatatcataaatatgaaatgatacactttactgttatctttagcaaaatagaatatgactcttgatacaattttattaatttggtataataattaacacattatcggaatcatctgataatttaaggaggaaaaacttttggaagatattcaaaagaatcatgaagcccaaaggggcttacaaaaccggcatattcaactcattgcaattgccggcacaattggtactggactttttctcggtgccggaaaaacaattcaaatgactggaccaagtgtcatttttgcttatattttaattgggattgctatgttctttttccttagaactatcggggaaatgctctataatgaccctagtcagcattcatttttaaattttgttaccaaatattcaggaatcagaacaggttacttcactcagtggtcttattggttagttattatttttgtctgtatctctgaattgacggccattggaacttatattcaattttggcttcctcatcttcctttatggttgattgaaattgtgatgctcgcacttctttttggtctcaataccttaaattctcgtttttttggtgaaactgaattttggtttgctatgattaaagtggcagcaattcttggaatgattgtaactgccatcattctcgtagcaagtaatttccactacaccacagtcttaagtggtaaaacggttaatgatacggcttcgctaaataatatttttgacggttttcaacttttcccacatggtgcttggaattttgtcggagccctacaaatggtaatgtttgctttcacttcgatggaatttatcggaatgaccgccgcagaaacagttaaccctaaaaagagtctaccaaaagctattaatcaaattcccgtccgtatcttgcttttctacgtcggagcacttctggcaattatggcaatttttaattggcactatattccagcagacaaatcaccattcgttattgttttccaactcattggaatcaaatgggctgcagctctcattaacttcgtggtattaacttctgctgcttcggctctcaatagctctctcttctcagcaacacgcaatatgtactctcttgccaaacagcatgacaaggggagattgaccgcttttacaaaactttctaaagcaggcatcccgattaatgccctttatatggcaacggctctttctcttttagcccctgtcctaactttaattcctcaaataaaaaatgcttttaactttgccgcctcttgtacgaccaatttatttttggtagtttattttattactttgtatacctactggcaatatcgtaagtctgatgattataatcctaatggctttttgactcctaaacccgctattgccgtaccatttattgcgattatctttgccatcgtttttgcttccttgttcttcaatgccgatacattttatcctgctttaggagcgattgtttggactcttatctttgggctttactcccatttcaaaaaaatctaattcaggttcactcctttataaaatagagcagtctctgaaaatcttaatgaaaaagcgtataatattatattatgaatacaaatcaaaatgatgaaaacatagaaaaacagccttctcaacgtggtttaaaaaataggcatattcaactgattgcgattgcgggaacaatcggtaccggacttttccttggagccggaaaatcaattcatcttactggtccttcgattatttttgtttatttgattatcggagctctgatgtacatcctattaagagcaattggagagatgctttatcaagatcctagtcagcattcctttttgaactttgtctcacgatatatgggagccaaacctggatactttattcagtggtcttatttgctagtcgttgtttttgtcgcgatggccgaactaattgccatcggaacttatattaatttttggttgccagatttaccgatttggatgactgaggtttttgttttagttcttttaacactattaaatactttaaatcctaaattcttcggtgaaacagaattttggtttggaatgattaaaattgttgccatcattggtttgatattaactgcaattattttaatttttagccactatcatacgggaactgacacagttagtttaacgaacatcactaaaggctttgagttcttccctaacggcgtctctagtttctttgaaagctttcaaatggtaatgtttgcctttgtttctatggaattcatagggatgactgcggctgaaacggacaatccaaggcctactttgaaaaaagctattaatcaaattccaattagaattgtactcttttatattggggctcttcttgccattatgagtatttatcaatggcgagatattcctgctgataaatctccatttgtcaccattttccaattaattggtatcaaatgggctgccgctttggttaatttcgttgttttaacctctgctgcttctgccttgaactccgctctcttttcaatcacgcgaaatctctactcattatcacaacttaatgatgataaaattcttaagccatttacaaaattctcaaaagctggtgtccccgtaaatgcgttacttttcacatcactattgattttatttactccatttatttcaatgattccagcaatctctaattcctttgtctttattaccagtgtcgcaacaaatctttttctagtcgtctatctgatgactttaatcacttatctaaaatatcgcaaatcaaaagattttgatccaagtggctttactttaccagcggctcatatctttattccattagctattgctggatttgtattaatctttatttcacttttctgctttaaagatacaattattccggccattggttctgtgatttgggttcttatctttggattatttaccttctttagaaaaataaaaacagctgattaattcagctgctttttttaatcttcaagttcaagttcgatttcttctgtttctactgctttttcttcttttttagcttttgctttagtttttgaagctgtagtttcttcttcagtttctgctacttctgaatcatcaagaagtccatgagctgcccgaactttgtggtctatttcatcaaaaacatcttgatgctctttgaggtagtttttagctttttctgccccttgaccaatcttctcatcattataagcaaaccaagcaccagatttcttaataatgccttcttcaacagcaatatttaaaagctcacctgtacttgaaattccttcaccaaacatgatatcaacaagcgcaaccttaaatggtggtgcaactttatttttaacgactttgattttggtgattttaccaatttgagttttgttatctccagaaccttcttcaatttttgttgaaccacgtacgtcaagacgaactgaggcgtaaaatttcaaggcacgaccaccaggagttgtttctggtgaaccaaacatcactccaactttttcacgcaattggttgatgaaaatcgctgttgtttttgttttgttgatatgtcctgcaagtttacgcatagcttgtgacatcatacgtgcttgaagaccaactgaactgtctccgatttcgccatcaatttcggcctttggtaccaaggctgcaactgagtcaataacgaccaagtcaaccgctccagaagtaatcaatttttcagcaatttgaagtccttgttcaccatagtcaggttgtgagagcaaaagttcatcaatatttacaccgagtgcttttgcatattctgggtcaagagcattttcagcatcgataaaggctgcaattccaccttctttttgaaccgctgcaacggcatgaagagcgactgttgttttaccagaagattctggtccgtagatttcaacgatacgacctttagggtaaccacctgcaccaagtgcaatatcaagcgcaagagaacctgaacttacaactgatactttttggttagctgcttcaccaagacgcatgagtgaacctttcccaaagtctttttcaatcagagcaagagcatcagccaatgctttatcacgctcagcgccatattttttggtaatatcatcaaaatttgtttttttctttgttgccaaattttatctccgttattctttatttatggtttaattatagcatttttcaggattttttataagcccctatattatatctatacgtttttttatgaactttgtcactgacttttttagttaatttaccttgtctgtcagtaaatattcttcacttatttttgctgacaaactgggcaaaaatgagtgcctcgaccagcaacttttattttttgaatctctgcaccacaacgggaacatttttcacccgttttaccataaacttgcaactcattttgcattttaccagttgatcctaaggcactataagttctaatacttgaaccaccaagcttaatcgctttttgcaaaatttcaataattgagtcgtgcaaaaggtggatggaactttctgtcagctgattagcctctttttctggatgaatttttgctaaccagagcacttcatcaacataaatattgccaagcccagcaacaagggtttgctcaagtaaataaggttttattttctttgttgattttcttaatttctctcgaaaaagcttttcatcaaaatcttcataggtcggttctggtccaatttttttgttcagaaaatagggaatcacttggtcagtagaaatcaattcccaagttccaaatttccttacatcggcatagattaactgcccatcagaaaatttcattgtcaaatggtcatgcttttctcttggtgcatcaagtgttgctaagcgatatttcccttccattcgtaaatgagaaatcaagcgaaagtcatctccaatttcaaaaattaaatatttccctcgccgcaagatgccctgaatgatttttcctgtcaattcttttttcaattgctcaaaaccagttaagaccattcttggataagtggcttctatagatataattttttgtccaacaattcttttttcaagttctcttctaacggtttcaacttctggtaattctggcatttttccctcttatcacaaaatttactgacagactttccagtcagttcttttattttactgacagctttctattttcattctgtactaaatttcaacataaaaaatcactgacaatttatcatcagataagttttatcagtgactattttaacatttcttattcatttttttatgataaagatttcaaaatttattttccggaatcaccataatttgacaagacgcgtgctgatggatctttaacatctgctcccacccaatcagggtttggcatccaaaaatcaataatccaatcttcataacctgggtaaaattctgaaaaaatttcccgatacatcaaggattctttggtaaatggtgtatgttttggatacttttcactagcctttgctaaatcttcatcagaatatttttcgtcagcaaattcttttaaatagtcgaccatggaatgaccaacagcatcagaaaaagccgctttttctctaaataaaatctcgtctggcaatagctccgttccttcaaaagcatggcgtaagagatattttcctttgccataagtattcagctttctactcggattgatggacatgacataagtcgcaaagtccaagtcagcaaatggaacgcgagcttcaagagaatgagccgctaagcaacggtcagcccgcaggacatcatacatatatagttcatgtactcgcttttgtgcttctttttgaaaggccccagctgatggagcaaagtcagtatatttatagccgaacatttcatcggaaacctcaccggtcatcaaaactttcagctctgtattctcatgaatatacttacagattaaatacatcccaatagaagcccgaatcgtcgtgatatcccaagtttccaaatgccaaatcacttcacgaactgctgaaagtacgtcttcttttgtcatcaaaatttcggtatggtcagtccgtaagaaatctgctacttcccgagcatatttcaaatcaatcgggtctgtttccattccaatcgcaaaggtcttgattggactttctaattctttagctgcaatggcacagaccaatgatgaatctaaaccgcctgacaagagataacccattggagcatctgcatgaagacgtttttttactgcacgttccaatttgcgacggatatgtcctgaaatttcagccaaaggttcttcaacaatcgttgaaacttccgcaatatcattataaacataaaattcaccacccgtataataataacctggtggaaaaggcgtcacatctttacaggttgaaataagggccttagcttcagaagagaaagaaatttttcccgtaactttattataaccataaaaaagtggacgaattccaaaggggtcacgagccgcaaaaatctcaccagtattttcatcaactaggacaaaagcaaattcagcatcaagcattttgaccattgtttcgattcctgtggtttcaaaaagaggtaaaagcacttcacaatcagaatctcctgtaaatttatatcccttagtttccaagaacttacgaaggcttaaaaagttataaatttcaccattacacatgactcttttaccgttcagtccaaagggctgacgccccaagtctgacaaatccatgattgaaagtcggcaaaaaccaaaatcatttcccaaagtatcacgaacatgttgttggtcgtctggtcctcgatgttcaatcagttccaaattgcttttaaactcttctatcgttaagtcagatgtttccataaataaaaaaccgcacataatttcccccaataataattataattttcaatattatatcacaattgtctggaaatttcataataaaacaaaaaatagcgataattcgctattttcattacatataatcatcacgattgtagccaaagtcagctaaatccattttacggtcgcgccaatcatttttaattttaacccaagtttcaaggtaaaccttgtcaccaagcatgatttcaatatcacgacgagccattttcccgattttacgaatcatatcgccacctttaccaagaataattcctttttggctcttgcgttcgacaataattgttgccatgatatgaattttacccgtttcttcatctcgagtcatttggtcagtagtaaccgcaatagaatgcggaacttcttcgcgagtcaacaacaagattttttcacgaatcatttctgaaacgaggaaacgttctggatggtcagtaatttggtcttctgggaaatattgaggcccttcatccaatttttcagagagtgtatcaattaatctttcggtgttatttccttgtttagctgaaattggaacgacttctgaaaattccatttgtgaagtgtaatcagctacaatttcaaaaagacggtcaggatgaattttatcaattttattgacaaccaaaatgactggaacttctgcttttttcaagcgttcaataatcatattttcaccagttgaacgaggttcatcagctgcaaccataaataaaacgacatcacattcacgcaaagtagaataagcagattgaaccataaaatcgcctaaagcattgtgtggtttgtgaatccctggtgtatcaatgaagacaatttgttcattttctgtagtataaattccttgaattttatttcttgttgtttgaggtttatctgacatgatggcaattttttgacccatcacgtgattcataaatgttgattttccaacatttggacgacctaaaattgccacaaatcctgatttaaattttttatttgtcatagcgctattatatcacagccagtgggacgaaacaaggtttcgtattactggtcctcattattaattatgctatagagaagcgtaggatagctgtcgccactttagtggcttacagatatgctggttgtccctcccagaaacgataattttccacttaggatagtcgttgtcagctgtccgttttatcattcgctttagcggatagacaaaatggacagcgtagcgcgtaatcgcgtagatgctgacttacgaatatgctagtattttcaccagagtgattgataaggtatctacttcgtttcactacgttgtacatagcacggctgtccgttttgctatcaacgctaaaacattgggcaaaaaggctcgctctaagccagcaaagctggcaagatgaaatggcagtaaatgcgtcatagcaacttccgtctgcgcgttataagcagtgatatttatatcataaaatcagccttttgcggaagaatattttgctgacagatgcatcagtaaaactgacaaattctttatccacagaattaatgcctctactcaatcagattaaactgacagacttatgactaatataaaaaatactgacagctgacaaaagaaaaaatcatcagataactgatgattcctttatttaccgatttaaagctcattaagccgctcatttcagtaatttttataacttattttatttatcgccacggctacgcattacgaagccagctgatttttcagttcctgtggtacgtttacgaggagttttttcaccttgtttacggtcgtcaaagcgacggtcatcacgttttccacggtaacctccacgattatcatcacggtctttccagttacgtttacgatctccaccgcgttcgccatctttagaatcacgattaccacggtagcctccacggtttccgtcacgattaccatcacggtcgccatttccacggcctttgtagcgtccgccgccacctttaccttttttcttgaatccttttccttcaccattgtatggtaatggacgttcggctgtaattttaacttcttcttggttatccgggtctttaacacgtccttggagaagtaaggcaaccaattctttagcatcaaatttttcaagtaagcttgctgcttgtttgtcaaattttgctaattttgctttacctgattcatcagacaaatcacgaagaacatcatccatcgcaacagaaagtgacgcttggtaagcttcttcttttgttggtggtttcaagcctttcatttctttgtttgtcaatttttcaatggcacgaaggtagcccatttcattgtatgaaacaaaagttactgagcggcctgatttaccagcacgacctgtacgtccgatacggtgaacatagctttcttggtcttgggtaatatcgtagttgtaaacgtgtgttacacctgatacgtcaagcccccgagcggcaacgtcagtagcaactaagacatcaatatgtccagctttgaaatcacgcaaaacggccaaacgtttgttttggtccaaatctccgtgcattccttcagcacgatatccgcgcaatttaagaccacgaatcaattcgtcaacgcggcgttttgtacgaccgaaaacaattgcaagttgtggacgttcaacatcaagcaaacgagtcaaaacatcaaatttttcaaattcttttgttttcacaaagtattggtcaatacggtcagcagtcatttctttggctgcaattttgatgtgttcaggattcttcatgaatttcacaccaatttttttgatatcagcaggcattgttgctgagaaaagcaatgtttgacgattttctggtgttttttcaataataaaatgaatgtcttccaaaaatcccatgttaagcatttcatctgcttcatcaagaatcaaagtttcaagttggtcaagtttgattgctttacgtttaatcaagtcaaccaaacgacctggtgttcccacaacgatatgtgcgccagctttaagtcctttgatttgtttttcaatacttgaaccaccgaatacagtacgaactttaagtccttttgatttaccaaaacggaaaagttcttcttgtccttgaactgcaagttcacgggttggagcaataacaagtgcttgaatggctggattttcagcattgattttctcaatagtaggaagaccaaatgccgctgttttaccagtccctgtttgcgcttgaccaagaacgtcacggccttcaagcgccaatttaattgtttcttcttggattggtgtaggttgttcataaccaatctctgtaagtgtttttacgattccttctgacaggccgagttcactaaatttcattttttacctatatttctactgcatgttcccacgccaaaatttttattacagggtacgaaacccttgctacaggcgaaatttatgtgactcgcctgacgtaacttatctattatagcataattttttgactgaaaatgcttacgccctttacttttttaaaaatattttcataaaaaaattactgacagtttttcaaaggataattatcggtaattttacaactacactatccacaaatttttgtcagtaattttaaaatatatcatttttttaatggaaatttttattaaaaataaacattctgtcagtaaatttataaaacttatactgaaaattgttccattaattcaacatctggatatttatctttgaaccagcgcatggcaaattcattttcaaataagaacaatggatggtcaaaacggtctcgcgccaagatgtttcgcgaacttgacattttttcatctaaatcttcttctttaatccaacgcactgtttttgagcccatcggtgtcatgattgtttccgaattatattcgcgctccatccggtctttaaagacttcaaattgaagttgtccaaccgcaccaagcatgatatcgccagtcgtataagatttgtagagctgaatggctccctcttgaaccaattggtcaattcctttttggaatgatttttgtttcatgacatttttcgcttgcacacgcatgaaaagttccggtgtaaacgttggaagtggctcaaatgatttctttaatttaccagttgtcaaagtatcaccaacttgataagttccggtatcataaaccccaataatatcaccagcgacagcattttcgacattttctcgtgattcagccatgaactgtgtcacattagataattttacttttttacccgtgcggacaagattaacatccattccacgctcaaattcgccagaaacaatacggacaaaagcaattcggtcacggtgacgagggtccatattcgcttgaattttgaaaatgaaaccagaaaaatcaggatttaaaggttcaatttcttcttcatcaaccgttttgtgtgaatgaggttctggtgcgtattctaaaaatgtttcgaggaaagtttccaccccaaaactggtcaaagctgacccaaagaaaactggtgtcaattgcccagcaactacttcgtcttctgaaaattgatttcctgcatccaaaagtaattcagcatcttctaaagcttgcgtgaaaaatggatttttcgttaaaggatgacttgttggtacttccccattttcatcaaattcaacaaaacgttttccatcttctggttgataaacttctacgcgcccatgcgtaaaatcataaagcccttggaaatttttccccatgccgattggccaattcattggtacactggcaattccaagaatttcttccaattcagaaagcaaatcaagtggttcacgtccatcacggtcaagtttattgatgaaagtgaaaactggaattccacgacgtttgacaacttggaaaagttttttcgtctgtgcttcaatccctttagcactatcaataaccatgactgccgcatcaactgccatcaacgttcgataagtatcttctgagaaatcctcatgccctggcgtgtccaagatattaacccgttttcccgcatagtcaaactgcatgacagaactcgttacagaaattccacgttctttttcaatgtccatccagtctgatttggcaaaatttcctgttttacgtgcttttacagtaccagcttcacggatggcacccccaaatttcaatagttgttctgtaatcgtcgtcttaccggcatccgggtgactgataatggcaaaagtccgacgtttttttatttcttcttgtaaagtcatttatactctcattttctttaattattcatttatacttttaatttaatttacattggctaaacctcaaaaaaaatagttcttttaattatatcaagatgcgaggccgactgcaagaaacgtagaaaattgcggctcgacttgtcgcttcaacgacatagcgagagcggacaacgtaaggtagggaatcgtggttctgcacttgtgcaggttccgatttttctactttcctagtttctaggaggacgaactcaattataccaaaatttgccataattttatagctgatttttttacacttactgatggattaaagagtgaaaaatttattcgggcagtaagaaaacaatagaaaaaacaatcagtagaactaattgttttatcattattttttacttatagagtggcatttttcttatacacttccgcttcagcttctgttgaaaagacaaaatgtccaggcgtaatttcacgcatctcacgttcttgtccatccaattctgctgttgggtcataaacaattggggtccgctgacgttcagagatagggtctggtgacggaatcgaacttagcaaactcttagtgtaaggatgaattggatgattgtaaacttgctcagaagttccaacttccaaaattttcccccaatgcatcacaccaatgcggtctgaaatgtatttaaccattgacaaatcatgagcgataaataagtaagtcaaattttcttttgcttgaatatctctcatcaagttaacgacttgggcctgaattgatacatctagtgccgagataggttcatcggcaacgacaaattttggttttacagcaagtgcacgtgcaatcccaatccgttgacgttgtccaccagaaaactcatggggataacgtgtcaaatggtcatcattcaatccaaccagacgcaaaagttccaatacacgagcatcacgttcagctttagtttttactaaaccgttagcgtcaagtccttcagcaacaatatctttaacgcgcatccgcccattcaatgaagcttgtggatcttggaaaatcatttgtgcttctgaacgatattctcgcaactctgagccttttagattacgaacatctttaccttcaaagagaatttctccaccagtaataaaattatcgtaaagtttaagaattgctcgaccaatcgttgttttaccagaacctgattctccaacaagtccaaatgtttctccttcataaatatctaaagaaacattattaattgctttatttgcccctttttttcctttattaaaagtcaaatcaaggttttttatttcaaccacttttttaggatctgtcatcatttatcccctttcaattcttcccagcgtttccaacgtgccaagatattatcggaaggcgttacttttggtgctcgtggatctaaaagccaagttttagcaaaatgagttggagaaacttcaaagtatggaggttcttcttcaaagtcaattgctagggcaaatttattacgtgccgcaaaggcatccccttttggcggattcaacaagtcaggaggagttcctggaattgaaaccaagcggtctacacttgaatcaactgttggcattgaatccaaaagtccccaagtgtaaggatgttgtgggttatagaaaatttcttcaactgtcccatattcaacgatttctcccgcatacattactgcaactttatgtgcaaatccagcaacaacccctaaatcatgggtgataaagacaatagatgaattaatacgctcttgcaattcggccatcatgtgcatgatttgtgcttgaatagtaacgtcaagcgcagttgtaggttcatctgcaatcaatatttcagggtcagcagccaaggcaatggcgataaccgcccgttgacgcatcccacctgaccattggtgtggataatcattgatatgtacttcggcatcaggaatccctacttgttgcatcaattcaagggcccgtttcatggcatcggctttactcatgcctttattgtgtttcaacaaaggttcagcaatctgttttccaatacgcatggttgggtcaagagaagtcattgggtcttggaaaatcattgaaatttcatttccacgaattttttgccattcttcttcttttaaatcaagaaggttacgccctttaaataataattcaccttgcggtattaccgcatttttcgcattcaagcccatcaaagtttttgttgttactgatttaccagaaccagactcaccaacaatcgctagggtctgtcctttttctaaatcaaaagaaacatcacgaatcgctttaacatctccagcataggtgtggaaattgacatgcaaatttttaacttctaatactttttcttctgccatttctaatcctcacttgctctagggtcaaatgcatcacgcaaaccatctccaaagaagataaatgtgagtgaaagcacagacaatactactgctggaataatcaattggaatggatagaattgcaaacttgcaatcccatcattaatcaaagtccccaaagaagacgttggcggtttaaccccaaggttaatcgctgataaaacagcctcatacataatcatacttggaatatcaaacatgatttggacaacaataacccctgaaacgtttggcaacaaatgttttactgcaattttccaagtagattgtcctaaagtttttgaagctaagacaaagtcacgctctttataggagagcaccatattcctgacttgccgggccattccggtccaggcaaagagcccaatggcaatgataattgatgaaatcccttgtcccaataagagggcaagcatggttaccacaactaagtttggtacagattggataatttcaataatccgttgcatgaccatatcgacttttccgcccatccagccggaaataatcccgtaggtcaccccaattactaagtcaattagagccgcagcaagggcaataatcaatgaaatacgcaaaccaacaactgttcgtttagctaatgaacgaccatatttatcagtcccgaagacatatttgtctttgcttggaacatcttgtgatttatagacatctgttctttcagtagaacccggtgctttaaattcaccattccaaaatggtaaatcacctgatagttttggcggaagatttccataaacttgtgatttatttggattaaagtaatttgcctttgattgtggtacaacaaatgctgaaatcactgagaaaaccaatgtaatcgcaataatccacatggcaaccaaagctgctttatttttcttaaaacgacgccaagcatcttggaaaaaactcaaggcaggtttcgcaattttttctgttgaatctgaaccctttgaaccaacaagggtgaagtctttatttaaattttccatttcgacaaaccctttctagagacgaactcgtggatcaacaattgcagtcagaatatctgtaactaagataaataacatcaagattactgcatagacaattgttgttgccataataactgggaagtctttggctggaattgaatcaacaaattgtgaaccaatcccggggattgaaaagattttttcaatcaagaccgaacctgtcaaaagattggcagccattggcccaatcaaagtcaacatcggaatcaatgaattacgcaatgcatgtttattgaccacttctttttcagaaagtcctttagcacgagctaacaagatgtagtcagaagataaagactcaatcatttcagaacgaacaaaacgggttaccacagccattggagcgaaagatagagctattgttggcataattgtctgtgagaaggttccccaaccagaaattgggaaaagattcaaattgaaccctaagtaaagaaggattaaggtaccaattacgaatgaaggaacggaaatccctaggactgagacaaaaccaaaaattccatcaagcaatccatttttacgacgagcggaagctttttccatgaaggctccaagaactgttccaagaataagtgcttggaccccaagttgcattgaaactggtaaacgttgagcgatcattgtaataaccggttgatttgtataaacaaatgatgtaccaaaattacctgtgaacatatgtccaacatagataaagtattgttgccaaagcggtttatctaaaccataggtatgttttaaaatttccagttgatctggcgttagtttgggatttgagaaaggtgttccgggcatgacttgcatcataaagaaagtcaatgtcacaatcaggaacaaagtcagaagcaaaagtcccaaacgtttaagaatatatttaaccataaaaaatttcctaatctaagcgaaaagatagggttggcaatctgccaatcctaactttcttgctctaaaactctattattatttgaggtaagctgttttgaagtcatacattaaaccagttgaaccgaatcgtacatccttaaggttaggattacgcaggactggagttgtacggaagtacagtggattgagatttgattctgtataaagtgcttcttcagccgctttataatctgcaaaatgcttttcaggatcaagggcatctgttacttcggcagctttaatggctttatcataagtaacattgttgattttaccattgttgtttggtccatcttttacaaataggtcaaggaaagttgatggttcagcatagtcaccaccccaaagagagatgaccatatcaaagttaccagttgttgagtcattcaaacgttgtttaaatggtactgatttgatattaagcgtcaatcctggaagttgtttttcccatgcttgtttaaggaaagttgctgaatcttttgaagctgatgtatcatcagttgttaaagtcaacgtaagtttagtttcgccaatttcactcaatcctttagcccaagctacttttgctgctgtagcatcgtatttgtatggttgtgctgcatacttagcgaagtcttcaccagtatttgttttagccatacccgctggtgttaatcctgtcgcaggattagaagcaggcgttactgtatcaacatattgttggcggtcggtagcgaggttgaaggcttcacgaatgttcttgttagcaagagctttatttttcccagattgattatattgaatgtaagctgttgttgcttcatccaaagatacgacatctttattatttttatttgctttgaaaaggtctgggtcaccaatacttgcttggacaatcttaccttgtttataaaggttaaatgaagttttagggtcttgaacaacttggaagtcgatttctttagttttaactgcactcttatcccaataatcatcattcttcacgattgagaatgtttggtttgaaccgttccaaccttttgatttttcgaatttatatggtcctgagtaaaccatcttttctgatgatgttccatattgttttccatatttttcaaccactttttgattgagtgggtaataaacagagttagctgtcaagaattcaaagtatggtgttggttgtgcaagggtaacaacaaatgttttgtcatcagttgctttaacaccaagtgttgatttatcagctttaccaccattaatctcgttggcgtttttaactgggccaaggaggtatccgtattctgaagcagtcgctggatcaaccgcacgttgccaagaataaacgaagtctttagctgtcaaagcatcaccgtttgaccatttcaagccatcacgaagatggaaagtataagtcaagccatcttttgatacatcaacagattttgccaattctggctgtgctttaccatctttgtccacacgtgtcaaacctgcattggtgttaccaataatgatgtttgagtatgtatttgtattctatttcaaccagtaagaatattcaataaaaaagataaattttcagaaaatttatctttatgttttaattatttaatataagccgattttaagtcgtaagctagacctgttgaatgaaattctaagcctgtgattttaggattcattaaagctggattggcttgaaaatcaattggattgatatatgatccttcataaagagctgcttctgccgctttataatgttcgtctactttggctggctcaagaacatctggtgttgttgttgctgctttaaaagcatcatcataggttttacttgagaattttccgtcattataggattgacctgttgtaaagagttgcaagaaggtagagggttcagcataatctccaccccaacctgagagcaccatgtcaaaatttccattttgcgcatcattcagtctttgtttgaatggaacgagttttaaattaaccgtcaatcctggcagattttgttgataagccgtttgcaagaagttagccgttgcttctgatggtgccaaatctccagcagcttcaaggctaagactgagtttggtcaaaccaagttcttttaatccgtttgcccaaagttcctttgcttttgtcgggtcataactataatcttgtttggcataagttgcaaaatcttctcccgttgaggtcttactcatccccactggtatgaaacttgtcgcaacggtcgagcctgggagggctgttttgacaacctctgctcgatttgttgctaagtttaaagcctgacggatgtcttgatttgctaaagctttttgagcatcaggacttgaggcattttttccagactgattgtattcaatatagtctgtccgtgcttgtttaaagactgtataaccctctgtttttttattggcattaatcaaatcagttgttgaaaggagtgtaaagtcgagttttccttgtttatagagttgagctcctgtattagcatttgaaatgacttgaaaatcaatttgtttagacttgactgctgatttatcataataatttggattggcataaattgaaaaattcttatttgttccagtccaagctttatctgatttgaacatgaatgggccattatagacggttttatctgaggatgtcccatattgtttaccatatttatcaacgactttttgatcaagtggataataaacgggttctgacaaaaggaatttgaaatatggtgttggttgtgccaaggtgactgtaaattctgtatctgactcagctttaattcctagactatcaagtgatgatttaccagaaataatatcattagctccagaaactgctcccatcaaataggcatattctgaacccgttttagggtccactgctcttttccatgaataaacaaaatctttagcggtcaatttgtcaccgtttgaccatttcaaattatctttaagggtgaccgtataggtcaagccgtcttttgaaacgtcaattgattttgcaagagccaaggcagcatttcctttagagtcaacgcgtgtcaatccttcttcaacatttcctgcaaacatcataagaatactggtcagttaaaattgtggtatccagcgaggccacatcagtgggaattgaaaattgaatgtttttttgctcacttgtttttgaaccacaggccactaaaataattcctgacagagcaatgacggtggtgagcccaataatttttgcttgtttcatctggtttctccaaatcctaaaagtactatcgaattttctaattattctgaaaattaaacgtggacctattatacttcttcaaaaatctaatgtcaagaatattattgtatttttctgacaatttaacaaaactaaaaagtaccgactcttgtcagtacttttttgtcattataatttttcaacaacttctgaaagtttcatgctgtttgaacccttgaataaaacttggtctgctggtttcaaatctgctgacagactttctgtcagtaaatccaaatctgtaaaatagctgacaggtttgtcagtcgaaatatctgccaaatttttcatcatttcgccataaagatagactttatcaatttttgtgaaatcaatcgatttcagcacctctttatgaagttgagcagcagttggcccgagttctaacatgtcagcaagaactgcgatttttcgaccattttcatttttaggaatggcttggaaagtttccaaaatcaggcgcatagctgttggattggcattatagacgtcgcttaaaaggtcagctccatttttagattttttccactctgtccgatttctggtcagttcaacttctttcaaagcatttttgatttcagcttctgtcaacccataatgtaagccaacataagcagctaacatagcattcgttgcattatatttaccaggaactggaatcgttattgattcatctaaaaaattagtttcaaaagtcaatctttctttgtgctcaattaattttgtaatgaataaatcttcaccgggcaaaccaaaacgactgattttttgattttctggaataaaagcattaataattgggtcagcaggggcaattaattcaccatgtagaccagcagtaatacccattttaccttttgcaatattttcacgactacccataaattcaagatgagcttcaccaattaaggtaataagagctagttcaggttgagctagttgtgagagaaaatcaatatcgccagggtggtccattcccatttctaatactaatttttcagtatcctctggcatgtgtaaaattgtgtaaggcaatccaatttcgttattatgatttccttgtgttttataggttttatattttttagataaaacagcagcaatcatatccttggtggttgttttaccatttgagcctgtcaccgcaataactggaacttttgttttttccagataatattttgctaatgtttggaaagctgctagattatcatcaaccaaaagatgagcttgttcaacttctttttctgaaaagctaattattgctccattgtcaaaagcaatctcgatgaaatcatgaccatctcgtgcccctttgagtggcaaaaagatatctcctttttcaattaaacggctgtcaaattcaattttatttactgacaaatctgccagttgcgaccaatcattttttgcgccaacgacttgagcgatttcgtgaattgtgagtttcatagtgactccattataacacagccagccagatgaaacacgtttcgtgtgactggctttcaatttattaggaccgaatgaaaccaaccctatctgcggttataccttagaatgataatttcttacatccggcctccttatcaacttaaactttttactctgaattatagaaaaaagtaacacagcccataagcagtggtactttttgccctttttactgatgaaaaaatctgtcagcaattaatttactgacagattcgtattttttataagagatgattttcgcgtgtttcaaaagtttctttagctaaatcaactaatttttcaattaaatcagagtaagacaagcccatattttcccaaagcaatggatacattgaccattgagtgaaaccagggatggcattgacttcattaagatacacatttccatctttagtcacaaagaaatcacaacgtgacaaaccagctccattaactgctttataagctttcttggcatattcttgaattttttgagctaaatctgctgaaacttttgcaggaatgtccatttggattttattatcaatatattttgagttgtaatcataaaatccaacatctttcacgacttctcctggaagtgttgcagaaacgtcactattatttcccaagacagcacactcgatttcacgcgcatccaccccttgttcaatgaccacacggttatcatatttgtaagcttcactcagggctggttgaagatctgctaaatcatcaacttttgaaatccccacactagaacccatattagcaggtttaacaaaaactggaaattctaatttttcgacgacttcttgagcaatctccgcttgattttcgtcagcaaaagcggcaatataaggaacttgtggcacaccaacagcttcaaaaacatgttttgctaataatttatccattgtacttgaggcagataaaatattcggtccgacatatgccaaacgcaaaatttctaaaaatccttgaatagagccgtcttcacccattggaccatgtagaactggaaatacaacagcatctttttcataaattgccgcaggtgaaatctttggataagactctgccaaatcgtttgtcagtaatttttcttcttcagcaggtgtgtcagtaaattcttgtgtttttatgaattcaccacccttagtgataaagtaagttttcacaataaaacgagaataattgacagctctcatcactgattctgctgataaaactgatacttctcgctcagcagaacgaccaccatacaacaaaattaatgtttcttttgacatatttcttccttttttactgactgccttgtcagtcgcttcttttttactgaccatttttaagatttctttataatacaaaacgtcaataattgtcttttttattttaccacagaaaaaatcaaatttccaaccgattctccacggcttttgataaggtaacctcatcagcgtattctatatcagaccctacagctaatccacgagccagtcgtgtcactttaattcccgcaggtttaatcattcgagccagatacatagcggttgcttcaccatccgatgtcgcattggtcgcaataatcacttctttaacttctgagtccattaaccttgtaatcaaagatttaacattaatttcatcaggagagattccgttcattggactaattgttccatgtaagacatgatagagtccacgatattcgcggattttttccatggcaagaacatctttagattcttcgacaaccaatatcgttgttctatcacgtgtgggatcagtacaaatagcacaaggatcactttctgttaaattcccacaaatagagcaaaagcgtaaatctcgttttgctgacaagagatttttcgcaaattcattgacatcttgatcttccatgccaatcgtataaaaagctagccgtgtcgccgttttcttcccaattccgggtaattttgaaaatgactcaatcaggcgagcaataggttctggataatacatatttcaccaattcttcacttgtaaatattttattcaatttattaattttactataaaaggcttaaaatgaaaaggaaatgcgacaagatttttaaaagaaaaaccctcattcaagagggcttttttattttaatttgttcgaaaagcttcgtttgagtagtataaatcggtaattccagtgacaatgctttggtttgccttcgtaccactagaagcatcactttcagtattatctggcaacacaactccaatcgcaatctctggattgtctgacggagcaaaagcaactgcattatttgctgttacgataacttgactaccatctcctaatattttcgtactttcggaagtacccgttttaccagaaatagaaaccgttgcagcgctcattggcttaccagtagtcaaaccacctgcaccatgaacaacagcatacatcccttgatgaagaacatccatattgtctggagtaatattaaccttatccataattttaggcgtaatatttttaattaaggttcctggttgtcgatcatttccgccctcataaatcccttggacgatgtgtggcgctaagcgcgttccattatttcctaaagttgcagcataaactgccaattgaagtggagtatagttatcatactgaccaaatgattcatacaatacattaaccccagaagcatctttagattttgctgaaggaataaatcctgtggactctcccggaatatcgaatcctgttgaagtccctaaactgtaagaagcaaatgcgcttcgtagctgctcatagactttaacccggttactatcattgagatattgtccagcaccagtataaggagcccctaacattctcattgctaactgcatcatataagtatttgatgaatattgcagggcttcaacagccgttaaagccattggtgaagcatctccccaccagtcattgataggaggtgaacctttaaattgaatagactgcgcagttaaagtgtcatttcccgaaatcacccctgcattccaagcagcagtcaatgttcccattttcacaacagaccctggcgtaaagacgctttggaaagctccaagtgtattatccgtaattactcctgtattagggtcacggttatatccagatagggctagtactgcacctgttttaacattgagaacaacagcataagcccctctgttatactgaccataaccttgggcaattaattggtccaattgtgttttaaccaaatcgttgacagcattttggaaatctaggttaatcgttaattttaaatcatccccacgttttcctttttgaattgtttttgttccagaaacatcaccatttttatcaaatttgactttgctaatactgtgcgttccttgaagttcactttcgtagcctttctcaagaagtccagttcccacacggtcattacgttgataaccttttttaagataggcatctaaatcttccgccggaatccccgatttctgtgaagtaatagtccccattaatggagttagcgaattttgagcataagagcgatcccaagaagttccaatcgtaattcctggcaaatctccttcttgctccgcaattgtcgcttgttgctctgccgtaatacttccagttgcaattttagtagtattaaaagtacttgtactattcatttctttgaataattttgcggcaaaagtttgttccgccgtaaagttcaagtcactatctttaactttacttagctcaatctcatagatttgtgagccagttaaatcattgccttgtttatctttcttttctttatcagttagcttgtttgcgattttttccaaatttttagcattagccaagaaataatcttttttgtcacgagttgtcaaatcagcaacatcaatatcattagataaaatagttgctagcttatttgccacctgatacatttcatctgctgtcgcattttgactacgtgtgaattcaacggcttggacagggattgttgttgctaaagctttaccacttgcatcgtaaatatttcccctcggagctccttcgataatctgaacatcgccaccggcgctaattgatttttcggcatagaaatgagaattcaaaacttgcatgtgaaaaagttttccgattaaaatcataaacagaacaaaaataacgaaaaatagaagattaatgcgttttgggattaattttgttggatcttttaatacttttgtttctttatttgtttttttagactgatcgactttattgcgcttatcgttttttcttttattaactgacatttggactccaagaatgagttttataaataattttttaattcaaaatttgtacttaaacattttaccacatttatgaaaagttttccttacaattttgattagttctagtttaatcgagaaacgcaacttaatcaagaaaaatgaaaagactaaaaaaggaaactcagacaagcttcctttttaagaaaaacaacttaatttcttatcaaataatcaaaggcacctaaggaagcagtcgctccacttcccattgacacaataatttgtttataaacagtatctgtgcaatctcctgctgcaaagacacccggaatatttgttgctccaaccttatcagtcacaatttcatgacgatctgtcaaatcaattgtcccttccaaccactgagtattgggaactaaaccaatcaaaacaaagacaccggcaagctctaaatgaatcgtttctttagagcctcgaacttgataattcaaccccgtgacttgctcatctcctaaaatctctttagtttccacattggtcaaaacagtaacattagttagactagcaagttttttttgtaagattttatctgctttaagttctggtaaaaattcaagaacagtgacatggttgaccaaaccagctaagtctatccctgcttcaatccctgaatttcctccaccaataactgccacatctttaccagagaaaagcggaccatcacaatgaggacaataagccactcctttattcttaaagcgttgttctcctgggattcctaaatcccgccaacgagcgccagttgagagaataacagctttactcttcaaggttgcaccattttcaagacttacttcaattaaatcttttttctcaagtttaactgctttttgcagattcatcaaatctactggatattttttcacgtgttcttcaagctgacgcccaagctgaacaccctctatatagggtgttccaatcagattttcaatccctaaagtttctaaaggttggcctccaaagcgctcggcaatcaatcctgtcctgattcccttacgtgccgcataaatagctgcactcgcaccagctggcccccctcctactaccaaaacatcataaggttctttttctgcgaaactatccgaactttctggacctgtaattttttccaacaattcttcaagacttgctcgtccactatgaaattcttcggcatttttaaagacagcaggaacagccataattccttttgcttctacttctgcttggaacatgcctccctcaatcatggtatgactaatgttagggttgagaatggtcattgtatttaaagcttgaaccacatctggacaattatgacaagttaaactgacataagtatcaaaatgaagtgaagttttaatagccttaatttgttcaattaattcttgttcaatacgtggtggtcgaccactcacttgcacaagggccaaaaccaatgaatttaactcatgacccaaaggaagacctgaaaaagcaacccctgaaacaccttctctttcaattgaaaaagccggtttatgattcagatttgttttctcttttgaaatcaagtctgataaacttgccagttcatctgtaaattcatttattttttgtccattttcactatcgtttgcgtccacttttaaaataattggattttctaataaatccatatacggcagtaactgagaacgcagattttcatctaaaatcatattaaacctttctgtcattaaatttttcaagacaaataaagtgagtcaagactcacttatttattttaaatttttcctacaaggtcaattcctacatgaaggctttccccatcttctttccacttagcgggacaaacttcacctggatgattgcggacatattgggctgccttaattttatcaattaactgactggcatctcgcccaattccatctgctgtaatttcaaaagcttgaatcacatcatcagggtcaataataaatgttccacgttgagcaagtccagcttcttcatcaagaacatcaaaagcccgtgaaattttttgtgaagggtccgcaagcataggataagtaatcttagaaattgcatcgctatggtcatgccatgcagcatgaacaaaatgagtatctgttgaagcagagtaaacttctactccgagttttttcaattcaggatatgtttcttccaaatcttctaactctgtcggacaaacaaatgaaaagtccgctggatagaaacaaagtacattccatttcccataaaaatctttgtcagaaactttaataaatttcccaccaagataagcatctgttgaaaattcttctatttttttaccaattagtgacatgatgttctcctttttttgtttaaaactttactattaaattatctcaagaaaaaaatgaagaatcaattaatttgtctaaaaactcacaaactattaaattgaatacaaaaaagctccgatttatcagtagaaattccactgacaaatcagagcattatatggcttattcaattatgtttaagctttttttggagccaaatagtattcattttgaacgttcaaattgtcatcaaattcgaaaacaagtggtgggaagttagggatttcaacatccataatttcgtcatcagaaagttttttgatttgtttaacgagggcgcgaattgagttaccgtgagcaccaacgaagacattttttccttctttcaaagctggagcgatttggtcttcccagaatggaagagcgcgttccaaagtaactttgaggttttcagcatcaggaatcaatgaatcttcaagaccagcataacgacggtctccgtgagctgtatatttatcatcatgatccattgcaggtggcaatacatcatatgaacgacgccagatgtgaacttgttcatcaccatgttttgcagcagcgtcagctttgttcaaacctgtcaaaccaccgtagtgacgttcgttcaagcgccatgatttaacaactggtacccaaagttgatctgaaaattcaagagcaaggttagttgttttgatcgcacgtttcaatactgaagtgtatgcaatatcaaattcgattccagcttctttaatcaatttaccagcttcaatcgcttgtttagttccgttttcagaaaggtcaacgtcagcccaacctgtgaaaaggttagcaagattccattcagattcaccgtgacgtgcaaatactaattttggcattttgtgtattctccgtttattttttacttgaacgacatttagttcgttcatttacaaagttaattttactacattttttcttttttttctagcttttattttctgtaagcccttttatttactgacagaagcgtcagcaaaaataaaaatctttccttcatctgattttttcaaaaaattactcatgaagttctattggtaaatcatctgggtcataaaagaagagcatttttttgtcagtaatctcatcctgccgaatttcctctacttttaccccttggcttatcaaataatttcgatcttcttcaatatttgttgttgttaaagcgagatgtcggtatccttttgcttctggataagttaaacgttcgggcgctcctgatttaataaataattcaagttctgtttcatcattcagtcttaaatcaagtttaacatcctctttttctggccgatgattttctcgaataattgaaaatcctaaaatatcaacatagaaatgacgagctttttcataatcgtcggcgatgattgcaatatgatgaattttgttgaatcttggttgatacatttcctaactcctcttacctatcagctactcattattcactagattattctaaaatttgaacttcttcacctttactttttaaagtttggacatggccttcgccccatgaacaaagaatatctagtaagccatttaaagtttccccataaggacttagtgaatattcaaccttaggtgggacctgattataaaccttacgcacgataatattatcaatttctaattctcttaattgctgggtcagcattttttgactgattcctggaattagtcttctcaattctcctggacgacttggatgatgtcttaaattacacaaaataattggtttccattttccaccaataacatccattgtcgcttccacacctatattataaatttttttcaaaattaatttcctttctaattccttattctatccaattattactttttagtacgtatgacacaaaaaagtaggtactgttcaagaggttttatttattatatactaattttctgccaaaacaaaatagatgaggagcaaaaaatgaaacttaataatcaaattgaaattccagaactcggtttaggagtctttcaaattccgaatgaagaaactgctgaagtggtaaagaacggaattatcaatggatatcgtttaattgatacagctaaaatttatgaaaatgaagaagggactggtcaaggaataaaagaaggtttgacctcgacagggcttactcgtgaagatctctttgtcacatcaaaactttggggagacaatcattcttataaagaaacaattcaaagctttgaagaaagtttgaaaaaattagatttggattatcttgatttatatcttatccactggcctggcactaattatgcttacaaagaagcttggaaagcaatggaagatttatataaagcgggaaaagttaaagcgattggtgtcagcaactttcaaaaacatcatttagaagaacttcttagctatgctgaaataaaaccagtattaaatcaaattgaacttcaccctaagctttcacaaaaagaacttcgtgaatttttgaaacttcatgatattaaggtccaagcttggtctcctttgatgcaaggtcaactattagacaatgaaatgctcaaaaaaattgctgacaaacatggaaaatctgttgcccaaattattcttcgttgggatattcagcaagagattttagtcaatgtcaaatcaatcaagagtgagcgaatgattgctaatcgacaaatatttgattttgcacttgaccaagaagatatgaaggccctaaactcattaaatgaagcccttcgtgttggccctaacccagatacttttaatttttaagaaagaaatataatgaaaaaaatctctcctagtcttacacttcttgctttagcgattaatgcttttgcaattggttcaaccgaatttatcagcgttggtttaatgccaatgattgtgaacacttttaatattagtttatcgcaagccggtttaacagtctctctttatgcgctaggtgtaacggttggtgcaccattactaactattctcacaggaacttggaatcgaaaaactttgatggttgccattatgattttgtttatccttggtaatttactctcagcctttgccccaacttttattttacttttagttggacgggtactagcttcacttgcccatgggatcttcatgtccatttccacagttattgccgctgatgttgttcgtcctgaaaaaagagcttcagcgattgccttaatgtttacaggacttacagttgctacagttatcggtgttcctttgggaactttcattggtcaacactctacttggcacatgtcatttattttcattgttgtcattggattgattggactgatagctacaagtattcttgttcctaaaggtcttccaatccctggaaaaatcaacttgagtggacttgcacgaattttcacgaataaatcaattatgatgtccttctttatcactgcttttggatatggtggaactttcgctgcttacacttatcttagccccatacttgaagggacttttagattttcagcaagtacagtcgttattattttagttgcctttggtgtgatggttgccattggtaattcactaggtggacatctagcaaataaaaatatccttcctgctttgcaaaaaatgtttgcggctcttgccttaagcttactctttctttttatcagtacaagcttagcttctcaacctttgggattgattgcaacattactcttgggactctttgcttttatgaatgttcctggtttacaattatatgttgttcaactggccgaaaaattcactccaaaagatattactctggtttctgcattcaatattgcagcctttaacattggaattactcttggttcttttgtaggaggccaaatttccaaaacctctagtgttgtctttacgcctatcggaggaattgttatcatcttgcttgcaatgattctcattggcatagcccaaaaacaaaaagctcagtaagaagttttagtaatccttcagaggataagacttctaaagcagatatggttatctcagactacaacaaagccatcagaaaaattgtgatggatgtgaataatgaagaattgttactttataccaagttacccaaagaacaccaagctcaaaaaatgttgaaagaggtggtttcagaaataaaagaagaagtctcaaatgcttatcctgaatatttgatttcaggttttgagcgacatggaaactcactatggttgaaaggcacaagaaaataaaaatcaggagagattttgtgccaaaggcaaacaaagaatctctcctgagcttatttaaaaaggacaaaaaatcaatgaataatacagttaaacaaatgaatgaatcagcgggtatttctaacagcccgctagagggtcaaaaattaaaccttagaactcagctctcagagaaatatggctttgtgtctatcaagattgaccgcttaaccattatgggaaatattgaacttggaggaaatcaagtctttcaaaatctttgccagttttgggatgtgatcgaacttcaatccaacggagaatacgctggattttacggacaattatttcgtgatagtacagaaaatttttatgtgagctatatgcccattaaagctaagagaatgaaaacaaagaacttctacttagagttcaatcctgctaaatctggtcaagacaatctgaactatgtctttgactatttagttccattattagaagaagtcagtatttcaaggattgatattgcactagactttgagcgtgatttatcttcgtttattttaggcggtcgctccaaaaagaaaattttctttggtacagatggcaaaatagaaacacgatacgcaggaagtggcgatgaatttattattcgcttgtatgataagaaaaaagagcggacagaaaaaggagataaaattgcacaagaagaagttcagaaattcgatcagctttggcgcttagaatttgaattacacggctcaggtttcattgaaaatcaactgaaaaaagaatttcgatttctctcagatactcccattgttcaacttgattttgaagatagaaattatattgaactttcgccacaggaaaaaattatatttctttcaaaagatgaacatccagaactctttgcggagttgtccaaagccacaaaagcgaaatacaatgcgttacgcaaaaaggcaagtatcattgatttggctgatatgacgcgtttaccttttgaattaacagaaatctgttgggattatccgcaagagattgatttgattcagtttctcaatgaaattttgaaagtgtgatgtttatggaaaaattatatggaaataaagaagaaatttgtgatatttttggtgtggcaaaagggacactctcaaatgacttaactagaatgcgaagaaatcctgagttttcaaagtatatcttgcaacccagtcatggacgtgtgaatatctctattgaggggtatgaaaaatttttaaaattccgctccgaagcacgtaaaaaaatattgtaatttgtgataaaatagagagtatctggttactctctattttatataaagataggagtgaaatgtataaaaagcaacaacccaatggtaaatggaagttctttgaaaaatatcaagataagcaagacaaatggaaacaagtttctgtaaccaaaaattcaggtggtcgtgaggctcaaagtcaagcacgaactgaacttgaactgaaaatagcagaaaaactttcagaagaaaaagaagctgaagaagcaccaaaaaccataaacgagtgttatgcggaatcaagaaaaattcgtcaagctgaattggctgaatccacatatctctcagaaacgtatggtttaaaagattttataaaaaaatttggacagcgtgaaataattagcattgagccaaaagaaatgcaagaatatttattttctaataagtattctaatacgacacggcacaccatagctttgcgcataggacatatttttcaatatgcttattcaatgggatttacacatgagaatatcatgaactgtatcatacttcctaaacaaaaaaaatcggctgaaagtcttgccaagtggaaagaaaaatttttcactatggatgaaatgcgaaaatttttgaagagttggcgaagtcatgcagtagaaaaagatgattttaaacgtgcagactttgtagaatttttgtttctaacaggtttgagaattggcgaagcctctggtcttcaatggtcacatgtagatattttgaaacgagtgatttatattcaattgagttggaactgtaatcttaaaaagctaggaccaactaaaaatcctcaatcagttcgttatgtcactctaaatgaccgttgtcttgagattcttgaaaattttcgtaaagataaatatggttcaaaatttgtatttgtgaaatcaaatggggttcaaattcgtaatgcggatattaacacttatttgaaaattgagggcgctcgtgccaatctgtttggtaagaattataaacagttttcagcgcatatgttgcgacattctcatattacagtgttagcttttctaggagcacctcaaaaggctgttatggagcgtgtggggcatatggatgctcgaattacaaacggagtttacacgcatgttcttcctgaaaatcgacaagatttgcagttgaagctagagaatttgaatttataataagcaccatgaagtaccatagaaaatctaagcaagcaccatataagcaccaaaagaaaattaatttggggaaatatgaggaaatggactactcttatcaatactcaataaattagtattggtaaggataggtaactttgatgaaaaataaggaaacgagggagatgatatggcgcaattatatttcaaatatggtacgatgaattcaggaaagtcaattgagattttgaaagtggctcataattatgaggaacagggcaagccagttctcttgatgacatcaagcctagatacccgtgctggtgttggaacagttgcgagtcggattggtatgaaagcagaagctatcgcaattgatgataaaatgtctgtttttgattatgtgaatagcctgtctgctaaacctttttgtgtcttaattgatgaggcacaatttttaaataaaaaacatgtctatgattttgcgcgagtagtcgacgaattgaatgttccagtcatggcctttggtttgaaaaatgattttcgtaatgaactttttgaagggtctaaatacctgcttttacttgctgataaaattgaagaaattaaaacaatttgctggtattgtagtaaaaaagcgacgatggttattcgaacaattgacggtaaaccagtctatgaaggtgaacagttacagattggtggaaatgaaacttatattccggtttgccggaagcattattttaaaccagaaatctaggaggaaatagatgttttatcattttaaaggaacaatcacaggggaagattatcaaagaattctcggacaaatgactaagcgaatgatgctggttttttcaggaatcatgctggtttttttagttgttaatttgttgatgagtaaaggacaatggatttggccagtcgtttctgcactgcttgtgcttgttttagggaatctttttttacattggcaactgaaaagccgttttttgaaaaattttaagccacaagagcttgacatgtatgtgacagaggaacaaattaaagctcaaatgaatgtacgaaatgttgagattttttcagaacgtgttcacttttttcaaggaagaaatcaagtgatgatttttaaaaaggacatgctacaagatgtgacacaatgggattcttttgtaaatatggcaaaaaatttaccattaaaaactaaaaaataattaaaggaaataaagaaatgtttgatcagttagagtcaatagttggaagatatgaagaattgggtgagttattatctgacccagaagtagtttcggatacaaagcgttttatggaattatcacgtgaagaagcagatttacgggataaagtggcgacttataatgaatacaagaaagtccttgaaacaatttctgatagcgaagaaatgcttggtgagggtggacttgatgatgaaatgaaagaaatgctcaaagaagaactttcatcagcaaaatcacaaaaagaagttcttgaagaagaaatcaaaattttacttttgcctaaagatccaaacgatggtaaaaatattattttagaaattcgtggagctgctggtggggatgaagcggcgctttttgcgggtgatttattaaatatgtatcaacatttttctgaatctcaaggttggaagtttgaaattatggaagcgaatatcactggtattgggggttataaagaggtttcagctttgatttcgggtccatctgtttattcaaaattgaaatatgaatctggtgctcaccgagtacaacgtgtccctgtaacagaaacacaagggcgcgtgcatacttcgacagcgacagtgcttgtgatgcctgaagttgaagaattcgaaatgacaattgagcaaaaagatttgcgcgtggatatttatcatgcgtctggtgccggtggtcagaatgtcaataaggttgccacagccgtgcggatggttcacttgccaacagggattaaagttgagatgcaagaagaacggacacagcaaaaaaatcgcgataaagccattaagttgttgaatacgaaagtttttgattactatcaacaaattgaattggacaaacaaaatgcagagcgtaaatcaactgtcggaacaggtgaccgttctgagcggattagaacttacaatttcccacaaaatcgtgtaactgaccaccgaattggtttgactttacaaaaattggatagtattttatctggtaaaatggatgaagtgattgatgctctgattgtttatgaccaaacgaagaaattagaagaattaaataaataatgaattttgaatttgaagattttgtcattcgagaagttggtcatgaacaacggacgatgcaaacctcaaaaaaagtgaataatgtcttaacagatgtgacgatttttcaggtcaaagggctaaatgagtcttttgatttgctttattgtgtgggaaaaaatggggatagctgggtagttgcagaaaagatagagtctctttcgcatcatttgcaccgagcacaaaggacacggatgtccattgaaaaatttaagggaaataattactgccgcctttggcaagaagttaaaaaaggtaaagattggagccaaactaagaaaagtttacctttatcagagtttggtaaatacagtaaaaacccaatacgtaagactttttcagaacttggagcaaagattggaactttggcggagctggtcgatgaaacaaatcaaaatcgaaaacagtatgccttgcttttttcacctcaggaaataaaggttcccctatgtgcttatcttctgacgagaatttcaccattgatttagaaataaaagtagtcaaaatagaagttagttctaaaatgaaacctgtcagtagggaggaatttaattttgatgaatgagaataaaattatgaatcaaacaattgaaaaaatgttagttcacgcgtcagttcgtgattttaaagctgaacctttgccggctcaaacaaaagatttactgctaaaagcagcacaatccggtgcttcgtcaaattttatacaggcctattcaattattgaggtagcggatgttaatttacgatgtgaaattgctaaaatttctggttcggacgcttatgtgaatcaaacgggtgtattttatgtttttgtggctgattggtatcggcaagctcagattttaagggcggagaataaagatgtgaaagctcttcgtaatatggaagctttgacagttgccattgttgatactacaattgctgctcagaatatgacagtagcagctgaatctatggggcttggcatttgttatattggtggaattcgtaatgacacgtctaaagtgacagagttgttaaatttaccagaattgacacttccactttttggactgacaattggtctaccaaatagccgaaacgaagtaaaaccacgtttgccaaaagcaaatattttgtcaatcaatggttataatcatgaatcattgactgatttaagtacttataacgagcaaacggcagaatattatgccaatcgcagtcatcatcaaaagtcgacaaattggtcacaggagatgagtgattttcttacgaatcctcgtcgtgaggacctggcagattttttgaaaaaacaaggatttacattggactgataagttgataaagcctgattttattgggcttttttgctatacttgaaagagtaatttaaaagagattagaaaaaataaaaagtcttagaaagtggaaaagtataatgctttggattgaagctgtgcgaactttatcagcagatttagaagaaccttttgagttagagtttgtctggcgaaatttacatgaacttaataagttatcttggttgaatttaatgcgtgaaaaaattactgaccaagagttaaatttactgacagagctatcagaacgtttgattaaaaacgaacccccacaatatattgtgggctgggcagaattttatgaattaaaatttaaggttgatgagcgagtgctcattccacgtccagaaactgaagaattagttgaaatgattttaactgaaaataacaatgattcgctgaaaattttagatattggaacgggctccggagcaattgcaatttctttagctaaagctcggcaaaattggtcagtaaaagcttctgacatttcacaaaatgcgctagaattggcggctgaaaatgcgaaaatgaatcatgtcaatttggaatttattcaatcagatgtgatggatgaacttactgacaggtttgatatcatagtttccaatcccccctatattgcttttgatgaaacgtatgaaatggatgattctgtcattaaatatgagcctgatttggccctttttgcccaaaatcaaggtttagcaatttaccaaaaaattgctgaccaagcggtcaaccatctgacagatgatggaaaaatttatttggaaattggctataagcaaggaaaagctgttcaagctatttttcaagaaaaatttactgacaggcttgttagtattcaccaggatatatttggaaaagatagaatgattagtgtcaaacgataaaagctactgttggtatatttaaggagaaaaatgaattctttaatttttgaacaagtatttcagcaaaaaaaagattttttacaaatattattattagctgatgatggtccgcatttagaaaattatctggaaaatggtgatttatttactctgtcattaaaaaatggtaagaccgttgcttgtgctgtagtcataaaaaaacaaaaaaatacttttgaaattgagaatttcgctgtagaaactagttttcaaggacagggatttggtcagcaaatgatgaagcaacttatcacttatttgaaagaaaatttagcagctgatgagcttattcttggaacagatgatatttcagggaatgttgaattttatgaaaaatgtggttttgaaattactcatataataagcaattattttgttgaaaattatgaccaacccatttttgaagggaaacagcaattaaaagataaaatatatttaagaaagaagttaaaatgaaagttgaaaatgatttgcgtacgatgtcctcttttttgcaagtgcaattaaaagatgtcaaaactttgattgaatccaacaagatagaccaagctaaagaaactttgaactttgttcaaggcggactcaataattttgctaatgaacttgaaaaagttgaaggtggattttatggtattattggctttctttttcgccgtccttataaagtaccagatgatttgaaagatatcagagaaaatttttttattgaagcaaataaactgcaaaaagatttagataaacaatcagaaaaagaaaataatagtaaaaatcgaatgacagcgagagcagtaaaagcgctaaaaaatggacaattagtggttttaccaactgaaacagtttatggtttatttgcagatgccatgaatgagcaagcggtccaaaaactttattcggttaaaggacgtccaaccgaaaaagctttaaatatgaatgtttcaagttttgaagatattctaaaatattccatcaacccaccagattatttaggtaaaattgttgatgcatttcttcctggtcctctaactatcattttagaagcttctagcgaagttcctgaatggattcatattggcaaaagcactgttggttttagaatgcccaacatagcagtgacccaaaaaataattaaagaagtcggtgttttggttggaccttccgctaatttaaccggttctaaaagtccaagtttctttgccgatctaagtcaagaaattttggaaaatgctgcagtcgctgttcaagatgataacatctatggattagatacgaccatcattgatttgacgcaagaaaaaccaaaattattacgtcaaggggcagtaactaaggcagaactacttaaaaaagttcctgaacttggacaaattgaataaaatatgctgagaaaaagtaatctaaaaatttccgaacaatctttggcaagctgaagatttctaagccaacatatttcaaaaaatgtgctttagccgatataatagttttagagttaaaagtttgcttgcgaaagtaaatcataatttaactgattaagtttatagcgtttaagactataaaattctacttatatttttaaaaatatccccaatagacatacaaggagaacgaatgatttttgataaagaagattttgaaagctttgacccagaattgtgggcggccattcatgctgaggaaattcgccagcaacaaaatattgaattaattgcttctgaaaatattgtttcaaaggcagtgatggcagcacaaggttctgttttgacgaataaatatgccgaaggatacccagggaaacgttactatggtggtacagaagcggttgatgttgtggaaaatttggcaattgaccgtgcaaaagaacttttcggtgcaaaatttgtcaatgttcaacctcactcaggttctcaagccaatgctgcagcctatatggcattaattcaatcaggagatacagttctaggaatggatttaaacgctggtggtcatttgacgcacggagcttcagtcaatttttcaggaaaaacttatcattttgtcccttatggggtaaatcctcaaacagagcttttagattatgaagaaattcttaaaattgctaaagaagttcaacctaaactgattgtggcaggggcttctgcctattcacgtttgattgattttgctaaattccgtcagattgctgatagcgttggtgcgaaattaatggttgatatggctcatattgctggtttagtggctactggtgctcaccccaatccacttccttatgctgatgttgtcacaacaacaactcataaaactttaagaggcccacgcggtggaatgattttaaccaatgatgaagtcttggctaaaaaaatcaattctgcaattttccctggaacgcaaggtggacctttagaacacgtgattgctgctaaagcagtcgcttttaaagaagcacttgacccagaatttgctacatatattgaacaagtcattaaaaatactcaagcaatggctgatgagtttgctaaggttgaaggactacgtttgattgcaggaggctcagataatcacttacttaatttgaaggtcttagatcttggaattaatgggaaagaagcacaggacttattagatagcgttcatatcacgcttaataaagaggccataccagacgaaactttatctccatttaaaacctcaggagtgcgaattggtgcggcagcaatcacatcaagaggatttaaggaagctgaagctcgaaaagttgctcaattagtttctaatgccttggttaatcatgacaaccaagaaaaactcgaagaagttagaaaagctgctttagagttaacacatcaattcccattataatataaaaaaattagacaataatttttgtctaatttttttatattaagttaaatttaaacgagaagtgttataatagaacttatataaaaatgaccgcataaaaatattgaaatgtactagtgaaaaaattaattgaagagaattaattaaaagtcggtcagaaaaatttaggtaagtgatatgtttaaaaaattaattggattaataatgctgatacttcttgtattcggtggtttttacgtttaccgtatgcatgaaaatgtgaaacatgtaatgtcttatgaagcagaggttgagaaaaccctgaaagcacaaggtttaagcggggatacaaagttagcgcttgcgattatttatactgaaactaaaggaaaacaagttgatatcatgcagtccagcgaaagcttgaatggaaaaacaaataccttttccacagaggaagaaagtatcaaacaggggattgctaatctttcaaaggtattagaatacgcatcagaaaagaaagttgatgcttggacgggagttcaggcctataactatggaagagcttatgttgattatattgcggcccatggagccaagaatacgattgctctttcaaaagcatattccaaagatgtcgttgccccaagtttaggaaatacgactggtgagacttattatcatttgacttttgattctttattttacaaccaaggaaagctctattctaatggtggaaatattttttacgccaaagaagttgaatggaacatgttattacttgatttattaaattggtaaaatgctgtttagacagaagttcacatcattgatgtgatttttgtcgaacagtatttttttatatttgaattatcagaaaattatattataatagtgattaataaataatttgaggaagtgaaatcgatgatttataattttggtgcaggacctagtgtacttccaaaggaagttttaaaaaaagttcaagaagaactgttagactttgaaaaaagcggtatgtcagtgatggaaatttcacatcgatccaaatcttttcaagaagtcattgatgaggcgcaaagtaatttgcgtgacttgatgtccattcctcaaaactataaaatattatttttacaaggcggggcttcgactcaattctcaatgattccaatgaatttggctcttgggaaaaaagcttattatgcaatctcaggggcttttggaaaaaaggcttatgatgaggcagtaaaattgagtcagaccttagattttgaagcaatcagtttgggctcaactcaatcagaacattataatcatcttttgaaaattgataagtccaaagttgatgagaaaatggcagcttatttgcatataacaacaaataataccattgaaggaacgactatttttccagaaaatctaccagaagttaattctgttcctttaattgctgatatgagttcaaatattttggcatttgattatgatgtgagtaaatttggtttaatttatgctggagctcaaaaaaatctagggattgccggtttgacaattgtcattattcgtgaagatttattgaatcaaaaagaaagtctttcatcaatgatggactaccgtattttggctcagaatggctctatgtataatacaccgccaacctttgctatttatttggctggtttagttttcaaatgggtcaaagaacaaggcggagttaaaaaacttgaagcaataaatcgtcaaaaagctcggatgttttatgatttaattgaccagtcggatttttatcagagcccagttctaaatgaagcagagcggtcgatatgtaatgttgtctttaccagtccaagtaaggaactggatgctttatttgtgcaaaaagccgaagaaaaaggttttaaatcaatcaaaggtcatcggtcggttgggggaatgcgagcaagtatctacaacgcttttccaatagaaggtgtgcttgaattggttaaatttatgaaggaatttgaagaggaaaataaatgacttatcagattaaaacaataggaaataatattgaccaagttgctctggatgaagttggcgaacaatttgctgtcaatcaagtaccagaaaacaaagcggacgcttttatttgtcgtgcccaaccttttcatgattatgaattttcaaaagaactgttggccattggacgtgcgggggctggatttaataatatcccgattgaaaaatgcgcaagcaaaggaattgttgtatttaatgcccctggtgggaatgctaatgcggtcaaagagttggtcttgtcaatgatgatttttgggacccgtaatttgaaacctgccaataaatggctgacaggacaaaaaggaaatgataaggccattgacgttgcagttgaaaacgggaaaaaagcattttctggttcagaaatttctggaaaaactttaggtgtgattggtcttggaaatattggctcaaaagttgctaatgatgcacagcgtttagggatgaaagtgattggttatgacccatatctctcaattgagcatgcttggaatttgtcacatcatgtcaaacgggtcaatgatttgtcagaaatttttgagaaagcagattatattacggttcacacgccagcgactgatgaaacaaagggaatgcttaattggaaaaatttatcaaaatgtaaaaatggagtgattttgctgaattatgctcgagatgagatttctgataaagaagccattcttaaggcgattgatgaagggattgttcgtttctttggcaccgattttggttctgaaaaattttatcatcaccctcaagtttttttgactcctcatttagggggctcaacagcagaagccagcttaaattgtactcggatggctcttgattctgttcaaacctatttgaaaacgggtgagattattaattcagtcaactttccgcgtgttttgcaagagttaaatacgccttatcgtgtgaccttaatcaataaaaatgtgccaaacgttgtggcgcaaatttctatagcagttgccgaagaaaatattaatatcgctaacattgtcaatcgtggtcaaggggattttgcttatacattacttgatttagatgaaaaagacgaaagaaaattggccgctttggtttcgcgttttgaagcttctgaaaatattgtgcgtgtacgtttaattgagaatccaaatttattttaaatttgatcataaatatttttgaaagacaagtaggatagaggaaaaatgacagtaaaaggattacttgtgatggatgtcgatagcaccttgattgaggaggaagtcattgacctcttgggagaaaaagcaggcttaggtgaaaaaatctctgaaattacggaggctgctatgtcaggcgagttggactttaaagaagctttgaaagaaagagtagccttactatcagggctacgaacgacgatttttgatgaaatttataaagaaattcatttgacaaatggagcgactgggctgattgaaactttacatggcagaggttggaaagttggtgtcgtttcgggtggttttcatgaaattgtggataaattggctgtagatttaaaactagattatgtttttgccaatcggttggctgtgcaagagggttatttgactggcgaaacttatggaacgattgtcgataaaagtttcaaattggaaagattgaagcagtgggccaaggaaaataagttggatttgtctgaggtagtcgctgttggggatggggcaaatgatattccgatgttaaatgctgctggtcttggaattgctttttgtgcaaaaccagcggttaaagctgctgtggcttatcatattgataaaagaaatttattgatggttttagaacttctggaaaaatatactgacaagcaatcgcttataaattgataaaaaaatactgacggaaaatctgtcagtatttttttaatatttgatattaaaatcggtaaaatcagggaaacttgtaggagtcgactcgacataagttactttcgcaaagggagaaagacgacctttggaagatttttcgccacgaataagggccgtaaattcttctaatttttgggagtcatcagtttgggcaaggataccaacggtaccatcatcattattccaaatacgacctaaaattcctaattcacgggcacttataataacaaaatagcgaaagccgactccttgaactcgtccagaaacaatcatttttactttgaacattttagctcctttcattcgttaaattattaagtgacttgtttatttaaaacgttttcttttattatagcataagcacaagcaagattggcaaaaatctgataaaataagagaatggaaatcatcagttcaaaagataataaaaaagttaaagaagcaagaaaattgctgacaaaaaaataccgcaaaaattcatatctcatcgaaggatttcatctgttggaggaagcactgaaagcaggtcattcaataaagcaaatttttgttgaagaaaataagctggctaaactgacagcaatgattgggtctgaaaaatcactgacagacttatctgtaaatctggtcagtaaagatgtactaaaatctttagctgacagcgaaagtccacaaggactgattgctgaagtggcaaaaattgaagaagttattgatttttcagcatcaaaatttttacttttagaaaatgtgcaagatccaggaaatgtcggaaccatgattagaacggctgatgcagccggcttttcagctgttattttacttggtgaaacggcagacctttatagtccgaaggttatgcgttcaatgcaaggatcaaattttcatttagcgattgcccgcatgaatgaagaagaatgttttgctgcgctcaaacaagcaaaaatttcaattttgacaacaacgctatcagcaaattctgtatcttataaaactgttgaggaatcatcttttgctttggtcatgggcaatgaaggagctggagtatcagactttgccgtggaatctgctgacaagcttgttcatattgacatgccaggacaagcggaatctttaaatgtggctgtagcagctgggattttgatgttttcattgtaaattactgatgaaaaccctagcatattcgtaagcgctcaagcgctaacgactatcctatgacagaaattgattttggctcgtaaatactaaagaaacacctatatttgctgatagggctgtccttgctgacggactgaatcttccccagtaaaaaataaagctgtcaattcattttgacagcttttgtgtcctattctattctttacaatttttactttgcatttatcagtgcttttttaaaatcaatatcgctgacggaatcagtaaaagtgaccaattcatccccgttgcttttgtaagtaattaataaacaagaattttcttccgaaatagcaccatgccaatgattgatattctctttaatagtaatcactgtgttagagagtaaaagacggggaacgctgccttcttcttgataaatcatcgctcctttagtcaccaaaatggtttgtccacagggatttttgtgccaatttgttcgtgaaccaatagggaaagtcaactgttcaaccattgcaaaaatattgtcgtctaaaatattcaaataaaaaggtaaacctgaataagcaggtttttcgactttgtttcctttattaaacattattgacctccaaactttttaaaaactcgattcaccagaggtggaattaaacgagataaaatgagcaataaaagataaacaattgcccaggagcgcaaccacagtaaccatgggaaatttgtaaatccaagtttgagaatattgagattgatataaaataaagaaaacgagataatcattgttgtaagaacaaaactaatctgtttttgtaaaaatgtgtgtgacataaaaactcctttgttttgtgatatactcagtataaactttcaagtgaacttgaaggcaagtaaaaaagattggatagcatgtataaaatatcagaaatcgcaaagcaaacaggattaacgactgcaaccttgcgttattatgaacaaattggacttttacagacgaaaagaaaaaccaatcattaccgagaatttgatgattctgaccttgactggctgagatttatcgaaaatatgaaaaaaacgggcatgaaactttctgaaatcaaatatttttctgatctcaaacaattaggtgcaaaaagtcgtcagaaaagattagagttattagaagagcagaaagtagaattaatcgaaagaataaaagaaattgaacaaagtttgaattttttagaagaagctaaagcactgacaaaaaactgttgataggagaaaattgatgacaaactacattgcaaaaattgaccgaccaattggaacaattcatcatgggacagtttatccaataaactatggatacatcgagggacttatcgcaggagacggcgaagaacaagatgtctatattttgtccaatttacctgagaatcaaaaagctctcaaaacattcactggaaaacgcattgctattattcacagaaaagatgatgttgaagataaatgtgtattgaccagtccagctgaaaatttcacaaaatcagaaatcgaaaaggcagaccattttcaagagcaatattttgacagtgaaattgaaatggtagaataaaaaattactgacagatcaatacgacccagccacaaactcacatcatagatatgagttcagcttgtccaagaagtctctctatggcagagtgagcattgaatcgtagataaaaaagctgacagaatttctgtcagctttttttttcatacttgtcagtaatttttatgttttaacattagttaaagtgagccgctaaagtttctgcaaaagcttcaagatgggcttcgtcttcatcttcaggtgacaaatcgacacgaacgagctctgctcctttagttgcccctgttttttcaaattgcgcttcaaacatatcgacgcagatacagaaatcatcatagaaagtatcgcctgaaccgaaacaaccgtaaattttaccagataaatcaacctcagctaattcttcgtaaaagtcaacaatttcgtcaggtaactcaccgtcaccgtaagtgtatgttccaacgatacaaagatcagcatcagccatatcatctgcatcaacagaagtacattcatcaagttctacttcaaaacctaattcttcaagtttatcagcgacaatatcggcacaagcttcagtatttcctgtcatacttgcatatacaatttttgctaaaggcatttttcactctcctataagatacaaggaacgtatagattttacgtaccaagctcagttaattgattaatatttgtctatctatcattgtgatgattcaattcaattataacaaaattcaagtgaaatcaaagctaaaaactatgaatattatttcacgctcttcttttgtgagaggaatattgctggaagagcaatgataatcaaaacaattgaagagacaagaaaaccaagttgataaccattaagagtcactgctttttcaacagaagtttttgcagtcgcaataaccgtgggagttaaagtggtatgtagagcttgctaattgatgcagtttagtcgtcatctgtccagcaatttctgatgttacaacagcagtaactaccgcagaaataacggctgaaccaaaagatgaaccgacattttgaatgattctttgacctactgatgcaccaggaatatcttgtttatctaaaccaatgaagatatcagtcatcattggcatttgcaggccaccaattcccattccgcgaataaataaaaccagtcctaaccaaattaaattagtattttcttgaacgaaaatgaaaggaaccgttcctagaagggaaatagcaattgaaaccagaacaactggtcttgctccaagtcggtcaatcatttttccaatcaaggggcgagttgccatcattccaagaccttggggaattaacatcaaacctgcttctatggctgtaaatcctttggtattttggaaaaagagaggaagaagaagcataggaccattagaagcaattccggctagaaaaattcctatatttgctgcagtaaaatgtttagatttgaaaaatcttaaaggaagaacggtattatttttccgaatttgattataaattccataaataataaataaagataaaccaatgaggacaaaagtaatcatttgactattgaaaaaatttttagcattcgttgaaccggttctgttgcaaagttttaaataaagaataaaatcccttacggtatctatgatttaagctgggattcccaataataccttgatttcagtagataccgaaaagccgaagagcgttccatttcttcggttctttttgtatattcctcgaatggcttccatgcctttaatcgtggttgaggcagtgcgtaaacttcgatagaatttattgcgtctctttactggacgatggtcttgttcaatcaaattattcaggtatttaatggtacgatgttctgtcccttgataaaagccgtattcttttagtttcttaaaggcacttgtaatagagggggctttatctgtgactacaaccttcggttcatcaaactgcttcactaaccgcttaagaaaagcataggctgcttgtgtgtcccgttttttacgtaaccaaatatccaaggttaaaccatctgcatcgatggctcgatacaaataatgccattttcctttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtagcccacggctacaataatcacatcctgctgaaattgctttcctttaaaatgattcatcgtcattcctcctgctatctttttctattattctaccttatttgatagtagatttaaaactttgcaacagaaccgaatatccaatgccaattggctccagaaacaatagcaccaccaagaacaggaccgatgattgggcaaagaataatcggtgtagaaacaacggccattaactgaccaagtttattaggaggtgtaatttgcatcagcaaggtggtcatcagtaaagtaatgaaacctgcagaaaatccttgaacggctcggaaaatgataaaactatcaatattccaagcaattcctgataaaaaactaaaaagtccaaaactaaggagggaccattgcatgactttttttccgtcaatatgattgaccacataaccacaaacaggtacggctacagcaagggcaagtacataacctgtgattgcccattgaatcatgtcaagagaggtatgtaaatcactttgtaatttgttaattgcaatattgaccatggtggagtcaagcatgggagcaattgcaccaacaactagtatccaagcatttcgagtcaactcttttggtaatttttttttttgattttgccataatggcttcctttcttttcgcttaagcgaaaactaagccttgataaacttagaaaaatctaaaaattcaattcagatacattttgtatcttatttacaaaagatattataaaacttaaagttttatttgtcaacaataagattctttttgtatctaattttggtttttggtattagataagaatgatgatataatagaaataagaaacaagaggtctcttatgcttgaagaaaaagtaaaaaaaacgccaattcaatctcgaagaagaggaagcgaacttaaagaagcaatttataaagcggcaattaatattttagaaaatgaaggttatgaaaaagtaacctttcaaaatgttgcaaaagaagcaaaaacgacccgaagtgtgctttatcggtattggaatgatgtttttgacttgatttttgaagccgtacgttttaatatttcacaaaatcctaaatggcgtgggaatgtcattgatcaagaaatcaataaaggaagcttacggcaagatttgattgaacttttaacttttatgagagaaaattttttactctatcctaaaggttttttagctttcgtctcatttatgcaatctcaaggaaaaaattttcttgaatcgactgttggtaatgtccttccaagcaatctgattatcatggaacgtttactagccagagctcaggaaagaggagaagcgcgtgaaaaaattggacaatcagccaaagttcttccctttcaaatgactcgatatcatatgttgcttgagggccaatcaatgaatgatgaacaaatcaaagaattggtcgatgaagttttacttccgatttatataaaaaacaccaagtaatggtgaattttatggtaaaatagagtgtatttatactaagcaaactcggattgattagaaataattaattgaattgctcagcatttcaaatcattttgaaaaggctcatgattgtcgaagaaaattcttatagatacaggcataaatactatctcataagaattcagtaaccccagtaaatagctatttatttttcgatgaagtatgagtcacttcaaaatattaatttaaataaaaagaaatgagtctattctcagaactttagaaggaaagaataaattgattacattaaaatctcaacgtgaaatcgaacaaatggaacgcagtagtaaaattttggcagatatccatattggtcttcgtgatttgattaaaccaggtatcgacatgtgggaaattgaagaatatgtccgcaaagtttgtaaagaaaaaaatgttttacctttacaaattggtgtagatgaaggaaattataatcccttcccttatgccacttgttgctgcttgaatgatgaagttgctcatgcttttccacgtcatcaaattcttaaagagggtgatttgattaaagtcgacatggtacttggcttagttgaagacggctctgttgatgtttcaaaacttgactttgatgatgctgagtcaatggttaaatatcaagaagaatttcgtggtggagtggccgattcttgttgggcttatgctgtaggtgaagtttctgaggaagtaaaaaacttgatggacgttactcgtgaatgcctctatcttggtattgaacaggctaaagttggaaatcgcattggagatattggggcagcgattcaagaatatgctgaaagtcgtggctatggtgtcgttcgtgaccttgtaggacatggtgttggcccaacaatgcatgaagaaccaatggttccacattatggacgtgcgggtcgtggtcttcgtcttcgtgaaggaatggttttaaccattgaaccaatgattaatacaggtgattgggaaatcgatcatgatggtgaacgaggttatgtgacttttgatggaagcttatcttgtcaatatgaacatcaatttgtcattaccaaagatggtccagtaattttaacttctcaaggggaagagcggacttattaagaagtaaaaaaggaaaaagcagatgagaggaaagatgaaaaaaggtctacaaaaaattggtgaattaacgacaacttttatgacttttttcaagagctctgaaatgagtctgtcctcaattgccgttgcttattatctcctgctcgcaatctttcctttgggcttgattattggaaatattttaccattcttacatattgatacttcaggtttattgagctttttatctgagcagcttcctagtgatgtttatcgaggaattgaaccagtcattaataatctcttaaatcaaagaaataccggattactttcactttctgttttggcaggtttttggaccttttcaagggctttatctgctttacagatgtcgatgaataaagcttatgaagtttttaatcatcgagattttattgtcagtcgagtaattggtttagctgcaggatttgcgattttactctttctctatttctcaattgtcctttcaacttttggacaattaattttagagcaagtacatcgtattttcgcttttgatgatcatttgtatcgcactttgcataatatgaccctgccagcgattgctgtagcgacttttttgtctttgatgatgctttattttattctaccgaatgtcaaaataagaaaattaagatatacgatgcctggaacaattttttcaacctttgttttagtttttctgacaaactggattgctaagtatgttagttttgctttgcaacgattggatgacttgaagttaattgggtcattggttgtttttgctctgatgatttggtttattttcattgcccgagttctaatcattggtgccatactaaatgctgtctaccaaaaaacaaaagttggtaagattgaaacacgtcgcggtgaaatcgttgaattcatcaaggaaattagaaaataaaaaaacactgacagaaaatctgtcagtgttttttgttcgccgattcaatgctcactctgatcgcattgaactgtcagtagtttttttaaaaaataattttcttaatcattaatctttttatcttctttaaagacaaagaattttgaatagagatagttaatgacaataattagaacctgaacgactagattgaggctagccaccatattgtttttagaaagtccaaaaaggttcatcaaaatatctggatgttggtcaataaaccaccagttaataaaaatagaaacgagcaagagaacaatccggccagaagtaaaattgatgaaatcacgtaataaattggttgattgatgtttaaatacaaaaagtttattcgtgaaaaaagcgaaaataatacttgaagcttgggcagcagtttctgagccccagccagaatgccatgcttgccaagttaaccatttgacaagagcatagacagcagttgccaaaacaccaaaaataagatatcttaccgtttcggattttaaaacattcatgagttttttcatgtcgtaattatatcatactcttttcttagactccactaaaaatagaattttcatagcatgaatagatatttcaaataatgtagggaatagggtataataacaaaataaataaagtaatataaatacaaagaaatgagaatggtttttgaatcaaatgatgaaaaaaataattgttttattgctcatcagtggtttatttttggtcacgcctcatgcttttgcaacagcaggaggataccgagggggaggaaatagaagcacaagaactggcggtaattttggaggtggaaacactaacagccattatcataatactggttccaataattatagctctaattctggaacatctagaatgggaagaagatatagtaggggaaggatttgggagtggctgattgtgcttgttggtctcggactttattttgtaagaaataaagttaaacttccttttaaaaaaagagattatcatcaagaaaagacaataaatgatccggctttagcacaagaaatagaagaaatttttcttaatgttcaagaagcttgggataaacaagatttacaaagcttatcaccattttatggcgatcaattgtatgaaaagcatcaaaaagttcttgaaaaaatgagaaataaaggtcagattaatcatacgcgcagtgctattttagatggtatcacgcgttataaggaaataaaagataatcaatttgaagttgacctatattttgtagctattgactatcttgtttctattgattctggtcaaattatttcgggcaataatcaatatcgaagagaatttaaacaacgctagacttttagtggtcaaaaaggagcccttcgagttgaaaaaatgagagaatttaaaatctaacgattatttaaattagaagagaaagaagaaaatgattgtttatctattagctttattagcagtttggaatcttattgtctttgtgttttatgcggtcgataagtacaaggcacagcatcacttatggcgaattccagagaaagttttacttgcccaagcacttttaggtaaggggattggagcacttctagctggtcatctctgtcatcacaaaacaagaaaatggtactttaatctttcttggtatttgggcctacttgtagatgctgtcctcctctttttaatcatcaaattttttgttaattaatgatgaaatttcatttttttagaaaataaaatgtgatttttgtcagtcattaattaagacaatccattgacatttctgacttaaaaatggcataatagaggcatgcctaaacaacgattttactcatttatgattggaacggttattgaagcttggattttcagctgggccttcctttctgcttcgtggtttttagccacatttttcggcttttttttggtgcgccgaatcttccttgcttatcgcttggataaatttatacgtgagatgaaaatgtgattttttatcacaatttttattataaaagtactgacaaaatttgtggagacttgtaagtaaaaaaacatgacattattctctagcaactctgtcagttattcttaatttatgaaaaaataagggagaattaaaatggcggtttcagttcaagacttacttgataaaattcactttcatgtgatttattcaacagaaacagcattacaaaaagaaattacaacttccgaaattatgcggccaggtttagaaatggctggttattttgattacttcacccctgagcgaattcagctttttgggatgaaagagtggtcttacatgatgactgtagtcggagataatcgttatgaccttttaaaaaaggtcatggccaaagaaacaccagttgtgattgttgcgcgtaatttagaaattccaagtgaaatggttgcagcagctaaaaaagcagatattgtcttgcttcaatcacgggaagcaaccagtcgtttaaactcggttttgacttcattccttgatgaacgattagcagaaagaaccacagttcatggtgttctgatggatatttttggtgttggtgtgctgattcaaggtgcgagtgggattggtaaatctgaaacaggtcttgaattagttaaacgaggtcaccgattagttgctgatgaccgtgtagacgtttttcaacgagatgcttttacgctttctggagaacctgcagaaattttacgcaacatgatagaaattcgtggcgttgggattattgacgtgatgagcctttttggtgcaggtgctgtcaaagattcaacggatattgatatggctatttatttagaatattacgataaagaaaaagcttttgatcgtttgggaaatgcgccgacaatcgtcgaattttctgatgttgaagtgcctcaaacgcgtattcctgtaaaaacagggcgtaatgtgtcagtgattgttgaagcggcagtcatgaatttcagagctaaacaaatgggctttgatgcaaccaaaacttttgaagatcgtctaacagacttgatcagtcacaacaaagaatcacaataaaacttagagttaactgacagacagaaatactgtcagttaaaatagaaaactgataaaaactatgaataatttatttccttttttagctctggataaaattgctctccaattaggccctcttgctattcattggtatgccatttttatcgtgggtggtgcggcattagcggtttggttagcgtgtaaagaagcaccaaaacgaaacataaaggtcgacgatattattgattttgtactttttgcttttcccttaggaattgttggagcaagattatattatgtaatcttccaatggtcttattatagtcagcatccgtcgcaaattattgcaatgtgggatggtggaggagccatttatgggagtttaattgctggagcgattgttctttttgtctttagctactaccgcatgatccatcctttagatttgctagatattactatacctggtgttttccttgctcaagcaatgggccgctggggaaatttcgtaaaccaagaggcttacggtaaaattgtttcaaatttagattggcttccaccatttattagaaatcaaatgtttatcgagggtcattatcgaatgcccactttcttatttgaaagtattggaaccctaagtggatttattctggttatggtctttagacatcgtatcaaaggtttgaaacgaggagatatttttagtttttatctcgtttggtatggggcagtacgctttattgttgaagggatgcgtactgatagcttaatgttgggcccagcacgggtgtcacaatggttgtcagttttattagtgatattaggaattatcctatttgtttatcgtagaattaaaaaaaattaagaaggctatcctaagggattgcctttttgtcataaaaaaatgtaagtaatattagaaaatggcgcaacaatttgttataataagataaaatagaatcgctttcatccaaatgaaagaagattaaaaaatggacatagagttttaagtccgaataagaggaggaaacgtgggaaatattgcattattgattatcgcgatagcatttgctgtattggtagtcttcttggttattgtattacataaggtttcgaaagttgtagaagaagcgaaccgtactgttaaattagtatcgagtgatgtggacgtactgcttcatcaagccgatggaatcatgactaaggctaacactttgcttgatgatgttaatgggaaagtcgccacgattgaccccttgtttacagcagttgctgatttatctgaaagcgtttcagatattaatgcctcaagccgtaagcttgtaacacgccttaatcgaggttcaacaaaacgaaaaacaacttcagcttcggctgttgtacttgccaaaacagcgaaaaaattctttgtcaaaaaagataaatctgaagctggtgtaaaagtaaattaaattacttacataaagaaaggacttaatcgatgtcaaaaaaaacaggatttctagttggtgctttagttggagccgcagccgctttatttttagctcctaaaaaaggaagcgaactccgtgaggaagcggggaaaatttatgatgatttaaaagaaaatccccaagaaacattgacagggatgagagatactgctcttgatttttcagctgaaaaatttaatgaaattaaagaaaagtttgattcaggagagatttcagcagataaagctaaagatttcttgctttcaaaacgtgatttaattatggaaaaagtggattcaggagaactttctaaagaaactgttattgactttttcaatgatacaaaagatgctgtcgttgaaaagattaattcaatgaaagaaagtggtgaagaactctttgatgaggatgaatctgacctgtctgatgaagctgcagaagtagtggctaaattcagtgatgcaaaagatgaagtaaaagaagatattgacactcaatctcttgcagaagaagcaaagaaaattgctgatgaagccaaagaattaacaaattttcctgacgaaaaataataaaattcaatctgtcttttaggcagattttttgctatgtaaaacatttacacacctaactatggtaattggaaataaattgcgttatactatataatatataaaataaaagaaatactctggaggatttcaaatggcacaagcaaactttggtgttgtcggaatggctgtaatgggtaaaaaccttgcactcaatgttgagtcacgtggttataccgttgctatctacaaccgtacgacttcaaaaactgaagaagtttataaagaacatcaagataaaaatcttgttttcacaaaaacacttgaagaatttgtcggaagtcttgaaaaaccacgtcgtatcatgctcatggttcaagcgggagctgctactgatgcaaccatcaaatcactcttgccacttttggacaaaggcgacatcttgattgatggtgggaatactcatttcccagatacaatgcgtcgtaatgctgaacttgctgactcaggaatcaacttcattggtactggtgtttcaggtggagaaaaaggagcgctcttgggtccttctatgatgcctggtggacaaaaagaagcttatgatttagtagctccaatttttgaacaaatcgcagctaaagctcctcaagacggtaaaccatgtgttgcttatatgggagccaatggtgcgggacattacgttaaaatggttcataacggaattgagtatggcgacatgcaattgattgctgaatcttatgaccttttgaaacgtgttcttggacttagcaacgcagaaattcaagccatttttgaagaatggaatgaaggcgaacttgatagctacctcatcgaaatcacaaaagaagtattgaaacgtaaagatgatgaaggcgaaggctatatcgttgataaaattcttgataaagcaggaaataaaggaactggtaaatggacttcagaatctgcccttgaccttggtgtaccacttccattgattacagaatcagtatttgctcgttatatttcaacttataaagatgaacgtgttaaagcaagcaaagttttgtctggcccagctcttgatttctcaggcgataaaaaagaagtaatcgaaaaaatccgcaaagcactttatttctcaaaaattatgagttatgctcaaggatttgctcaacttcgcaaagcttctgaagaatttgattgggacttgccatatggtacaattgctcaaatttggcgtgctggatgtatcatccgtgcagaattcctccaaaacattactgatgctttcaacaaagatagcgaacttgaaaatctcttgcttgatgactactttgtagacatcacaaaacgttatcaagaagctgttcgtgatgtggtttcacttgctgttcaagcaggaattccaattccaacattcacctcagcaattagctactacgatagctatcgctctgaaaatcttcctgcaaacttgattcaagctcaacgtgactatttcggtgctcacacttatgaacgaactgataaagcaggaatcttccattacgactggtatacagaagattaatttaaaaatattcaatcaaaagctagagttttctagctttttttcttttaaagattagtagtattctttggaacattttttaacaaaaaatggataaaatgttatattattagataatcaaaatgtgcttagcttattttaaaaaaaatgattgcaactagagaaagttgagggagctaaaatgggttatcaacataatcgctcatttaataaggcgacaggcgcaggtttcattatcgcaatgggaattgtctacggtgatattgggacaagtcctctttacacaatggaatccattgtccaaggtcaaggagggcttgaacgaatttcggagacctcaattatcggggctttgtcattgattatttggaccttgactttgattacaacggtcaaatatgtttggattgctttaaaagcggataacaatcatgaaggtgggattttttccctatttactcttgttcgtaaatatgcaaaatggttaattatcccagcgatgattggtggagctgccttgctttctgatggtgctttaacaccagctgttacagttacttcggcaattgagggattgaggtctattccagcttttcatgaagcttttggtcagcaacaattaccaattgtcattataactttggcgattttggcaattctgtttttgattcaacgttttggaacttcgatcgttggtaaagttttcggaccagtgatgtttatttggtttagtttttttgggattacaggcttgattaatctctttggcgatttttcagtccttcaagcaatcaatccttactgggccattcatttactcttaagtccagaaaataaagcagggatttttgtccttggttcagtctttttagcgacgaccggggcagaagctctatattctgacttgggtcacgtgggccgaggaaatattcatgttagctggccatttgttaaagtttgtattatcttatcatattgtggacaagcggcttggcttttacaaaatcgcggaaaatcattaggtgatattaatccattttttgcagttttacctcaaagcctgattattttttctgtgattctagcgactttggcagcaattattgcttcccaagctttaatctctggttcatttacattggtttctgaagccattcgccttaaactactcccaagattgagaatcaattatccgagggaaacctttggccaattgtatattccagcggtaaatctgggcttatggctcgcggcaagttttattgttgtctacttccaaagttctgcccacatggaggccgcttatggcttagcgattacggtcaccatgttaatgacaacaattttattaacggtttatttagcacaacatcaaaaagtcaaaaaggtattcgttgtcctctttttcggtgcttttatcttcatagaaggattattttttgcagcctctgctgtaaagttcttgcacggtggttatgtggttgtgattttagctgccctcatattattcgttatggcaatttggcacaaatctgaccaacttttctataaatacctcaaatcttctaatcttaatgattacaaagaacaaatgaataagctgcgaaaagacgaatcctatgatctttatcatacaaatgttgtttatttgacggccaaaatggctaaagaatggattgaccgttcaatcttgtattcaattttagataaacgacctaagaaagctgaagtatactggtttgtgaaggttaatgtcacagatgagccttatacttctaagtatgaagtggatatgttagggactgattttatcgtttgtgtcaatctctatctcggttttcacatgcgtcaagaaattccacgttatttgcgcacaatcgtgactaatttgatggaatcaggacgtttaccacaacagcatcaaccttacagtatcattcccggacggaaggttggcgatttccggttcattctcttagaagaaaagttgattaatgcgagacaaatgcccgcttttgaaaggttcgtccttcaaacaaaggagcaaataaagaaaattacggcttcgccggcgcgttggtttggactccatttctcagaagttacagttgaaacggttcctttagtcctttcagacgtcagaaatttggaaattctcgagcgaatttctaaggaaaatgaagtggaaaatctgtcaaaataaatatgcaaaaagcttggatttgattgatatagtagtgttttagaagaataacgtattttatataaagctgcgagaaataaataaatgtaatttctcacagttttttttgaataaactggggataatctgctataatatagctattaaaaaacgagctaagcttcgttttatttatttgactattttcgctgaagaaagttgaggagttataaaagtgggtcaagtacacttacataattggtcgtttaacaaagcgacctctgcgggattcctgattgcattaggaattgtttatggtgatattggaacaagtcctctttatgccatgcaggctattgttcgaggacagggaggattagcaaatctttctgaaagttttattttaggggctgtttctcttgtcatttggactttaacgctaatcacaacagttaagtatgttttgattgcattgaaggctgataatcatcatgaaggcggtattttttcactgtttacgcttgttagacgaatgagaaaatggctgattgtgccagcaatgattggtggagcgacattactagcagatggggcattgacccctgctgtaacggtcacttcagcaattgagggattaagaggggtaactcatgtttactccaatcaaacaacggtcatggtgaccactttgataatccttgcctttctctttttaattcagaggtttggagcaagtttggttggtcgtttgtttggaccaattatgtttatctggtttggctttttgggcgtgagtgggctaatcaactcatttcttgacttatcaattcttaaggcgattaatccttattatgcgattcatttattatttagtccggaaaataaggctggtttctttatcttgggttcaattttcttggtaacaactggggcagaagcactctattctgacttaggacatgtaggtcgcggaaatatttatgtcagctggccatttgttaagatttgtattatcttatcttattgtggacaaggggcttggcttttagctcaccgtggtgaacatattgaaaagcttaatcctttctttgccgttttacctgataatatggtcatttatgttgttatcttgtcaacgctagccgcgattatcgcctctcaagcactgatttcaggttcctttactttggtctctgaagcgattcgtttgaaacttttacctttgtttaaaatttattatccagggcaaactttgggacaactttatatcccagcagttaactttgcactttgggtaacgacttccttctttgttttgtattttaaaacttcagaacatatggaagccgcttatagtttggcgattacaatcactatgttaatgacaacgacccttttgacttatttcttaattcaaaaagggatgcccaaaattgcgattgcttttatttccattggtctcttttgtattgaaggctcgttctttgcggcttccttggtacaatttatcaatggagcatatattgttgtactgattgctttggcaattatctttgtgatgtttatctggaataagtcacataagattgttatgaaatacattaaatctttgaatattaatgaatataagaatcaattgaatgctttgcgtcatgatgaatcttatgacttatatcaaacgaatgtggtttatctgacgagtaaaatggatcatgaatggattgaccgttctatcttgtattccatcttagacaaacggccaaaacgtgcggaatgctattggtttgttaatgtgaaagttactgacgaaccttatacttctgagtacaaagttgatatgatggatactgattttattgttcgagtgaatctttatctcggattccgtatgcgtcaagaagttccgcgctatctacgaactattgtgacggatttgatggaatcaggtcgcttgcctcgacaacatcaacactacagtatcactccaggacgtaaagttggtgatttccgctttgtcgttgttgaagaaaaattaatgaatgcacgacaaatgccaggctttgaacgttttgttcttcaaacgaaagcacaaattaagagaattactgcttcaccaattcgttggtttggacttcaattctcggaagtaacagttgaaacggttcccttggttctttcagatgtacgtaatttggaaattcatgagcgtttagagcaagtagatgaaacagaagctcctgcaacaaattaaaaaacttactgacgattctgtcagtaagtttttatttttgtcagtaaaaattttagcgtgcaagtcgttttcgagcggattcttttcgtttttgagcgatgaattcagccttgtcagctgagggaagatatccttttttcttggcaatcaagagggcagttccagcgacaagaatttcgactgattttccaatgaggtaaccttggataaatttatttttcacttgcggtgctcctttagtttttatttaaaaatcattatattatcattataaatcaaaaaatgtgaaaacgctatcgaatcacttctaaaaatgaaagattttttaatcttaaccggttaaggttaagattagacacatgtgatatattagtatcagttgtaataaataaatgaaaaagaaagaaggtaagaaatatgacaattataggtgtaaaaattgatcagaagtttatgagggacttactcatcctgattataggtgtcggcctttatgtattatctgttcaattattcgtcatccccaaccgtttagcaagtaatggtgtcgctggtttctctgtacttatggattttgttttcggcatcaacccagccttgactttctttttggtaaatgtacccctctttattttcgggggacgtctgcttccacgtagaattttacttttaagtattcccggagctcttgcgatgagtctttggttaatgatttatgaagcattgggtgttactggttttcaattctcacatgttatttttgccggaatttttgatggaattttatcaggcatcggtgccggtctagtcatcatttcggaagggacttttggcggctctatcctacttagtcgaattttagaagaacaatgggattttaaaatcgataaagtattattcttagttgacgtagttgttctgagcgtttccttattgactttcttgtctcttcctaactttgccgttactctcctatcatgctacatttttagtaaaatgacactgattgttgggcgggaagattatcgaaaatctttgatgtcacgtggaaagaaaatttaccaaaaagtgtttgcggcttaagagactgtaaaatatattataaagttactgacagaatggtcagtaactttttttctggtcaaagcttgaatttgctgattatttctgaaataatagagattggaaatcgtgagggtgagttaaagatataaatgaaaaataataaagttttggttgttgttggaccaactgcggtgggtaaaacggcactaggcattgatttagctataaaaatgaatggtgaaattatttctggtgattcacaacaagtgtatcagggattagatattgggacagcgaaagtaacaaaagctgaacaagccttagcagttcatcatttgattgatgttcgaaaatggacagagaatttttcggttcatgattttgtgatggaagccaatcgattgattaaggagattattgaacgtgggaatgtcccgattattgttggtgggacaggactctatattcagtcactgatagaaggttaccatctgggaggtcaaaaaaatcatcaagcaatgatggaacttcgagaaacattgtcggctttaactgacgaagagctctttgaaaaagttcttaaattaaatccaaattttcctgaattgaatcgcagacgagcgattcgctttttggagttgcaaacttttggttcaactgacgaaaatagtggttctgattataattttttattaattggcttgaatgcagagcgaaaagtgctctatgaaagaatcaatcagcgggtagagcaaatgatgagcgaagggcttttggctgaggcaagaactctatttgaaaaggcacccgatgctcaagcagcaaaagggattggttataaagaatttttcccttacttttctggcgagattagtttagaagatgcagtcgaattagtcaaacgtaattccagacgttacgctaaaaggcaattgacttggttcagaaatcgaatggaagtcgaatttgaggatgtcttttcagaaacataccctgattcagtttttgagaaagtgactcaatttttgaactgactctttttcgtaaaaatgttataatgaaaatgattgaaaaaggacattatatctgactgacagactttaaatcagtcaacttattttgctgacaaaaagattagaagcttgtcagtaatatttttagcaaaaaaggagagagaagatgaatgataaaaaatggatagatttgggaatgaaatatggtggattcatggctcaagatcaaatttttttagaaaatagattagccactttaactgatgtcgccgataaacgacttttggttactccgccagcatcggtattgaatgcttattttgctgaactttatcaaaaacgctcgcctaaggatgcgacagactatttctttgagctttctaaggcctttgatatttttgaagaaaacccagattttcaacttgaaggaaaagtgggttctgaacatttccgttttattcgactcaacctttcaggcaaatcatttggtttttcttataaaaatgaagcggaagaagcgcttatctttagtgagtttccagtaaaaattacagctgaattgatgtttgaaattgcgcaaatttttccacactatctattgattgaagaagatggaaaattgcagatgaaacctgctcaattccaaagtgaatttgagaaagttaaagacgtgaccgccttgaccgagcaagcggaaaatgaagaatatatccgtttatcaggttataatattgaggatttattggagcaagcacaggaaattggctttttaagtcctttgtgctatggacgagatggacgaaaacatttggtttatattacaaaaggcttttaatcattgatgaattagctgcctaaaaaattgcaattctctccaataagtgatagactatttgaaaacggttactgacaaagacattttcattaaaaaaactaattatttaattttactgacagattgatcagtgactgatgagaggctacaaggaggaacttttcatggatattattatttttccactcgttattttggcaattgttttactaattcttatctttagtttaagtacaattgtcttcgtcgtgaagcaacaaacggttgctattgttgagcgttttggtaaatatcaatttactgcaagcccaggttttcatttaaaactaccatggggaattgaccgaattgctgcgcgaattcaattacgcctgttgcaaacagagatgactgttgaaacaaaaactgcagataacgtctttgttacgatgaatattgctacacaatatcgagtaaacgaacaatcaattaaagatgcttactacaaattgatgaacccaggtgaacaaatcaaagcctatatcgaagatgcccttcggtcagctgtgccaaagttgactttggatgatgtctttgagaaaaaagatgaaatcgctcttgaagttcaaaaaacggttgctgaagaaatgcaaacttacggatacattattgttaaaactttgattactaaagttgaaccagatgctgaagttaagcaatctatgaacgaaatcaatgcggctcaacgtaagcaagatgctagtcaaatgttggctaatgctaataaaatacaagttgtgacggcagccgaagctgaagctgagaaagatcgcttgcatggtgttgggattgccgaacaacgtaaagcaatcgttgatggtttagctcaacaaattactgaaatcaaaaaacttggtgtggcacttgatgaagaacaaattatggcgattttgctgaccaaccaatatttggatactttgaaccaatttgctgcgggtggaaactcaaccatcttccttcctagtggagctgaaggagcagaaagcttgcgaacccagattttatcagcaataaaagcaggaaaataaaaagaaaaaagaaagttatcaagagatagctttttttattttgctgagtttcttcttgcaattttttttgaaattaggtagaataaaggggttatagcgtccgtagtgtaatggatatcacgcgagattccgattcttgcaatgggggttcgattccctccggacgcatttaatcatacaaataaaccgctctgttgagcggttttcttgtttttgtgccaaatgacttgaaatagtataaatttggattatttttctgttaatgagtgacgacgaccagaagaaatagcttgactttcagtcatggtaaaaatctcagattgattaactggatgaccgtgtttattaccataatcaattagggcagtaagactatatcaatagactttcgaatctttaccagctacataaacagttcttcctacaggaggagttacagtacttccaccagcttgaactttccaagctactgctccaaatttccatcctccattaagtaaactgttttgttcaaatgaattagttgtatagttgtgtgaaccagaacctgcatttggattataggcaacatagagattgacatttccaccagagtagaatgcggcatttccgccattatcgcaacgccatccgctcttgactaaactttgagcttcatatttactcatagtatagtagtgatctccgcccactgaatttggattgtaaactcgataaactggagttcctgatgttgcagctatccaaccagttccttcatcgttccagccagaatttttcaggctattttttcaaaagcacttttagtataaaaatgctctccagtatttttattatagagtcgataaacaggtacagtagatgctgcagaagcgctagtttcggaaattattccgcttacgcttaatgacaaaagcactccgagggcaattgaaatttttttcataaattttctcctacctagcttttaacgagtatcaaggtttgctcgtaggggttcttttatgttgcttctaataatttcataaattcttttactttcgtatcataaaaataaaggcctaaatggtgagaagataaaattgataaatatttacactatcaattacactaatataattaagaatagagtcatgcatcatagattactgaggttagagtttatttcatcttgtttataaatggtataagctaattcaaaaggagcttacgttgcattcataaagagcttcaaatatttgtagtttcctttattctttcaaatatttgccgaagagagaaatgactgctttgaagatgatttaattcatgagaaagtctaaaaggggatgctgaaagtagtttaaaacccttcctgctatagtttatttccttacttatcttccaaacgttttccgagaataagcttcatagctatctttacatcgtcacttagaggttttccttcgaataatacccatttatcccaatccactttgctgtcatcaactaattgtgctagatcaattggttcgtttataatttctaatccttcacgtcctaataaaaaatcaacagtaacatgaaaataatcagctacttttgccaagtcatcagctttaggttttgttttcttccatccataaattgcgttttcacttaatccaatatcaagagcaactgtttttatattttttccttgcttatcagcaaggccttttattctatcgaatagagtcatggtgagctttctaaaaataatttcaacttaagtattatgtttaatacttaacccgcaataaaaagtatgaattcttgttaaatgttactttttatgttaagtcaaaaagagttaatgtaaatgatttgaaaataggtatccttttattaaaaggtttattctgtactaattagattactttaattgtacgaaatctaatattttttgtcaatgctattgatgaaatagtagttatatttcttatattttttaatcaatggtgaacttctataataaaattttagagttacctgtcatttttaatttttcgtaaattttagataagtacaatccaaccaaccagattcaccactgcgttcaactagaaaactactttctgtaacctttccaattgctagacccattttttgccactgagcaaaatgctctgaaatagaaatggttcctttttgtcttggactttgtctaatcgcaaaatattgagtaaaagtttgatttccgtcaatagagggctggtcttctctaacatttttgatgacttgataagtcgctccgtcaagttgatatgtcccaagcacattaccttgcgttgtagcggttgtaatcggagttttttcagattgttcaccattaccaaaccaatcatcaacaatataatactcgacaagcttttcattagggtcagtcgcagtttcattacgaatccagccgtaaattcctatatagttataatttcctgctgttccttctcctgattttttataactaaactgacaagaaatatttccaatatttttaatgtcttctccagcattcgtccaactatagccaacacgtgctaaaaaatcatccgaatctgaccaagtcgccttaaaagctgcaccacctctttgtgatgccccataccaagaaagcgtatgtttcacccctccttgataccataaagtatagtcataggggcttttgcctaatgtttgcggaccgttactttgtgcttgaaaagtttgcaccgttggatttttttcatttttatctagtaattttttatttttacaagcttgcaagcctaatagagcaaagatgattagacttattagagtgagttttttagttcctcttctcattgtttttcctcaaactttacggattttgtaaagctatttcataacaacaaaaaaataagttatctcgcaagtttgataaaacctcacgagataactttatcaaagtttaaacaagatagtcattcaatactgatttgatatattctaagtggttagaatcaagttcgatgtcatccccatgctcaagagcataagcagcaagactttcaaaagttgctgttccattttcgatagattgaccaacttctgtcttcttgtatgaactataacgttcttcaacgatatcagacaagaatttgtcttcaatgatggctgctgcacctttaagcgcacgtgcataagtatccatccctgcaatatgagccaaaatcaaatcttcggctttgaagcttgtacgacgaactttggcatcaaagttaattccacctttaccaagtccaccgttcaaaagaatttggtgcatagcaagcgtgatatcaatgacaagtgttggaaattcatcagtatcccagccgagcaaataatttccttgattggcatcgattgaacctaaggcaccaaaagtacgtgcagtatttaattcgtgttcaaaagtatgaccagccaaccaagcatggtttgtttcaagattgagtttgaaatatttgtccaaatcatatttttgcaagaaagcaagagctgtcgctgcatcaaagtcgtattggtgagtcattggttcttttggttttggttcaatcaagaagattggcaaatggttaattgattttgcataatcaatcgccaaatggaagaattttgccatgtgatccatttcaagacccatgtctgtgttcaaaagtgattcgtaaccttcacgaccaccccagaatacgtagttttcaccaccaagttttttagaaagttcaagtccttttttgacttgagcagcaccataagcaaaaacttcagcacgatttgatgtcgaaaccccattcatataacgtgggtttgagaacatatttgccgtattccagaggagtttaatgcctgtttctgtttctttttgtttttcaagaagatggtcagtaatttcatctaagtttgcataaaattctttcaaagaatttcctttaggcgcgatgtcaatatcatggaaacaataatatttaacacccaatttttcggcaatttcaaagaaagcatctactcgacgatgagcacggtcaagttcagagccaccttccaagtcccaaggacgttccattgtggcactaccaaatgggtcagccccgtccatcgtaattgtatgccaaaaagcaagggcgaaatgaagctgttcttccattgttttcccagcaaccacttcttctgggttataatggcggaaggcaaacatgtttttagtttttgtaccttcatatttgataggtgcgatgtcgttaaagtaagccatttttatagctcctcctctttatgatattaatattattttcaaactcgaaattactactatacatttgttgtaatgtatgtcataataatagtgattaggagagaatgaacatgaaaaatgaattagagaatatttatcactcaaaaataaataattttaattttttacttgttgatattacttaccgtaaacctcatcttcattttgacattgaattagcatttgtcttagaagggctcggtactgtaaccactcaagaaaatttctttgaaatcactgctggacaagctattatttttaatagttgtcaggttcatgagctttcatcaagtgactctatgaaactgttaattctgcaattttcatcagaaatttttaaaattatcttccctcaacttgataaaatttattttgaaagtcaccctttcaatctagaaaatcaacctgaaaccttgaaattactcttgcaagcagccttaagttattttgcagatgataagaataattctttacgaactcacggctatacttcacttttactagaccgtttgttaagtatttctgagtacagtattttaagcagctctgaacaaaataaattgatggacctgcaagagcgaatggagcggatttcttcctacattcatgagaactacgaccacaaaatttctctggaaatgattgcctcacatgaaggattgtcccgaacttatttttctcatttctttaaaagtaattttgggataaattttaacgaatatttaaataaaatccgttcagaaaaagcaagaacactcctttcttctttcaaagataatttactaaacatcgcttatatgtgtggcttttcggatatccgaacgctcaatactgcttttgtcaaatcctatggcgttttgccaaaagattttcggaaaaacaatgttctcttccccaatctgaactatatgactttcaatcaagataaaattgataatcaagttttttattctgataggggttctcttgatattttgcaatactatctcgaaaaacaattttgaaaaacaattaattttagctcaatgttttcacttgttaatgataccgctttccaaagagtttatcttacttatttgttcttttttttaggggaaatgttgtcattttaccctatccaaagtaaataaaaaaatacttgatattaatcaagtattttttaatcccaaatttttgtggctttaatttcattaattgttttgtcaaaatcattcgttaagatagtcacatgtcccatctttcggttatgtttagcatcaggctttccgtaatcatgttgatgccaatccgcatgattatgattgagcaccttaatggcttccacatgttgtcctaaaacatttaacataatagcagcatttaagagtttgggttccggtaaatcttctcctaaaattcctttgatatgcaagtcaaattgattgaaatcacaggcttcaatggtaaaatgaccactattatgcggtcttggcgcaagttcattgacatagatttgaccgtcagctgttaaaaacatctcaacacaaagcgttccagaaagtttcaatttctctgcaattgatttcgcaattttattagcttcgtcagtgattttgtcagtcacacgagctggtgaaatcgtctgatgtaaaatattttcgcggtgctcattttcggccaaaggaaaagtaacatactcatgaccatttccactaataatgactgaaatttcacggtcaaaggaaataaaatcttctaaaacacattcggaaatttctgtcagtgattgagcagctgacaagtctttgtccgtctttaaaactacttgtccatgtccatcataacctcccgtcgtcgtcttcaaaacttgttttttagtgacgacttgcggaagtttttcttttgaatcaatcaattgccatggagcaactttgacttttgcttcatttgtcaaaaattctttttcaaagcgtcggttttgtgtaatctctagcaaacgaattccttgaggaatcttgacgcaagcttcaatctcatgtagtgcttctgctgaaacattttcaaactcataagtaataacatcgcaagcataggcaagtcgcaataaattttctacatcatcataaggagcaacaatgagttcatcagatacttttgccgctgagcaatttggattagggtccagagtaatcaccttatgccccatatattgagcggcaattgccatcatctgtccaagctgacctccaccaatgattccaatcgtttgctttgtattctttatcacaagttttcctacccttcatttttagaaatctaaccgcttttgtatttttattaaatcatttcaattcattgtttgattgctcaaccatttcttgagcggctgcccgatagttcactaatttattgtataaatcatcatcattatttgccaaaagttgcaaggcaaataatgccgcattttttgccccagcctctccaattgccattgtcgctacaggaacgcctgctggcatttgaacaattgaataaagagagtcaagaccggataaagcccgtgatttgattggcacaccaatcactggaacaagcgtctgagcagcaaccattcctggtaagtgtgcagctccaccagcgccagcaatgataaccttacagccttgttcatgggcctgattggaaaattcagccattaaagccggtgtccgatgagctgagacaacttttttctcataagctaacccaaaatcatctaaaatcttcgctgtttctttcattgtggcccagtctgaacttgaacccatgataattgcaacttctgtcattttattttctccaaatatcttaaaatttctttttcatttaaatgaatatctgcaaaatctaatgcttgattacttccaactgcaattgagagctctgcatggcgaagtaattggatattattatcatcatttccaaaagaaatatattcttctttaggaaaatactgacgcaatgtggtgtatttatttactcctttagcggttaaatcaatacttttcgcttcttcagcctaacaatttcaagatttagttttttcaattcatgcaagattatttctgattgagggttgagtaggttgcatttgattgctctgtcaatttctgatagagaaacatttttggctaagtgacactggtcaatcttgtcattaatttgcgctctttcttcatccctatttaagagcgcatagttccaatcagaatcaactagatagtccaaatcttggtcagtaattattttttttattaacaaaaaatcatgcgctgaaataggttgtacaatctcaatttgttgctgcttatttctggcaattgagccatttccacctatcaacagctcttttggaaaggctgataaaagtggtaacatatctcgaatgggtctagccgaagcaaaaatcagttgattttttaatgatagttctgtcagagattctaaaagttctaaggaaatgcttttgccgtcaaaagatattgtaccatcaaggtcaaaaacaaaaatcatgtcagctccatttctaaactacttttcaagagtaaaaattctatcagcaatctttcaaaactttgattaagttatttaacggcttttgaaccaatgtcatgccgataaaagagcccttgattatctaatttatcaagtttatcatagagtgatttctgcgtacttgcgatatcttttccactttcagaaagaagatatacacgtccaccactacttacaagttgattggcttcattctctgttacacctgcataatagacattcagctctttaggaatatcaggaagaatgcttcctgtttttgcttgagctggataaccctctgaggcaacaactactcccaaagttacgcctgtttcaagccattctaatgttggcacatctccagctaaaatatcaatgattgcctgtgccaaatcacttttaagcctaggcagaacaacttgggtttcaggatcaccaaaccttgcattaaattcgattgtcttgaccccatctgctgtcaaaatcaatccagcataaagaacaccagtaaacgaatttccctcgttaatcaatcccgcaaccgtgggtttcacaactttttctaaagcttcatttatcacttctttaggaaggtgagggactggggagtaggcccccataccacctgtatttggtcctttatcaccatcaaaagcacgtttatggtcttgagcaataggcattggataaatctttccttgatgaacaaaactaaataaagaaaactcctccccatcaagaaactcttcaatcacaactttcccttggcttccagaaaatatatctgctaatgccgctctcgcacttgcaatatcaaaagcaactgttactccttttccggccgctaatccatctgctttaatcacaatgggaaccccatgttgtttaagatgtgagagcgctggttctaaagaatcaaaagttgcataatctgccgtaggaacaccatattttttcatgattgactttgcaaaatctttagagccttcaagttcggcagctttttttcttggtccaaagataattagatttttctcttcaaaagcatcgactacaccattcataagcgctgtttctggtccgacaaaacttaagtcaatgttctctttttgagcaaattcaaccaattcatcatttgaaagttcggaaataccaactatttgaattccatcttttttcattcctgagttgcctggagcaacaaatactttttcaacttgagggctttccataaatttttttgccagagcatgttcacggccacctgagccaattaccaaaattttcatcatttctccgatattttcgattcttccaaattcttgtgattgcagttaatacagcaattcatttaaatattttattgttttttcacttctctatttgctctttctaaattgttaaagcagcaagttgagaccctttttttaacgaagagttatcgtcctcgttttgttcagtcataaatcttatatttctatcttaaaagaattactagaaaagaaaaagcctgagcaaaaatttcataaaataataggctagattgttcggaatttacttggatttcaattctcgtttttttaaaatttatagattaccttttatttattttttcttcctatcgcatttttctttaaaaacatgtaaaataaatttaagtagaaatagaaagtagaatatcatggcgacccaaccaacaaaagacaaaattattagcagtagctgggaacttctacaagagcttccactcacagaattttcaatgcgcaaattagctagtcggctaggaatgaccgtctcttctctttactatcatttttcaagtaaagaggcactttttgctgaactgattgataaagccacccttgaaatcatttttccagcaaacgaaaaaacttggcaaaatcgcctttttgtttatggaaaaaatatttatgctgttttagaatcttatccaaatcttgctcaattgatgatggattatccaccagaatccgaaaattatctacgactttttgacaaacttttgatgattgtagatgatcttaatctcactgatgaccgtaaattttataccgttaacctttatctaaattttatctacagcagtaaaatagatagtgatcgcttagtagaacaacccgaaaaacctctttcgactgtcaaaattcctcttattcaacttgctccttttctcgataaatattggcagacagaaagtcttaccagcttaagttcgtctgaaagttttgaatttggactagaacttatcatttcgggcatcgaaaaaatggttcaaactgattaattcataaaaaacttctaaaaggaagtttttttcttgactttattttagaacaacggtattatttttaccgaacagtgttctaaaacaaaaaaagaaggttcttaagaataatacaagtgattttaatttaaaaaaagtcttacccgcagttttaacaattgcgattgagatacttttagttatgatggataccaccatcatgaatgtgacacttccacatatccaaactgcttttcatcaaaatttatctaatagtcagtgggtcattaccgcttatactctggctatggcaacggctatcccttttgcaggttttctgggggaccgcttttcagataaacgcattttcgctctggcaatcatttttttcaccattgcttcactcttggcagcaaatgcgcattctcttcagagtttaattatttggcgaattgcccaaggcttgactggtggcgtcgttgctccaataggaattgggatgtcctttaaagttattccaatggaaaaaagaggctctatgatgggaattttgggcttacccatgctacttgcaccgacaattggtccagcactttctggttttttggtaaaagattttaattggtcaactgtttttttgattaatcttcctgtaggaatattggctcttattttcatcctcttatttcttcctaattttccagcaaataaagcaagtaaaattgatttaaaaggcgctcttctttctccctttgcttttccgattttaatttatggtgtgcatattggtgcagataaaggctggtcaaacccaagcgctatcgcttttatgtccgttggtttactgatgctccttttgtttatccttgttgaattacgtgtcgaaaacccacttttacatttgtgagctttcacgattcctgaatttacaaaaggtatttcactcatgtggctcaatcaaattgttgtgtttggagccatgcttctggttcctctctactttcaaaatattgtgggactttcctctgttaataccggattaatgatggttccacaggcgattgcaagctttttaggaatgacaattggtggtcgagtttttgataaatttggtacgaaagccgcggttcttcctggctttacacttggcggaatcagactcatcttattcgcgcaaattagtccgcactcttcattgacttttacgctttgtgcgattgttttacttggtttaagccaaggtctggtcaatatgcaagtcaacaatcacgcactacaagccgttccaatgaaaaatattagccgagtgacacctttaaccaatgaaatgatgcaagtggtcaactcatttgcaattgcctttctgacagcatttttaagtagtcaaatcaaaaatcaaagtagtctttctccattacaagctaatttaacagccttccatcatactttctggcttcttcttatcttcgtatccgtaggatttatctcaagtctttttttaagaaaaaaagtaaaagtataaataaaaaaaacacttttaaacaaacagtgtttttttattaccaatttttaaccaatgatggaatttctagtaaatcttgaatttgtacatctggttgtgcttcgccagtcacttccaattgtttggggttgtaccagattgttttaattccagctctattcccacctaaaatgtcggttgctagagaatcaccaacaattgtaaattcctttttgttcgctgcttcaatgtggtcaaaaacgtaatcaaagaaggcaagagaaggtttgtgatgaccaacttcttcgctgataaagatttctcgaaaatggtcagaaattccagattcaaatattcgtgggcgtgaaacacgtgaagttccattgctgaccacatacatttctgcttcttttgctgacagttctgtcagtaactcatttgcgtgattgattagctcgtgaccttgtgataagtaaagttggtattcatcatcaaccgctactggattatagtttactgacacatttaaagctcgaaaagcatggtcaaatcgcgtgctcaacaattcttctcgagaaagcttttccgattcatgtaggcgccacaaggctttattttcgcgtgaataagtcgctcggttttcttgattatcttcaatttgataatgggcaaaaattttccccaaagcatcatattctgctttatcaaaatcaagtagagtgttatcgatatcaaaaagtagtacagtcatttctatttcctttgctaaatgtattctttgcattccttacattatagcagaaaaaagtatcgaaaattattttttagattgtagatgacaaaaaatctaccctaaggcagatttttaattaatgtctaaaatggcggagtccagtaaagaccatcgcaataccatatttatcacaagcttcaatcacttcttggtcacgaacagagccacccggttgaacgattgctttaattcccgctttggcaatttcatcaatattgtccgcaaatgggaaaaaggcatctgagccaagtacggcattttcttgaagaagggcgtccttatcagctgtcgcttccaaggcaatttttaccgagccgacacgattagtttgcccagggccaacgccaagcgtttggtggtcatttgttacaatgattccatttgatttgacaaattttactgctttccaagcaaacttcatggcttccatttgtctgtcagttggttgaactttagtcgccactgtccattctttcggattttcaacaatgacatcttgattttgaacaagaagtccaccaagtacccctgttacaagcgcttctttttctgattgctcttttttagaaaaatcaacggttaaaagacgaatatttttctttttactcaaaatttctaaagcctctttactatatgatggagcaataataatctcaaggaaaatcttgctcattttttgagccgtttcctcagtgacttctctatttaaaacgataatcccaccaaaaatcgaaacagggtccgcttcataagcataatcccaagcttgttcaatatttttagctgttccaatcccacaagggttcatatgtttgagggccacaacggttggctcatcaaaatcccttgcaatttgcaaagctgcatcagcatcacgaacattgttataacttaattctttaccatgaagttgatgactttgcgcaatagagtaagttgttggtaatcctgattcataaaaatcagcactttgttgtggattttcaccataacgcatcccttgtttaaggtcataagtcaaggttaatttttcgggttttgtatcttctactggaaattcttctgtcaaatattgcgcaatgagggcatcataacttgcagtatgacgaaaaacttttgctgcaagttgctgacgaagttctaaacttgtttccccgtctgctgaaagctctttttctactttttcataatccatcgggtcacagacaactgtgactgccgcatggtttttagctgccgaacgtaacatcgacggcccaccaatatcaattttttcaatcatttctgcttggctaccaccagcaagcaaggtttctttgaaaggatataaatttacaacaactaagtcaatcggagaaatatgatgttcagccattgatttcatgtgactgtccaaatctctacgtccaaggagtgcaccatgaatcagcggatgtaatgttttaactcgaccatccatcatttctggaaagccagttacttcatcaattgcaatattcggaatttcctcttgttccagaactgcttttgttccgcctgttgagataatttcccaacctaactcctgaattttctttgcaaattctacaataccttctttgtctgaaacactgataagtgcacgttttgacatgatttcctccaagttttctacttaccgttctgtaagtcaatatttttctgctaaaagtactgataagtctgtcagtaactatttatcatgtctttattttacatttatcgtttggaaataaaaagcgctagtttaacaactaggctttttttaattttattgttcggaaataaccttcactctttaatcaaaaattcttcattgaaaactccaatataaggcaattgacgataacgctctgcataatcaattccataacctacgataaaagcatctggtacttcaaaaccgacataatcagcgtcaatatctactttacgaccacttggtttgtctaacaaagagatgatttttacagatttggcttgacgtcctgtcagtaattttttaagataaagcaaagtatttccagtatcgataatatcttcaacaatcaaaatatcacgtccatgagccacggttgataaatctttcaaaattcgaacttcaccagatgatgagattccgtatccataactggtgacgtccataaaatcaacttcagcatcaattgataattccttgagcaagtcaactgtaaacatgattgaccctttcaaaatcccgacaacgagaggattctttccctcataatctcgtgaaacaacttcagcaagctctttgacacgttcagcaatttgttctcttgtaaataagacttcttttaaatgtggatgcatttttctccccaattttttcacaatatgcttccattttagactttttttcagagaatcaaaagggtaaaggcagagatttggtcttttttagcttacaacgttcggaaatagtaaaatttataattcatattttcttaatcaactttaatcatagccaaatctaacatcgtttgcgctgtttgaataatggctgctcctcccgaacggggttgccaacctaaaagtcttgttgatttctcatttgaacatgccgtattttgccccaaaaatgtggctggcatcgccaaacttttatcaaaacgtgccaagatcttcactaaaaagtctggaataacttgagtagaaactttcttggcttttgaaccaaattcttttttcaaaaattttgcttgttcctgataagtaatattttgccctgaagtcgcgataaaacgctgactaatggcttcttctttttcaagagctaacaaatgtaaatcagcaacatcacgaacatcaacatagtcaaatgccaaatttaaaagtctaggcatttttccttcaaacatatttttaattgccgcgctagaatgtgaaaaatcattcccaagaatcggtcccatgacagccgtaggtagaactgaggatccttccataccataagatttggcaagtttccaaaactccagttcagccatatgctgaggtcaaaaccactcgtttaactcctgcttccttggctgctctcatcacaaacttcactccatctacagccattattaccattaaatcatcagcgtcaggacgttgcaagggtgttggagaagcgacgtggatgacagaatccactccagtcattgcttgactccatccttcttctttagttaaatccgtttgaacaaagtctaggtcagtaaaatcagcaatccctccttgcttcatcattttcttcacttcttcttgtctagacatcatccgcaaggtcgcccgtactcgatagccttttttaataaagcaatcatgatgaacatagcaatataacccgaaccaccagttactagtattaattttttatttgtatttgtcattttttctctcctttttctctctcaacaacatccgttacacttgaaactcatgtggaattattgtacgatagaagtagtaaaaatacaagcttaaaatccgcttgtgtgacagcctaaggagatgtgtaatggcagcgaactattcccaaaccatcaaaaatgatacaaaagattttattactacagttattctacagcttttgggcattcaaaaaacatctgaaaagccaaaaactcttgctcaactgaccgtttcaaacgtttgtcagcgggccggagtcagtcgaatggcattttatcgtaattttgattcaatcaatcaagtcatctatcaatactatcaaccacgaatttccgaaagctttgaaatcattcgccagaatgtgtcggcaacaataaaaattgagaaccaattaaaattttttgaagacttcaaaaatgacttctacctttctgaaagtcaaggctatgagcccatcattcgtcagatttatattgaagaaattgaaaaattttacgaagaaacaaatgacgaatatttcattacttttgtggcaactggagtttatgctgtttggcgaaaatggttaatgaatggtcaagataaaccaattgaagaaattcatgaactcatcagaaaaattgtcacgatttaagtaataaaaaaagacacaaaaggtgtctttttttgatataaaatttatagtctaagcaattccctgacctaaatgaatgacttcatccaaataattttgagtttcatcatacaaatggtgagtaatcataatcacagtcaaatcgggattttctaaaatatttttttctacagccagagccgttttcttatcaacactggcagtgctttcatccatcactaaaatcggttttgtccccattaattcccgcgcaacagataatctttcttgctgacctcctgataaatttttatcataaatcgtatcaagtttattaaacacaaaatcatcagcacaggcaattctaatcgacttatcaaaaatatctggcgaaatcttacgacccaaagtcaaattttcctctaccgtttccctaaaaagataagggaattgcataattacgctcatgacatgtggtaaagattttcggttaattcccttataatcttttccatcaagtaaaatttctccttcataatctcgcttattgccgactagcaaattaattaaggttgatttaccactaccactatccccgataatcgcatatttcttcccctttttcaatgacaatttctggatattcaattttttggccatcaggaaaagcgacagacagattttttaactccagtttactttcaaagtctgtcacttcttctccgtcagtaacttttgattcgtcagcaatttttccatatttttctagcaatttcccagtagcattgagcaaaatcaagctatttgctacactttttgagtaattagtaactgttcctgacagattccccacgctcatgacaacaccgattccaatctgaccattcatgatgagaaaaccagcaacagctaaaatcaaaaattgtcccaacatattggcccctaataaagaatattgcatccaagcccgagtaaaaattaattttacatttgccgtagccaattgattaaatttacccatggttcgctcttgcatcagccccagttgtttattgtgatagagcacttcatagccacgtaagtaatctgtagatttcgctaaagcatcattagcaacatctgaaacctgttctgtgtctcgttccactgatttcttaaagacttttggaaaatagaacaaaatggctccaactagaagtgttgtcaaaagcaatacccagtggaaaaagatgattgcaattcctgagaatagcatcgcaacgattcccgtataaacaaaataaatctgatggaaaccattatcataaagtagttttgtatcattatttaaccaggaattataatcttctttactgtttttttcaaaatcagaataagaaatttccgtcagaggttcaatgatatcccggcgtacagcattaagctgcttttgtatggcaatttctttccaaacatcacgcgccctgaacaaaactatcgaccacccagaggacaatgtcaatagctaaccataagaaaaattgattcatttctctagcaatcaaagaattgagtacattggccaaaaagaccgaactcaagaccgcaagagcaatgtcaatcgtgataagtaagaaaaccataaaattttcaaatttgaattctttaagatactttaccatttttccttctcttattttacttaagattatgttaccactacattgtagcatttaaatttcaaaagtaaatagcgattacaaaagttttttagatgttttattttcttaaaagaactgaaaattttctcttatttttatcttttttaatccctcatttctcatttattaatggccaaataaaaaaacttcatcattgctgatgaagaattatttgacgaacaacttttggatagagctcatgttccgcttcatgaactctctcttcataaacttccaaactttcgtgataagccacagggatttgcgcgataatttcgccagtatccacgccctcatcaacataatgaattgtaattcctagaccatattttgcttcatgtgactcctcaatcgcatgaggagagccagcaaaatcaggcagaaaagaaggatgcacattgataatctttcctttatatcttgccaacatcgtcgaaccgatgattttcatataaccagccaagagaattaaatcaatttcttgtgcttctaaaatttccaccaaagctttctcatagtcaacttttgaagtaaactcttttaactccaaacttgcatttgctacccctaatttatcagcacgttcaagtacataagcatcatgatgatctgaaaaaacaaacttcactaccttaggaaattgttcagctagtctttgaaagttagagccatttcctgatgcaaatactgcaattttcattctatcccctattcttaatgaaaaaagattattttttaataactactggtgcctcttgtcgattaaccatttgaccaatctcgaaagcattcaactcttttttgagagcagcagcattttcaggagcaacagcgataaccattccaatccccatattgaaaatttcatacatttcttcgtgcttgatacttccatatttttcaagagccttgaaaattggtaaaacatcccaagaaccttcgacaatttcagctgacaagctatttccaaacattcttggcaaattttcatggaatcctccacccgtaatatgagcaattccttttattttattttgcttaatcaaaggcaagagctctttgacatagattttagtcggagttaaaagagtatcaatcaaagattggtcaagttcaggcaatgattcattcaaatcaaagtcagcaaaaactttccgaaccaaagagtatccattagaatgaatcccagatgatgcaagaccaagcaaaacatcgcctgcttccacatctttttcaccatcaattaattgtgatttttcagccacacccacagcaaaaccagctaaatcataatcatcttcatcatacattccgggcatttcagctgtttctccaccaatcagagctgctcctgcttgcaagcaaccttcggccactccagccacaacttgctccaatttttcaggaatatttttccctgtcgcaatataatccaaaaaatacaacggctcagccccagcagcaataatgtcattgacacacatggctacgcaatcaatcccaatcgtatcatgcttgtctgctcgaatggccagcatcaacttggtccctacaccatctgtccctgaaatcaatacaggttctttgacatcaagcacagataagtcaaaacttccaccaaaaccacccagtgccccaagcacccctaaacgttcggttttagcaacgtgcttcttaatacgagaaaccacctcatatcctgcttctacatctaccccagattttgcatacgcattctcagacactgtcattctccattttctgatttattttattctacttccatgttaaatgattttcaaacataaaaaaagttccagcaggtagaactgaaactttttgattggattgttcggaaataaggattttgtttatttaaatattcacatatctacataaaaaaaccgccagcatcagccaacggtttaatctatttattcagcaatcgattgaatatcaaagtcaaccttgttatctataagccttacaataacttttgattttggtggaatttttcctccgataatcagcttagctaatggattttcgatgacttttgtcaagtaacgtttgagtgggcgtgcaccataagcaggttcataagcattttcagcaatccaaacttttacttcttcactcaattcaagctcaacttccatttcttcaagacgatgtgctagttgactggtcattttaaggataatgttcttgatgtcttcaagcgccaatggtttgaaaagaatggtatcatcaatccggtttaaaaattctggtttgaaatgcgcgcgaagttgcgacatcacattttctgttgtttcttcagaaatttcaccattttctccaacattatcgagcagatactgagaaccgacatttgaagtcataatcaatactgtattcttaaagtcgacgagaacacctttagagtcggtcaaacgtccgtcatctaaaacttgcaacaagatattgaagacatctggatgtgctttttcgatttcatcaagcaagatgatggtataaggattacggcgaacggcttcggtcaattggcctccttcatcgtaaccgacatatcctggaggagctccgactaaacgtgacacgctgtgtttttccatatattcactcatgtcaatccgaaccatatgttcttctgaatcaaagagattttcagccaatgctttcgcaagttcggtcttacctaccccagttggtccaaggaagaggaatgagccaagtggacggttagggtcttgaattcctgcacgcgcacgaataatggcatcagatacggcttcaacagcttcatcttgtccgacaactctttgatgaagtgtttctggcaaatgaagtaatttttcacgttcaccttcaaccaatttggtaattggaataccagtcatccgtccaaccacttcggcgatttgttcttcagtgactgattcttgaactaaagataaatcatctgattttgctttttcttcaatggctttgagttctttttcaatttcaggaattttaccataacgaagggctgctgctttttctaagtttccttcattttgggcttcttccaattcgtggcgagcatgttctaattcattacgtttttcagaaatattgcccacttcttttttctcagcttcccattgggctttgagttgattattttcttctcgaagttcagaaatttcaccacgtataatttcaagacgtttcttagaagcatcatcccgttcttttttgagggctgcttcttcaatttctaattgcatcaagcgacgattggcttggtcaagttcagttgggagtgaattcatttccacccgaatcgttgcactggcttcatcaattaagtcgatcgctttatctggtaaaaaacggtctgtaatataacgatttgacaatgtggctgctgcaactaaagcattatcatgaatggtcaccccatggtgaatttcaaaacgttcttttagaccacgcaagattgaaatcgtatcttcaacagtaggctcagtgaccaatactttttggaaacgacgttcaagtgctttatctgtttccatgtatttacgatattcatccaaggtcgttgccccaatcaaatggagttcaccacgtgcaagcattggtttcaaaaggttaccagcgtccattgaaccttctgttttacctgcaccaacaatggtatgaagttcatcaatgaaaaggataatttgtccatcagcttttttaacttcattaaggactgctttcaaacgttcttcaaattcaccacgatatttcgctcctgcaatcaaggcacccatatccagtgaaaagattgttttatcttttagattttcaggaacgtcttttctgacaatcctttgtgccaatccttcgacaatggctgttttaccaaccccaggttcaccaataagaacgggattattttttgttttacgagaaagcactcgaatgacatcacgaatttcttcatcacgtccaatgacgggatcttgattgcctgatttaacttgagcaacgagatccaccccatatttttcaagtgctttgtatgtttcttctgcattttgactggtcactttatcacctccacgtaatttttcaatcgcagcttgcgcttttgcttttgttagtccatggctgaccaaatactcggtcaatggattttgttttaattcaaagagggcaaggagaataatctcagttgataggtattcatcgcccattttttgcgcaattttgtctgcttcagtaaatacttggaacaaatctggacttaggttttgaccatatgtaatatttgaaccttctaccgaattaattttgtcaatttctttttcaattaaatttgtaaagtcatctaggtcaatccctaaatctttataaaagttcgccccaaaactattaggttgaacaaaaattcgccataaatgtggaacttcaatcacttggtgatgacgaacttgcgcaatttgttgcgctgaaccaagtgcttcttgcatcgttgttgtcattttttcgatgtccataaaaacacctcatttcgatttcatagttggtagtgattgttatctttttctcactacattctaattataatacattggtcagtaatggtcaagctttttgattcgttttttgacttttattatatacaaaaactactgacagaatttttgtcagtagttttaatatttataagtaaaataagttgttttaaggataaacaatgcttgcaacaaggcttccatcagggtttctgaaattatacttaattgataaattggaaatccccgcattttggaaaattgattgattttcagtaagtaaaggggttaattgttttttcaaatcttgaattttatcaggactgagtgaaccatgatttcgagaaaaagtaaaatcgacaacaagcacgttaccgctagcgctaacattcaccttgttaaatattcccccactttcattcacaatgtttgaacttgctgtattcagtgcatcagcaatttcctgcaaagaattatttgaaggatttactgacaaactgacagcattccaagcgactgctttatatttccaaccaatattaattaagttattttcttcaaataaatttcccgtgtaattatgagctccagattgagcattggggttgtaagcaacatatatcggcaaatttccgcctgaataaaaaactgcttttccttgattatcccacttccagcctttatttactaaagactgcgcttcatacttacttttagtgtagtaatggtctccacccgcagcattggggttataaaggcgataaacggttatccctttatctggtgctacccaacccaatccttcatcagtccaaccagcactaatatcaaccgctcgctcagttgcactcgtagtataaaaatgctctccggtattatgattatagagacgatagaccatactatcggcactcactcgaaatcctactgcgagggtggttccaactattaataaagtcaataatatttttttcataatctactccctccttagaaagcgcttttattatgttcttttataaattttttgtcaatttaatttttttattttacaaaaaactggaagacgtcacttatttttttatataaaaaaagtgaagctgtctttttaatacattttgccctataatggacttagatgtcatatttaacaaagaaaagataggagaaaaatgactcaacaactaaattctttgggaaagtctgccctcttaatactaagtaatacgattattgttcttccattcatgatttttattcaaattgccaaaggaacctcacttcttgccctacttccttttctgctcttttatactttcagaatgaccggcatattctttataagaggaataaaaacaagaatcaacagctacagtcttttaaaaatttcattgtacgctggtttattgggttgcttacttggatttcttggttctttttactttcctttctatactttatccggtatttttctaggagtaagtgcagcttggttgccgatgtcaaacacttcagtaaactatgatctaaaaaatactaaccagcttatcaaagaaaagaccttaattagtttacttttgtttttagcccttggcttttcttttgtcttcccgccttctctaaaatatcccctgttctttgtcttctatggaatagtttatcttctctccttccaattagttggaaatttggacaattacaaagttgatccaaatgacttagaaaaagcctcctataaatatcttattttatttgctttattttttgtttgcctctttctattacgctcaagtcgattacttgccaatagtttagaatttgattatttcattttcggatttttttttttggtcaccctctatattgtcgctataaattttttcaaaaataaaatccaaagaaatatccctcgtaaattatcatatttgacagctattaatggggcagtgggaaattatttatttcttttttgttctttgtatgtcgctggcttttatggtcatcagcatttatttttacaattttatcttccttatgttttaggaattgtctttgcctctaaggtcaaaaatttacttggaaataatgtcaaaacctattctttaatcggaatttttctaggtttacttttgattgtttttagtcctctatttgctctaggtttattccttactagtttattcaaaggaagtttaaattcaagcttaactcaagactatgaaagtactattaatatcgttgaagataacggatctggataaaatataccattcaaaatatcggaagtattcttcaccaatttttgttaatgcttttaggttcacttatcatcatgaaaaatggcttatctatcaagactttgttcgttattacttcaactcccattcctactgctcgaagtattgaactaatgaaatcatggaatcttattgctacatcattgattatcttaattatcatcgcttatcttatttatccaaaaatagttccacttcttaaaaaatcaaaataaattagaaaaacccatgtctaagcatgagttttttatttaatacgagtggtcagtgagctttcttttccttcgataattttatgaatctctttagcaaattggcttcgcttaatcggacgatagctttttaagaaagaaaaaatcggaattttcacgagcggctccaataggcgtgctggaaaataactgctttttcgtgaagcatcatagacaattcctggaaaaacagaaacaaatcttgatttcaaacatttttgaccataagcttccactttttttttagctttcatatagtcatttataaaaaaaggaccatcatttgctgaaataaaaagacattgattttctgagttaactattgtatcaataattatttttgctggttgaatactatttttttcataagttgttccttttgatttactcggtaatagaattcctaccgcatcaatcacccaatctgatttctgtaaaagttcttgccaatcaccggtttcatttagattagcagcatggtaaatgactggctcaactagattatctttagatttaccatgtcttgataagctatgtaattcataatctgcaacttgggcaagttccttgaaaataccttgaccgaccagtccagttcctccaacaatcgtaataatcatttgcttacctcacttgcttttatttcttatcctaacatattaaggaaactaataaaaaataatcgctttatggatttgaccaaattaaaaactagagaaaatactctagtttttatttcagaccattttttgccaaagattccaaatagtctgcttcataatcataaagcggtgttggatattcgccgtcaaaatatgacaagcaaagtttatcgtgaccgatcgcctcgacaagccctgactggctgagataggtcagactatccgctccgatagcttctctgatttcatcagtcgtgtgtgtggctgcgatgagttcttcacgatcttggatgtcaatgccgtaaaagcaaggatatttgagagcgggactggcgattgccacatgaacctcggctgcgcctgcatctttgaggagtttgacaatgcgacggctggtcgttccacgcacaatgctgtcatcaaccatgatgacacgttttccttctacaacacctcgaacagcactcaatttcatgcgaacgccttgttcacgaagttcttgagtcggttgaatgaaagttcttgccacatattgatttttaatcagccccatttcgtaaggcaagcccgattcttcagcgtagcctgaagcggcactgagtgatgaattagggacaccaatgacaatatcagcgtcaattttggcttcttgggctaaaatttttcctgaacgttttctggcagtatgaacattaactccagcgatattgctgtcaggacgagcgaaatagatgtattccattgaacaaatagtcatgttggtgctgtcagtaaattggtccacatgaatgccgtcgtcattaatttcaatgatttcaccgggttgaacatcttgaatccaagtggcgccaacaacatcgaaagcacaagtttctgaggccacgacaaccgcaccgttgctcattttaccgattgaaagtggccgaaatccattagggtcaagagctgcgacaattgaattttcattcataataagataggcaaagccacctttgaccgtattaagtgcttctttgactctgcccataaattctggatgatgactacggcgaatcaagtgcatgaggatttctgtgtctgaattactagaaaatattgctccagatttttcaagttcacagcgcaaggattgagcgttagttaaatttccattgtgggcaagtccaagtgatccgtcatgaaattcaaactggaatggctgaatattattaatatttgccgagccagccgtcgcatagcggacatgaccaatggcagatgaacctgtcagttcttccaaatctttttcgtcacgaaaaacttcggtgaccaaacctaaaccacgatgacgattgagcttgccgttgttattgaccagaattcctgcgccttcttgcccgcgatgttgcaaagcgtgaagaccaaaataggttagacgagcggcatcaggatgtccccaaacgccgaaaagtccacattcttcatttaatgtcttcgcttcaaaccgcgaccagtcgcggagctcatcggcttcagtttgattcaaactttttttctcaaaatgcgaccactcttgttcagtaaatgttgcgcttgttatttcatcagacatggaagggctccttcataaatgctgacagcttcgtcagtagaaatagaaagttcattaattttcaaaattccgttgtcagtaacttttccgatgacttcgctactagcagaactttctgtcagtaatttttcaaaagcagcttgattttctggtgaaattgagagtacaaagcgaccttgcgtttctgagaataattgagcattgcttaaatcaacttctacatcaattcctaagccatttgcaaaagcagattcagctaaggcaatcgctagaccaccttctgacaaatcgtgcgctgaattgattaatccgtcagtaattgcttttaaaacaaagtcttgattgactttttcagtttctaaatcaaaatcaatcttgccagaaatttcgcctgtcagcattttttgaagttcagaacctgaaaaatcatcaaaagtttgcccgactaatacaatcaaatcacccgcttttttaaattcttgagtcgtaatattttttacatcctcaatcaaaccaaccattccaatcattggggtaggtaaaatagctgaaccgttcgtttcattgtaaagactgacatttcctgaaataacaggcgtatcaagagccaaacaagaacgtgaaattccatcagcggcagtcgtcaattcccagaattgttctggtttttccggatttccaaagttcaaacagtcggtaatcgcaagtggttttccaccagaggcgacaatattacgagccgcttcggcaaccgcaattgctccacctttttctgggtcaagatagagataacgagcattacagtccgttgtcatcgcaagtgctttgtttgtaccacgcactcttaaaactgcggcatctgaccctggtgcaacaacagtgttggtcatcacacgcgaatcataagtttcataaattgatttcttgctggcaattgtcggttgagccaaaagttttttgaaaatttcactgaccgcgctgtcagtaatttctggaagatatttctcgctgtcagtaaatttttgaatgcgctcaggaacttttgcctcacggtaataagtcggtgcatcttctgccaatgaatcaacaggaacatgagcaaccatttgccctttatgataaagtgtataaaagccatcatcagtcacttccccaatattcacagcatcaaggtcgtattttttaaataaatcaatgatttcttgttcatgtccttttttgacacaaagcaccatacgctcttgtgactcagacaacatcatttcataaggaatcatttctgtttcacgctgtggcacattatccaagttaagacgcaaacctgacccagcttttgaagccatttctgaagtcgatgaaactaagccagcggcacccatatcttgaattccaactaaaatatcgccatgattttggataacttcaatacaggcttcaagcaatagtttttccataaaagggtcgccaacttgaacggctgaacgttgtgtttctgagcccgaaccaaattctttggaagcaaaagatgccccatgaatgccgtcacgtcctgttttcgctccgacataaaaaatagaatttcccacacctttagcttgtcctttttggatatgtttatgctcaattaagcccacacacatgacattcactaaaggattaccagcgtatgattcatcaaaagccacttcgccaccaaccgttggaatgccaatacagtttccgtatcccgcaattccggctgtcacttggtcaacaatatgacgtgttttaccattgtcaattggtccaaaacgcaaactatccaaaattgcaattggacgagcccccattgaaaaaatatcacgaataataccaccagaacctgttgctgcaccttcataaggctcaacgtaagatggatgattatgagattcagctttgaaaacaaccgccaaaccatcaccaatatccacaaccccagccccttcaccaggtcccatcaagacttgcggcccagtcgtcggaaatttttttaagacaggttttgaatttttgtagcagcaatgttctgaccacatcacggcatacatcccagtttccgtaaagtttggcaagcgtccaccaagaatctcatccttgattttcaaatattcttcatccgtcagtccccactcacggtaaattttgctttcttgaatctgttctggtaacatctccaaagtcatgttcttctcctataagatgtgagcccgactgttttgaagtggtgaaaattaggaaaattgatggttctgcgctcgtgcagttttttaattttgtcaaatttcactcatttcaagggggcgaactcagttaatttcaaattacaaactcactgacagttctgtcagcaaattttacaagttttcagcttactgacaaagctgtcagcaaatttttcttaattttttacagtcactagaaaatttttcaacaaagaggcaaacatttttcttccgtcagctccaccaagcaattcttccatagcacgctcaggatgaggcatcatcccaagtacatttccttctttattgacaattccagcaatattttcaactgaaccattaggattttcatctgcataagtgaaaacgatttgaccattttctttaagttcagcaagcgttgcttcgtcagcaacatattggccttcgccgtgggcgatgggtaaattaatcaaagcatctttagcatattcagtcgtaaaattactttgattattttcaactttaaggacttgccatttggaaacaaatttcaaaccctcattgcgaatcaatacacctggtaaaagcccagattcaaccaaaatttgaaatccattacaagtgccaaaaacaggtttcccttctttagccaaacgtttgatttcaggcataatgttagcaaatgaagcaattgcaccacatcgcaaataatcgccataagaaaatccaccaggaatcaatactccatcaaatcctgcaagtgacttctcgtcatgccagacaaattctgcctctgcccccatgacatcacgaattgcccaaagtaaatcaaaatcgcaatttgaccctggaaattgaatgactgcaaatttcattttttgactccttcactttgttcagtcaaaatttcaactttgtaagtttccatatttggattcgccaacaattcattggcaatttcagtcgctttttctttagcaagctcagcttccgcatcaaaatcaaaatcgaaaaacttaccaacattcaagtctgaaacttcttgataacccattttatgggtggctgctttaattgcttgagcttgaggatcgagaattgaggctttgtaagccacgtaaacacgtacttttgtcatttttaaattctttctatataagatgtgagacctgccctaaagactagaacattcttattttgtcttttccaatagatttaaaacttcagtataagtttcaatcaaatctccaatattacgcctgaaaacgtctttatccatgtgttgccccttcgcgtcccaaagacgtgaagtatctggtgagatttcgtcagcaagaataatacttccatcagcaagacgaccaaattcaagtttgaaatcaaccaaagttaagccaatttcagtccatatttttttcaaaatcttattaattttacgtgtttgtttttttagaaactcaatttcagaatcacttgcaatgttcaggaatttgacatgttcatcattgataaatgggtcatctaaagcatcatctttataataaaattcaacaataggttcttccaaaacaattccttcttcaagaccaaatcgtttggcaaaagacccagcaacgacatttcgcaaaacaacttccaaaggaattattgatacttttttattcaattgttcggtttttgataactttttaataaaatgcgtttctaatccttcagcatttaatttttcaaaaatcaatgaagtaatttgattatttagagcacctttcccagtaatttgttctttacgagcaccatttaaagctgtcgcttgatcacaatattcaacccaaagcacattagaatcgtctgtaaaatacagttttttggcttttccttcataaagcagcgtttctttttccataatatcctccatccatttaaggaattctttatgcttcttattctattctaatgagacaaataaaaaaagctctagcggataaaactagaactttttcattttattgttcggttttgctgaatgttcggaaataactttttatttactgagattttcatattgttcatcagaaacttcttccaaccaaacagcttcccccgctgtaatggcgacatgactaaaccaactatccttagtcgctccatgccaatgtttaactcctgcatgagtgacaatcgtatctcccgcatgtaaaagttgagctgccttaccctcttcttggtaccaaccctcaccggctgtaaccaataaaacttgatagccatctttatgaatatgccaatgattacggcatccaggctcaaaagtcacatttcccacaccacagggcaagtccttatccgcaatcattccttctaaataagactgtcccgtaaaataggctccataaggatttttttcaccttgcgggaaaataagttcttcttctagttcttttttgttcattccattctctctttcttaatcaatctcttgatatcgagtcactttcaatcgaagctgatatttttttcttaactcagcaatttgagccatcatctcacttttatgatgaagatcaatagcttcttggttttcccactcatcaatcaataaaatcgcttgttcattatcaaagggagcaaaatactcataacgcaaatttccactttgctgacgaattttatcaacaagacctgagcttatcatttcatcagcaaaaagatgggccttattcccgtcaccttgatacaaaatgttgaccgttattgtcatagcttccctttcttatttccaaatcgttttagtaatattaaaagctgaccaagcctttggccatcccacataaaagctcagatgggtaattatttctgaaatttcttcttgactaattccattttcttttcccttagacatatgaaaatttaattgttcaaaatttccaccagtaatcaaagccgtaatcgtaatgacactacgttcatgtgctgaaagttctttttcactactccagacttctccaaaaagaatatcgtcatttaattcagcaaattttggggcaaattctccaagttgttcatgtcctgcggtttgtttttccattctagcctccacatctcttcaatatctaatttttttatctcgtacttcttccaagctcttccaaaaatttcagacgcatcactgtcggtctaaaatttttctcccaagcaggatcccagctatagcctgaacgttgtcgataagaatcaataaatttatcaatacttactttatctgtcactggctcaaattctacttgataagctttcccatcaatgtgaacttgccccttttttgaaatcatagccgaattccaccaacttgatgccgttccgcgacctgctgctaccgctaaatcatcatcaatataagcaaaccaaatccaagcaggacgatgttcttgtggatccgggctaatataaatatcttgtatcttagaaaacttttttacatcaatttccattttttctccttttatcttaccaaggttggcttgtaggtccaacagtaaactcgctgacgttaacatctgcaggttgttcaagtgcaaaggcaactattcgagcaatggcctctggactaataccatactgttcataaagcgcggccattcctttggctgcctctgtgtccgtaattgtattcagtaactcagtatttatagcagccggataaatagtagccgttcgaatgtttgtcccttcttgagcagattccattctaagcacttccattaattcacgaactgcccattttgttgccccataaacgccaccattagggtaggcttttagtccggcaaccgaactcgttgtaatcacatgcccagatttttgagcagtgaattcaggtaagacagcagcaagaccattaaggacccctttaaggttaatatcgaccatactctcccattcttcaacatggagcgctgacaaaggggaacttggcataattcctgcattcaagaaaatcgcatcaactttaccaaatttttctttggcatattgcaccaattttttactgtcttctggattagtcacatctgtcacttgataaatcgcttgaccaccagccttattaattttatcagccaactctttcaaacgactttctcgtcttgctgctaaaacaattttagcgccttttttagcaagcaattcggcagttgactgaccaataccacttgatgcccccgtgattaatactaccttgttttcaatattgtttgacattttttctccattcatttttaacttctattttcattatattccttgaagtccacttcaagtcaacttaaaagtctcacatcgtttcatcttttcgatgattttattataaaataattttttactgacgtgaaatgctttttatatcaataattatgctttttaagcatactatattaaattataaaaaagcttcgtataattacgaaactttcatcaaaatttattttatttttttattcaaaatcaaagtatagaaaacaaagttaagtaaagcaagacaaaggaaaaacataaatacatgttgagttccggttgttaaattacttgattttgttgcaatcagactggccgtcgccgtccctgctgatgccgcaaattgagaagtcgtagtaaaccaagcatttccagaagcggctttatcatgcgggagttgagctagactattggtcattgtcgttgcaaagcttgacgaacgtccgattgtgaatacaacataaagtcccatcacacccagtaaagttagatttttagtaaaaatcgttaacaatacaagtgcaatgaagaaaacagtgttcccgctatataagatacccttggccccttttcggtcataaagtgcaccgattggtccttgcgccgctgaaccaattaatgaaccaggtaataaagcaaaacctgccaaggtacttgtggcaccaagagaaacctgtaagaaattagggatgataaagttaatacccaaatttacaaattgtaaaatacaataaacaaggactgacaaagtaaaggttggactcttaaagacattgatatctataaaattcaaagaacttgtttttgaacgccaaataaaggcaattaatccaataataaataggattaaccaaatccatgaaaaatgagcacttgataatgaatctaaagctaaaagggcactgttcatcacaagtgataagaaaataaaagcgataaaatcaaatttacctggacgagttttttcactcttttcaatagcccaagctcccaaaggaaataagcagattgggataattaaaataattgcaaaaatcattcgccagccaagagttcccgttaaaagccccccataagttgggccaagtgcgggtgcaatactcaaaatcataccagcaaatcccatccaaagaccaacccgttcacgaggaattttagtcaagacaagattaaacattaaaggaattgcaatcccagtcccaatcccttgaatcaaacgtccagccatcaaaatagtaaaatttgatgaaattaaactcaataaatcaccgatagtaaagaagattaatcctgcaaaaaacaaggttcggttttgaaaacgttggctgatgtatgaacttgtaggcataacaatagcaacaacaagcaaataagctgtcgtcacccattgaaccgtacttagtggaagtccaaaagttttctcaagcgtggggaaagtcacattcagacttgtttccgccaatatccccataaaggccacaagagccacagcgacaatcgaaaagcgcgttttcgcgctaattttatgattcgctttatttttttctaattctctattcattctcttccttcctgcacgctaaaattattaagaaatttttcaaccgcagcaatctcttctgttgataatcctgtcaaagcttttttattatgtgcttggatataagccctgatttcaggtaaatatcttttcccttcttcagttaattcaactgatttttggcgggcatcggtcaggcttgttcttcgattaattaaaagccgcttttccatgcgctgtaaaatttccgtcgttgttgaacgtcggatattaaattctaattcaatcatcgtctgactaatttcttttcctgaaccttcttcgctttgatttccaagaaaatctaaaattgacatttgctgacctgtcaaatcaagttgagctgcaaaattatcaaattctcgagacatttggttgctggctacttttaaaagtcggccaatcgcttcttttttagttcgcatacgaattattataacatagtttttttgttcgtcaacgaacgtttttgtgtgattttgataaaaaaaattactgacaaaatgatgtcagtaatttcacattattttattatttattttacgggtgtaaaaacaaccgttttagcgtttcctgatgtaataatggtcacttccataccagtggtaaagttgatagatgtcgccttgtcgtgatataatattatctttttaataatacattttattcaattctaaatttaatataatcatggaataactctaaaaaaagccaccgctgccatactattcgccatttgagggcttgtaccagaataattcacaaaaattcgttgttgcccagttgaatcgtctacttttttattattagggaaagcaacttctgttggtacaacaaaaatgttaagtggactaccaggggaaatctctccattttttaaggcaatatctgcagttccattaaattgttgacctgcgccaagttcaaaggtttgattctttgcccctttccatattaaagtaagatttcccattgcattaatttcaagcatatttccagaagtatctttccaagttccaacaatactagaaaaattaccattaacaatttgagcaatgtttaacatttcgttttttgctccaatcccgtaccaagctactgccccatatttccaaccagtattcaataagctattttgctcaaagctactttccgtgtaattgtgagcgccagattgtgcattgggattataagcgacatatacggcttgagaacctccagaatagaagaccgcctttccgttattatcccatttccaacccttatttactaaactttgggcttcatacttgctttttgtgtaataatggtctccgcccatagcatttggattgtacacacggtaaactgggcttgaacttgttgttggtgcgatccaaccgacaccttcataagtccaacccgcacttacattagcattcttttctgtcccactagttgtatagaagtgctcaccagtattatgattatacaaacgataaacatttgtatctgcatgagcacccccaacaatcagtaagctagcccctataaaggctgttccaagtaaaagtttgttcatctttctttctcctttataaaaataaaatcggttacaagtcctattatattcattttaaaacatttgtcaattaaatttaaacttcgtaatcaaaaaaatacaaaaaatacatttagagcgtactctttaaaacatcttgtcgttaaagcctattctagtcgatttttaaacgaatttcagacttctactgacagattctttacggtcataaaaatacatttttcccacaaaaaaagttactgacaattttgtcagtaacttatagattaatttaaattgctaaatcaaatttcaattgaggttttactggctcatagtccacaagttcaaaatcttcaggtttaatatcgaaaaagtttgtaccatcaggaacattaaggaccaaacgaggttctttttcagaagctgttcgcttcattaattcatttgcctgctcaaactgattatcataaatatgtaaattatttacaaaataaaagaatttcccaactttccaagaaaaatgttttgcaatcatcatttgcaaagcaacatattgcatcgcattgatatggtgggccacaagcatatcgtttgaacgttgaatcagtgtggcatccaaataaatctgaccatctttttctcgacggacatcaaacatcgtttggaaagcacatggtaaaagaccttctgtttcctcaaaatcttcatactgccaaaggttgatgatattacgacgattccatggatttttggccaagccttctaataatttaccaatgatattatattttttgactgtttcaccataacgttgcccaatcgtaccatcaccaattccccattctccccagtatttgactccatacttctcttcgagaacagaaagctcacttgtttggtcttggtatatccacatcaattctttaatagcagatttgattggaattggacgcaaagtggtaattggaaactcccccttttgcaaatcataagtaacgaatgaaccagtgacatatttgctattcgccatttgaccatccttatactttggtcttgcattttctgaaaaaacaccattatctaggatattttggatattttgtttaaaaacttgatctgcgtaagtcatgaaattttcctatcttttttaattcccttcattataccacaccacctcgatatggttcaatagtatttcccaaaataacctctcagaattatcaggatagaaaaagagatgtcaatataatttgttcaaaccagatttataaaaaatatccatcaggcagtttctgaaccttctaattcaacagctgctttttcttcttctaaagctttattatccgccaccttaaagaatgggtagtaaataagaacattcaagactaaacagattgcaaaaataatcaaaaatggaagtccacctgaaatggccattctcacaggtgctggtgtcgtccaaggaagaagtgccgtcattggattcagatttgtaatatttaatatctttgccaagcccaatgctacagttcctaaaattgctggttggaaaaccaaaggaataaagaaaataggatttaacatcattggaagaccaaaaagtaatggttcactgatattgaaaatactagcaattgcacctaattttaataattgtttatagcgttcagattttgccgtaaacattgaaataactaacccataagtatttccacttccgccccatgcgttcgcacccacagcaaacacaatcatcatttgtaagtatggtacaggttttccggcagcataggcatcaatattagcatatgacattgttaataacaatggatttaaaattcccccaattaaattagggtggataccaaagaaccataagaaattaccaaaggtaaagatgcccataagaacccatggatttgccacagcaccagtcaacggtgcttgaattagttgtgttgagaaattgaaaatatcatggaatggcgtataagagaatcccacacgaatcccgaacatcaaacagaaaatcaccattgaaataattgctggacttagtgaatctacaaccattggaggaactccagctggtaatttaataactaaatttcttttgctcaattgtatatagactaatgaaacaataaaaccaattatgattgctacaattaatcctgtgctacccgtgtataccgtttgaaatgcttcaacatttgacacactgtcaactaccgcggatttcggaaattcggttggaatgttttttactacagggacactaataatttgtggcattagcattaacaaacttgcgattgataataaaccggccgtatggccattatattcatgacgatttacacctgtctcttttttgaattgtgaagataaataagaaatattcatgtgtagctcttctgcaatttcactcacacttagtttttcgtataaatgattaacaatatacttttgacaagataatattttataagaaacctgacaatatcgatgctgtttcactttatctgcaaaatcgatcatcacattataggcaagcgttctaatttcttctaattccgttaattcttcaagctcttgaatatataaatcactcatcaaaaaagcttcttcttcaggtaatcctccctgtatagccgaacgagtagtcatagtgatgactgaaatcaaaatgtttttcttatgtcgcattgaattattagataattttccagcagttcctttattcatataatttgaaaaagctttttttaactctgcaacatctccacgaataacacattcccccaaatatttttcagaaagatatgttttatggaatttactttcctcacgtattggaatcatttccatttcaattggtttagcagcaagcaatggagaaataatatgctgatttttttcaaataattcttcataatctaatttttcttgaaaaatcatttgatagagtaaaataccactttttaataattgttttacttcaacggggaaaggattatttgcaagtttttcttgtcctttaaaaataagtagaagatactcctctttaccaaatacagaaaaaatttataaactaaattatacgtcgtttaattggacttaagccctaaaataacgtagaattgtattgaggaggacgcttacaatgagtaaaaattataaaaaaattctaatcgctattgatggttctgaacaggcagaagcagcattaaaagaagcaatcactttttgtaaaagagataatgctcaattatttgttttacatgcaacggataaaaatagtatctatgcagctgggaacccagtacctgtggttccggcccctgctattccagtagttcctgcagttcctgttcttgaagaaagtgcagacaatgaagctaaggaagttttagagaaagcttcagcaattatcaacaatgaagtgaaatttgaagaaattcgtgtcgatggttctgctaaaaatgaaattgtagactttgccaaagaacatgaaattgatatgattgtaatgggctcatctggtaaaggtgcccttgatcgaatgttacttggttctactgcagtttatgtagttaaacatgcaccttgtagcgttacaatcatcaaataatatagatgattttggagaatcgacagaagctgtcgatttttttgtagtttaaaaataaaactcttgacattggaatttttcgtttacaattgtaaacataaagaagagaaagttggattgaacaatgaaagttacttttaaaacccttgatggacgtacaatgaccaaagaatttcttacagtcgatgagttcgtgatgctacaaaatcgtgaaattccagccatagatgattcagcaaaagtccttgaagttgtaatctctggacaagctgaagaatttagcggaaatgttgcggatttatatttcaagttgagtaaataaaatctaatccagtagagagaagtggaggaggaaaaatgacaaattatgtttttaaagctggtcgcaagaacttggctcctcttttgttgctacacagtacgggtggggacgaacatcaattgttagaaattgctgaaatgattgctccacatcatccaattttatcaattcgagggcgagtaaatgagcaaggaagtaatcgatattttaaacttcgcggtttaggtggttttactaaagaaaactttgaccttgattctcttgatgaggaaacgaattggttaacgagtgaagtacagtccttagctcaaaagcataatcttgatgtacagaaaatgattgctttaggttattctaatggagcaaatgttgccttaaatatgtttctcaaaggaaaatttaattttgataaaattattgcttttcacggcatgcaacttgaagaatttgaagaagctattcagctagataagaaacaggtttttctgacttatgccgcaaatgacaggattgttcctcgagaaaattttggtgatttaaagggagatttggaagattcaggctgtcaaattgaaatctttgaaagctcactcggtcatcagttgacgcaagaagaagttatggccgcaaaaaaatggttggcgaaagctgactgactcatcaaaataactttactgactaaaggttgtcagtaaataaatagtaaatataggagaaaaaacgatgactgaatcaacaaaaatagtagcacaaatccctgaagctctcactcttggtggagttcaccacgttacagcaattacttcaagtgctcaaaaaatttatgatttttttacaaatatcttgggacttcggctagcaaaattaaccgtgaatcaagacgattatgaaacctatcacctctttttcacagaagaagacggacatggcgccgatatgacattctttgatttcaaagatattcccaaaggaaatcatggggttaataatatcgaacgcgcttcattccgagtacccacagatgcttcattggattattggagcactcgctttgataatgcccatgttaaacatggcgaaatttcaagtaagtttggtcaaaataccttagagtttgaagattttgatggtcaactttatcaattaatttctgaccaaaataataacggggatgcttctaaagggcattcttggcaactttcaaatgttccgcaagaacatgggattactggactgggcccagtttttgtgaaagtggaaaatgccaaaaatcttcgttcaattttggaaacagtttttggattccgttacgctggtcaagaaggggatttacacctttttgaaggagccaatggtgggaatggggcggctttgattcttcaagaagctggtgaaaaagaatcctatgcctatcaaggttatggtacaattcaccatttagcattgggaacaacaaaccctgaaacattgaattattggattgaacgcattaaagccttccgtttgcctcattcaggtttggttgaccgattctatttctcaagtgaatatgttagagttgcgccaggtgtactctttgagattgcgacatatacaccgggaattggagcacttgatatggcaaaatctggttcaggggctgttgattcttatgaagaagcattgattacttctggtttctggattgaccaaagtaaagaagaatcgggtttgtctttgagtttgcctcctcatttattcccaggagatgaagcaaccaaggcaagaactgcagctagtttacgtcctttggatacctcagatactcaccgtgatcgtacgagagatgaattgtggacggttgaaaaagtattggaacataaagcgggaactccagttgaaacgctgaaataaaggagaactgatgaaatcatatcaagcagatgagctcgatgaaaaaacagtctataaactcttatcgggcagtattgttcctcgtccgattgcttgggtgacaagtcaaaattccgatggtttagtcaacgtagccccctttagctttttcaacgtcgcttcggctaatccgccacttttgtcaatttcattcacgggaaataaggatagtctcaacaatcttttgacaacaaaagaagcagttgttcatcttgtaaatgaagacaatgtagaattaatgaatcaaacagcggcaccactagccaagcatattagtgaagcagaagaattttcattggagcttgtgccttctcagaaagttcaagttccaagtttaaaggaatcaaaggttcgcttagaaactaaattatatcatcatttacctttgggtgagaatggacatttagttcttcttgaagtggtaaatttctcatttgctgacgagctattggacgaggaaaactttcatgtcaatctaactaaactcaaaccagttggccgtttagcaggtgatgattatagtactttgggtaatcgatttagtcttttacgacctagataaataaaaaaacttactgatggttggtcagtaagttttttgttcgatttaaaaataaaaaaataaccttaaggtcatttttaattatttaacttctttaaagattacgtgtttacgcaattttttagagtattttttaagttccaatttgtctggagtgttgcgtttgttcttttgagtaaggtacagacgttcaccagattctttgtgttcaagtgtaatatttacgcgcatgatagtccctttctataacttttgtcgaattatttagtgtcgcgaactttgcggcctttgtagtagcctttaagtgaaacgcgatgtgagtgacggtagtcaccagtagtttcgtcaaaagtaacagttggagctgtcaatttgtaatgtgtacgacgacggtttttctttgctgatgaagtgtgacgtgcaggtactgccattgttttttcctccgtagaattttatctcgttcttgcagagtgcaaaaacgtactttattagtatagcataaattttcagaaatgcaagttttgtaaagtaaaattacttgacaaattttactgaccaatctgtcagcaaaatatcagcttttaaaagtactgacaaatatctttgacagctaaatttatagggactttagcataaatttgataaaatgtaagtaacttatcggattacttaaaaatttaagctcagcttcgaaagaatcaaatcggcgtaaggagaagacattcaggtcgtaaaaactccaaacaaagcagggcaatgttctaggacaattaaatttttaaggagaaatgaatgaaaaactggaaaaaactgattcttgtttttgtcatcgcagacgtagcattgattgcttactttggctttaatcagccttttttggcgcgtctagtcgtcacaattgctgggggagttttggctttctcaatgttgattgaaatgatcaaaaccctacgaagtggctcttatggtgtagatttattagccatcacggccattattgcgactttactggtgggagaatattgggcttcactgattattattctcatgcttgttggaggagaaagtttagaggattacgccaatggccgtgctcaccgtgccttagcagctctacttgacaagtcgcctgaaattgcacatgtgcaaacaggagataaggtagttgatttgccactggaccatgttgagattggtagtgttttattgattagaccaatggaaattattccaattgatggtaaacttctgtcggaagctgttgtgcttgatgaggcttcactgactggtgaaacaaagcctaatgaattagtcagaggtgacaatgttctttcgggagctattaacggtaactcaagcattcaaatcgaaacaacgtttgctgcagcggattcacagtttcaaaaaatcgtacaattggttaaggaaacggaaaaaacaccagctcaatttgtgcgtttagctgaccgttatgctgttccctttacaattattgcttatatcatagcagcggttgcttattttatttcgggagatccagtccgaattgcggaagtgttagtagtggcgagtccttgtcccttaattttggccgcgccgattgcttttgtttcagggatgagccgctcaagtcaaaatgggtctttaatcaaaaatgggaccgtcattgaaaaattagcaaaagctcaagaaatatttttagataaaacgggaaccattactgaaggaacaatcaaagttgacagtataaagccagtaaaatcaggaaatgaagcggaacttttacagctagtttacacagttgaaaaatcaagtggccacattttggccaaagcggttgttgaatatgcagaaactaaaaagattcaacctctaaaattaacttctttaactgaggtcgcaggccttggagtaattggagagattgatggtgaagaaattaaaattggccgtagtttatttgcatttgcgccagataatctaaattatgaaacagctttttatgtcagcaaatctggaaaatatattggtgccgtcactttttcagatactctacgaccagaagcaaaagcaacaattgctcagatgagaaaaattggacttgaaaacatcacaatgctaaccggtgataaccaacttgttgctgacaaaattgccaaaagtgtggggattgaaaatgtctatgcaggactgatgccagatgaaaaattgaaatttattcaaaatgcaactcatcgaccatccattatgattggagacggggtcaatgatgcgccagcattagcaacggccgacattggaatttcgattggtgtcggttcaggaacagttgctagtgaagcagctgatattgttttgctgcaaaatgaccttagaaaggtcacgacatctatcgaaattagtcgtgacactttaaagattgctaaacaagcagtcatgattgggattgtcatttgtattattctaatgttcattgctgctttaggagtgattcccgcagtgattggagccttgttccaagaaatcattgacgttgtttccattctttatgcacttcgggcacttagaggttaaacttgcaaaaaaagtactgataaattcgtcagtactttttattttttagcagctcaactagtaggttttttcatgactttttcatgataaattctcggtaacttttcagtgaaaactggtagttttaaatcctttctttcgctacaatggttttgttaaataactcaaaagagagaaggtctaaaaatgttagacaaaaaatttcaatggaataaggttcctgccattggcttgctattttggttgaccaaacttatctcgacgaggcaaggagagtctctttccgacttctctagcaagctctttgggcaacaaaatcaaatgcttggtgcggtatttacggttgcttggtcgctcattctttttggtatttttctttttttgcaattaaaatctgaaaaatatcgaccagttttttactggctatcagttgctttgctcgctgtttttgggacaattctagctgacggtctttcgggggttctcggaatttcacatctttttactagtctgatttttgccgcgggaatgggaatttcatttatgatttggtatcatctgacgggaactttatctattaataagattagaacacttaaatctgaactttgctattggttgacggtcatgtttagttttgccatgggaacagcccttggcgattgatggcggatacaagaacaggctataatccagacccttatggactcggtcttgggcttcttaatacaggattaattttaggtttaatctttgtcatcgttttggcttatcgatattttggaaggccggctcaaaatagtttggtagaaattttgagtttttggtcagcttatatcctgacacgtccagttggtgcaagtttcgctgattattttggctatacatggaatgggggaaaacttggaaatggaggaatgtcagtgatttggcttgtcttatttgtcttcttgattgcagtgattctagtagattttcataaaaaatcggcaaattattttactcagaaatcagaaaaaatagtgtcggattgacactattttttattttttgagcaattcaatcaaatgttcaagctcatcaagattatcaaaatggagcgataactttccttgatattttttatttgcttgaattttaactttatttcccaattttttcatcagttctttttcagtttcgtcagtaaaaagatttatatttgagttactgacagacttgtcagtaactttttcttcgccataaataatagcttcaagctccctgacattgagctgttcgttgatgattttatcgaccaattctaattgctttttgggatttttttcggctaagagtgttcgggcatgagcaggggaaagagttctattctcaacatgcttcaaaattttatcgggtagaccaagcaaacgaatcaaattagaaacataagatcttgattttccgagggctttagcgatttcatcatgagtcatgcctaatttgtcagagagttgtgcaagacttttagattcttctaaagggttgagattttccctctgtaaattttccaaaatcgatagagtcatcatctcctcatccgagtaggtccgaataattgctgggattgtttctaatccagctaattttgaagcttgaaaacgacgttcgcctgccaataattcataaccaattaacttcgatttacgaacaataatcggctgtagaacaccattttctttgatagaattggccagttctcttaagcggtcctcatcaaaaacgagacgaggctgataggggtttttgacaattgttgataatttgagttgagtgatttcttctgtcatctttttcactttctgtcagtaaatgttaagactttatatttactgacaaatttgtcagctcctctttttttgttcattaatccattctttccgactatggagggctttttcatatctccccatatcatccggtcggaagtaatctgcatttttaattttatctggtaaatattgttgatttacccagtggtctgggaaattatgagcatattgatattctacagaccgtcctaattctttagctccggcgtaatgaccatcttgtaaatgcgagggcacagcaagatttccgtattttcccaagtccgaaagggcttcgtccattgctaaataagctgagtttgattttggagataaggccaaatcaataatgatattggcaagaggaatccgtgcctctgggaaccctaatttctcagctgctgataaggctgtaacggtatgtactgcagcatcggggttggctaaaccaatatcttcataggccatgacagtcaaacgacgtgctagactttgtaagtcccctccctcaatcaaacgtgcagcatagtgtaaacttgcattgacatcagatccacgaattgatttttgcagagcagacagcaaatcgtaatgagcatccccatccttatcaaaagttgctgcttttctttgcaaagaattttccatatcatctagggtaacgcggtgttcgtttgaagaaagaacagctaattctaaggcattgaatgtagaacgtaagtctccattggttgagtgaactaagaaatagagcgcatcatcgtcaatagtcacatcaaaatcaaatcctcgttctttatcttgtaaacttaggtttacagcagattctaaatcctctggttcaagagctttcagttcaaaaatttgaacacgagagcgaatggcgggtacgactgaaaaataaggattttcggtcgttgctccaattaatataatttgtccgttttctaaaagtggtaaaagaaaatcttgttttggtttatctaaacgatggatttcatcaagaagtaaaacaagctgaccagaaaattctgcttcagaagcaatttcttggagcctttttttagtatcggttgttgcattaaatgttctaaaagcaatgttcatggttccagcaattgctgaagcaattgaagttttaccgatgcctggagggccatagagaatcatacttgaaagaagttgagtttccaccattctgcggatgatttttcctttaccaactaaatgtctttgaccaacaatttcatcgatattgcgaggtctcattcgtcttgcaagattttgtaccatatcattctccaatcaataagtttacaagcagtgtaaaccaaatttacatgaggcttttatcaagataaaaagctaagaagcagtcatcaacataatctccatcaatgaaaaattcttttttcaagcgcccttcttcaacaaagccgagtttattgtaaagcgccagagcagccggatttgagcccatcacttgaattgtaatttttttgaagccttctttttgagctaaatcaataaaaaaattaatcaatgctgtcgcaattcctctacctcgggcttcttttgcggtcatgaggccaaaagtgacgatatgcttgccaaagactgatttatggcgaaaaccataatcaaggattccaagaatttcaccatgttcttcagctaacaaataagtggtcccgctcatgattttgctgatgattttctctgctgatgagtccatgatatgtcgggtagaagccaaggtccaattttcgttttcgagttgagcgactttgacaaagtcacgaggttctatttttctaatttccattaatatatctccaaattctaaaaagtaagggataaaaaagaaaaaactatccattttgttttattaaatataaaaaagtgcttttaaaagacttatttattaagtcttgctgcttttatagagcaaatttttgttataattattttaacataatatgaagagggtgtgaacaatggccaaatttggatttttagatgttttagaagaagtcttggaaaaaggattttcttatgattttgagatgaattgggacaagcgtaattttgcggtggaaattagctttttgctagaagcggaaaacacttctggaacactgttaactgacgcagagggtgttgaatctgatgaaaatattgtctatgaagatgcgataattttctacaatcctgcaaagtcaagttttgatgagaatgactatctagcagcaattccttacactgataagggcttatctcgtgaatttttgacttattttgctcaatttttacaggaaagtgctgaccaaggtttagatgatttgatggatttcttagccgatgaatctgcggaagaattttctgtaaaatgggataaagaagcttttgaaagtggcctttctggtctatcggaaacagacttttataaatatccgcgctactaaaaattttagaaagaattaacaaataaacaatgagtattttaaatgtaaaaaatctatcccacggttttggtgaccgtgccatttttgaagatgtgagtttccgtttgcttaaaggcgagcatatcggttttgttggggcaaatggtgagggtaaatcgacttttatgaatatcatcacaggaacgttggttcctgatgagggaaaagtcatctggtcgaaaaagcaccgtgtaggctacatggaccagcatgcggcacttggaaaaggtaaaacaacccgtgaagcactagctgaggcctttcaatatctttttgatattgaggaagaaatcaatgatacttacctgaaaatggcagaaatgtcagaagatgaaatgaatgcagcacttgaaaatgtcggagaacttcaagaagaattagataatagtgatttttatctgattgatgcaaaagttgaagaaacggctcgaggtcttggtttaacgccacttttagataaagatgtggccgaactttctggtgggcaaagaacgaaaatcttgcttggtaaactcttgcttgaaaaacctgacattttgcttttggacgaaccaacgaactatttggatgaagaacatatcttatggttgaaaaattatctgaaaaactatgagaatgcttttattttaatttcgcatgatgtgccttttatggacgaagtggtcaatattatttatcatgtgcatggtcttgggattacgcgttattcaatgggttatgcagaatttgaacgggtatttgaagagaaaaaagcgcaacttgaagctttgcataatgcacaggtggctgaacaagctaagctcaaagatttcattgctcgtaaaaaagcgaatgtggcaacttctggacaagcgaaagctcgtgagaaaaaattggcgaaaatggaaatcgttgaaacgatttctgaaaaaccaaaaccacaatttgactttaaatttagccgtaaaccaagtcgtctgatttttgaagctaaagatttagtcattggttataacgaacctttgtcgtcagaaattaatttaaaagtagaatctggacaaaaaattgcttttattggttccaacgggattgggaaatcaaccttgcttaagagcttaatgggcttgattccaagtcttgatggggaagttgaaaaaggaaatttccaagagattgcttattatgagcaagaaatcaaaaatccatcgcaaaagacagttcttgatgatttatgggacgaatatccaagctggaatcaagcggaactccgcggagcactggcacgcgttggcttaacggctaagcaaattgaatctcgtgtttatgtactttctggaggagagcaagcaaaattacgttttgctaaattgatgaatacagaatcaaatattctcatcttggacgaaccgactaaccatttggacgtggacgccaaagatgaacttaaacgcgcacttattgcatatccaggaaccgttttgatggtttcacatgaacctgaattttatgaaggcttggtttctgatgtcattaattgtgaagaatggacgacacgaattttgtaattcctgattaatcttatacaagttcatctctaatttttcctaaaaattagtagttaaacagtattaggagaaaaatgactcaaacaccatatccttgggaaaatccacaacaagattataaagtgactctggcaaaacgccgctcagagcgtcgttatcgaagtttacaactggcaaaaacactcgaaattctactgacgaaatttaaaaaatacaatgtaaataaatttaattcagagattttggattggattgaagagctcagaaacaatgctgaatatattgatgatgaagatttttcgtcagcaaaaaaatttgttgcgaaaatgaaacgagaactgaaaaaacttgaaaaatgaacttttagactgacaagtgagaaaaggtgaaaaatgaaagcaagtttgcaaaattattttgaccagtgggaaagcccttggatgcaactttactatcgcatggtttgggagcagctgtcagcagaaatttcactgacagataagaaaattttggattttggttcaggatttggttggaatgccaatcatttggctgacagaaatagtgtgattgccattgagccaaattctgaaatggtgaaaaatcgtcagcaaaccaatcattatcagcaaattactggcggactttctgagctcagaaaatttaatgacgaaggttttgacctcattatatgtcataatgtttttgagtatgcatcagatgaacgtgcggaaatactgcgtgaatttgacagactgctcagtaaaaatgggctgatttcgattgtcaaacataattatgcgggggccttgatgcagaaaattgtctttgaaaatgcgctcgatgaagctcatgatttactgacaggctcgtcaaaaaccaatcaaatgtttggtaagattcattattatgagctggcagatttattatctaccgacagttctctaaagattcataaaacctacggtttgcggactttctgggctttacagcctaatgagtttaaaatagaacctgattgggcagataaaatgtttaaagtcgaatgggaagtttgtgacaagcctgaatttgcggcgatttcgtttttcaatcatctgattttgaggaaaaataatgatgaccatttataaatttcaagccgagcttgaaattatcggcattaatccctttgtggctctgccgatagatattttgcaacatatttttatcgattcaggccgaaaaaaatcgcccattgccatttgtggtcaggttaatggcaaggattacaagcaaaatctcatgtttttcaaaggggattggcgtttgtatgtgaatacgaccatgctaaaaaattctccaaaaagaattggtgagttggtagattttacaattgcttatgattcagagccgcgaatggtcaaacaaccccaagtgctgagcgaagcattagccaaaaatctggaagcaaaagaagtatttgaacaattgacagcttctaaacaacttgaaattaaccgctatatcgccagattgaagacagatgaagccatcgagcgaaatgtggcacgggccattggttttttgctgggaaagaatcggtttgttggtagggataaaccatagaaagaaataaaaatgaataactggaactcaatcactataaaaatcagtcgtgaagccgaagaagctatttcagctttgctgatagaagcaggttcggcgggtgttgaaatcaatgacagcgctgattacctcaatcacgaagaccaatttggggaagttttacccgaaattgagcaatctgaactcgttgacatcacggcttattatccagaaaatatgccaattgtggaattaaaagccgaaattgaacataaaatcgccaatttagctgattatttttcactgacaggtttgtcagtaacaacaaataatctgtcagaaacaaattgggcagaagcttggaaaaaatattttgaaccggcacgtatcactcatgatttaacgattgtcccaagttggacgaaggattacctggcgacaggttctgaaaaattgattcgacttgatccaggaatggcttttgggactgggacacatccaacgaccaaaatgtcactctatgctttggagcaagttttgcgcggtggtgaaactctgcttgacgtcggaacgggttcaggagttctatctgttgcagcgacttatcttggcgcggcagaaatttttgcttacgatattgatgaagtggctgtgcgcgtggctttagaaaatattgaactcaaccctggtcatgaaaaaattcatgtgtcagcaaacaaccttcttgaaggaattgataaaaaagcggacgtgattgtggccaatattttagctgatattcttgttttaatgacggacgatgctttccgcttggttaaagaagaaggttatctcattatgtcaggaattattgctgacaaagccgatatggtcattgcatcagcagaaaatgctggatttttccttgaaacacgcttgattcaaggcgaatggaactgtctgattttcaagaaaacggaaaatcgggaaggggtaattggaggataaaatttcatttaaatcatattaggacctcggaaatgagtgctttatcttttagcaaatgataaaataaagtaaacaattcattgaaatgaattttatgaaatagatgattggaagagaaaatggctaaccaatattttgtatttaaagaattaccaaaaatcggtgaaaaatttaccattgaaaaccaagcagcagctcaccatatttttacggtcatgcgggcacaggccggtgatcagttacgcttagtttttgaagaggggaaaattggcctgtcagaaattatttcgccagctgaccagtcggtcagactgattgaattactgacagattcatcagaattacctgtccaagtcacagttgcagttggttttcctaaaggtgataaattagattttattgttgaaaaatcaactgaattaggcgccacagccatttggtcagcaccttttaaagcttctgtcagtaaatgggaccacaaaaaactgacaaaaaaacaagaaaaattggaaaaagttgctctaggagccgccgagcaatctcgcagacaattgattcctaaaattcaattatttgaccaattttctagattgacagagcaattttctgattttgaccaggttcttgtagcctatgaagagtcggcaaaaatgggcgaaacatcaatgtttaaacaagcactgaccgagctgtcagcaaatcaaaaagtcctgattatttttgggccagaaggtggaattagtcctgatgaaattgcaaaatttgagaatctaggggcaaaaatgattggcttaggaccacgaatattgcgagcagaaacagctcccttatacgctttatcaagtatatcagcttattttgaattattataaataaagaaaaaatttttaggaaatcgattatgaaaaaacgtgtacaaagtaacaaaaaacgaattcgctgggcttcagtcctcacagttttcgttcttttaattggaataattgcaattgcttttgctgccgttcatctgctaagtcctaaagcaaatactagccaaaaaagtagtcaaacttcaagacaagaaaaaaccaaaagcactgtcccatctagttcttctcaacctaaagaaacaaaatggctcactggaactaacgaaaatcaattgcctattttgatgttccattatgtcacttcaagagctgaccaattgccacaagatagtaacaacatcaatattgttacctttgaaaaggagttaaaagcactgaaaagtcaaggttatacgacagtcagtggaacggatgcccaaaaaattctgacgaccaaagaaaaacctagtgacaaaatggtttggcttacttttgatgacggttcagtgaccatgtatactgatattttcccattactgaaaaaatataatatgcatgctacgaatttcattatcacaggatttgtgaataaagctcaaggaggaattttgagttgggagcaaatcaaagaaatgaaagcaagcggacttgttgactttggaagtcatacagtcagtcatcctgatttaggaacgcaaactttagaggaccaacgaacggagctagaacaatcaaaagctgaccttgacaaaaatctgaaccagcaaaccaatatgatttgttatccagccggtggctacaaccaaaataccctaagcttatcaactgaattaggctataaatttggacttcttgatccaggacgtaatggtgttgtcgcccaagcggccaaagaaagtgatggtctattaacactgccacgctttagaatgatgagtagcaccactgctgaagaaatgatgcaaatgattcaaccagcgactgattataatgaaaaaaataaataaactccgaataatcggagttttatctttatatttttaagagtcatccttttgcttaacttgcaaatgtgatagaatagattaaattaagtgaaatcaaccttaacttataaaatttgatgagataatatattaatccaataaggaggaaaactggccaccattttaaagtttatttttaaaatggtctagtatatcaagctatgccttcagaaccagtcttaaccggagcagaagttgtcaatatctgctctgaatacatgaatgaaactgaccttttactcgtagaaaaagcacttgcctgtgcttcacttgcccatgccgaccaatatcgtgcttctggcgaagcctattttgttcatcctacccaagttgcaggaatattagccaaattaaaactggatgccgttaccgtttcctgtggttttttgcatgatgtcgttgaagatactaattttactcagggtgacctgcaagagttatttggcgatgaaattgctgaaatagtagatggtgttaccaagttaggtaaagttgagtataagtcacacgaagaacaattggcagagaaccatcggaagatgctaatggctatgtccaaggatatccgtgttattttggttaaactggccgaccgtttgcataatatgcgtacgcttaaacatcttcgtccagataaacaaaaacggatttcacgtgaaacaatggaaatctatgccccccttgctcatcgtttagggattgccagtattaagtgggaattagaagatttatccttccgttatcttgaagaagcggaattttatcgcattcgtggtcttatgaatgaaaaacggactgctcgcgaagcgctcgttacggaagtgattgggaaattacaagaacgtgtggaaaaagcaggagtggatgccgaaatttatggacgtccgaagcatatttattctatttatcgtaaaatgcacgataagaaaaaacgctttgatgaaatctatgacttgattgctattcgctgtatcactgaaacaacaagcgatgtttatacaactttgggatatattcatgacctctggaagccaatgccaggacgttttaaagattatattgccaatccgaaagccaatggctatcaatctgtccatacgacagtttatggaccaaaagggccaatggaattccagattagaacgcgggaaatgcaccaaattgcggaatatggggttgccgctcactgggcttacaaacaaggaattaaatcaaaagttgatgttcatgaaatctcagaaacattgaattggattcatgaattagtcgaattgcgcgaagaagctggcgactcagccgaagattttgttaaagcagttcaagaagatatcttatcagacaagatttatgtctttactccgaatggtgaagtccaagaactccctagaggctctggtccaattgactttgcttatgcgattcacactaaagttggagatcatgcgacgggtgctaaagtaaatggacgtatgaaacctttatctgttcaattaaaaacaggggaccgagttgaaattattaccagctcaagctcttttggaccaagtcgtgattggattaatttagttaaaaccaataaggctcgaaataaaattaagcaattctttaaaaaccaagacaaagaattgtcggttaataaaggccgtgaaatgttgcaagaagctttggaagaagctggctttgttccaaatcagtatttagataaaaaacaccttgatgaagttttcaataagattagttatcgcaatgccgaagctttgtacgcggcaattggttttggtgaactttcagcgacaacgattgctaatcgtttaactgaaaatgaacgccgtgaagctgagagagctaaacaaaaagctgaagctgaagagctgatgaagggtgaagttaaacgcgaatcaagtaaaaatatcatgaaaatccgccacgacgggggtgttagcgtttctggtattgatagtctacttgttcggattgccaaatgttgtaatccagttccgggtgaccagattgttggatatattacaaaaggtcgaggcgtttctgttcacagggcggattgtcaaaatgtgcgcagtatggaagactttgaacaaagacttgttgaagttgaatgggatgattcagagaacttggtcaaagaatatgttgctaatattgatgtctatggatttaatcgtccaggattgctcaatgatgtgatgcaagttttatcaaattcgactaaaaatttgatttcgataaatgctcaaccaacaaaagataaaaaaatggcgaatattcatatcgctttagggattaaaaatttatcagatttaactttgattgttgataaaatcaaaatgactcctgatgtttattcggtaaaacggacaaatgcttaaaaaaagagcttgacttagtcaagctcttttatattggattctttaataatgtaattgggacgtcttttagtttcaagaaaaattttagcaatgtatttacctataattcctaaggaaagtaactgtaagccccctaaaagtaaaatcaggacaatgagggtcggaaagccctgaacggggtcgccaaaaattagtgttttaagaagataaaagatactgagtaggacggaagctaaaaaactgataaaaccaacaaaagttgcgatattgagaggtgtttcggaaaagtttataatcccatcaatagaataactaagaagttgtctaaaagaccaagaagtctgcccagcacttcattcatgattttcatattctaaataggtgactttataatctacccaagagaataagccctttgaaaagcgattgctttctcttagctctaaaatactatcgacaaattgccgagtaattaagcgaaaatctcgtgccccttcaacgattggcgtggtagaaactttattaataattttataaaaaaggttcgaaaaaagggagacaattaaggcttcacctttgcgagaaatgcgacgggcacccactgcatcgtagccttcttttagcttatgatacatagggacgagaagttctggcggatcttgtaaatcaacatccatgacagtgataagggattctttagtggcttgcagtcctgcgagtaaagctgcttccttcccaaaatttcttgagaagctaatatagttgatattatcattttgtcttgctattttttttaataaaggaagagtttggtcactagaaccgtcatttacaaagtaaaaattttttttaatttcaaggttttctgtttttttgtttacctctcggacgaaaagttcaatcgtttcttgttcattatagacggggacaacaatagctaattcttccattttttttccttaattattcttgtagtttattaatctttagaaagtcttatatctattaatgataatacctaaagagtgctatgatgtcaaggattcttgctatcttattgactaggtgagcattttttttattggcaaggtggtttatgaaaaatagaggattgacttaaaaaatcgattaaactcaggtaaataaaatagcttttttatgctatactgtcagtaaagagattaacataggagtgaaacattaagtattatgaaaatagtaattcaacgagtaaagtcagcttctgtcagtattgatggaaaaattaaagaaaagattaatcagggttttttgctttttgttggagttgaagatgctgacagcaattttgatttggactatgcggtgcgtaaaattgctcaaatgagaatcttttcagatgaagctgataaaatgaatctctctgttcaagatattcaaggagaaatattatcaatttctcagtttactttgtatgcggaaactaaaaaaggtaaccgtccgagcttttctgcggcaggaaaaccttattttgctaaagcaatgtatgaaaaattcaatgacagtttagctcagattgtgccagttaaagcaggtgtttttggtgcagacatgcaagttgaattgataaatgatggccctgtcacgattattttagatacgaaagaagctagaaaaaatgcctaaaagattgcaaaagagtagagttaaaaaacaagctcctgctcgctctgtcagtaaaaccaaaacttttcaaaacttaaaaaaatctgagcagtctgaccaagtgggggaaatttggcaaaataatattattcaatcgcttgatgaagattattcaaaagaacaggccagaaaacagcaaaataaaaagatgactgagcgtcagaaacgaaaaattgaggaaatgcaaagcaatccggagatgattcaagcgcgtgaagaacttaaagaagagtttctcaatacgcatcctcaatatgcaaaaatgaccagtgaggaattgcaagaatcaatgaccaggcatgctttagaggatgaaaaactcagaaaacaaaaattacgtcatcacattgaagcatttgctgacggaattattgcggtcatcattacaattatgcttcttgaaattccagtgccttctggtaatcaaggttattggggatttctgagttctgccggtatttttctggtgagttttgttgttactgctaatttttggttcaatcgtcacaagatttttgcactgacagaagaaattacggaaaaatcattgttcaagattttatctttatcggcttactttcactcatcccacttttgaccaagtggattatggttgctccaacttcatttagtgcttttaattttggtttggttttgattgtaattttacttcagcaagagcttttaagttattcgattactaaagatcattttcgtaagatgccaaaatcttttaaattttggcgtcgtgtctggacaatccgactattttcaacaattctaatgaatattgcaatcatgataattgccattatttttccattttatggtcattggctctttgtgattgttccggtttttaactttttattccgcatggtcaatgaccgaaatcaggaagaagaagtttatgctgcgacacgttctatcggtgttccctatttgaaagaaggttaataatgactgtaaaaaatattatatttgatttgggtggcgtaattttagatttaggttttacgcgaatgattaattcttttgagcaacttggcgtcaaggatttttctagctactttaatccacaaaaacaagttgatttttttgaagaactagaattaggacttatatcaccagacgttttctacgatgagtttagaaaagcgactaaaagccagcttacagacgaagtaattgaagaaaattggaatttaattctaaaagattttcaaaaagaacgaatgaatttactgacagacttgtcagcagatttttcactttatcttttctcaaataccaacgctattcatgctaaatgttttgagcaacgttgtatcgaacaaatgggtcagcctttagcaacttattttacaaaagcctattattcacatgaattacatttaagaaaaccaacagttgaaagttttcacgaggttctccgtcagtccaatttaaaggctgatgaaactttatttattgatgacaatgcggacaatatcttaggagcacaggcagcaggtctaaaaacttatcatctgaaagcaccagaagtactgacagaaattgattttaataaaataatttactgacgaatctgtcagtatttttttgaaaaaaattttatactacataaagttaattcttgacaattgtctgacaattcggtaaaatacagtttattgaaattatttagttacaaattcagaaaaatgaggatttattatgggatttatgagaaaagcagattttgagctttatcgtgatgcagataaacattataatcaggtactaaccacacgtgattttcttgcactaggtgttggaacaattatttcaacttctatctttaccttgccaggacaagttgccgctcaatttgcgggcccaggggttgtcttttcttatctacttgccgctttggtcgctggttttgtggccttggcttatgctgaaatgtcaacagtaatgccctttgctggttcagcctattcttggatttcggtcttatttggcgaaggttttggttggattgctggttgggctttgcttgcggaatattttattgctgttgcctttgttggctcaggtttctcagcaaatcttcagcaattgctggccccacttggtttccatctgccaaaagtattggccaaccctttcggtacagacggtggaatcgttgatattatttcacttttggtcattttgctctcggcaattattgtctttcgtggagcatctgatgctggacgaatcagtcaaattcttgttgtgctcaaagtggcagcggttattgctttcatcattgttgggattacggtcattaagccagcaaattaccatccatttattccgccacacaatccgaaaacaggttttggtggcttctcggggatttggtctggggtgtcgatgattttcttggcctatattggttttgattcaattgccgccaattcagcggaagctaaaaatccccaaaaaacaatgcctcgtggaattattggctcactcctcattgctgttgttctatttgcagcagtaaccttggtacttgtagggatgcatccttactcagcctatgcaggaaatgcagcgccagttggttgggcccttcaacaatcaggttattctgttttatcagaagttgtcacagcgattgcacttgccggaatgtttatcgctcttttgggaatggtccttgcaggttcacgtttgctttatgcttttggacgcgatggacttttgcctaaaggtttaggtaaaatgaatgctcgaaatcttccagcaaatggtgtgtggaccttagccattgttgctattgtcatcggggcattcttcccctttgcttttcttgctcaacttatctcagccggaactttgattgccttcatgtttgtaactcttggaatttattcgctccgtcgtcgtcaaggaaaagatttaccagaagcaacttataaaatgcctttttatccagtactaccagctcttggttttattgggtcattatttgtcttttggggactggatgttcaagccaaactttattctggaatttggttccttattggaattgcgatttattttgcttatggaaatcgtcgcaaaaagaaataagacgaaaaataaaaaaattaacttagagattacaaaaaatggtttcaaaatttttgagaccatttttttgtcattattttggagctgacaaaaattgctaaaatagctaaaataagttaaaatagggaagttatcagcaacttatgatatgaggagtaaactatctaaaatgaaagaatatgaaaaacaacatcgaatcttctatgtctttttacgcaatcttgtcgcctttttacttttcatttttaatggaaaaagtaaatattacaatatcgaccggattcctaaagatgaaaattatatattagtcgccccccaccgaatggcttgggagccagtatggtttgcttttgcgactcgtccaaaacaatttattttcatggccaaaaaagaattgtttaaaggatttggcggttggtggattaaaatgtgtggtgcttttccggttgaccgtgaaaacccagggactaaacccttaaaacatgccgttaagatgcttaaagaatcagataaatcaatgattatgttcccttcaggtagccgtcatagtgccgaaatgaaaggtggcgttgcggtcattgctaaaatggcaaaagttcgtatcgtaccagccgtttatcaaggacctctgacaatgaaaggaattttcaaacgtcaaaaagttgccattaatgttggtcaccccattgatatttcagatatcaaaaagatgaatgaagagggaattgccgaagttaaccgccgaatggaagttgcttttgctgaacttgataaagaattaaaccctgattttcattacgaagcaaaataaaaaaataaaaaactctagcaaaatattttgctagagttttttatcagtctgcgtcgaatcaaaaatttgtccttctgttagattgaaatcagacagaaaatttaaaatgattgatttttcattttcgttgtatttatcaaaaatttgtccaagctttaaatccatgattttgtgcatcttatcatggatacttgccacttttaagcctttagttgtgatatggtagtaaattttctttttatcattatccgcttgataagttgttagaaactgatgttttattaaattttgaacagcacgggtcactcccccacgagtgactgataattttgtagctaattcaataccagttaaatcttttttggttagggccgataaaatgtgaagagcgacaactgacagagtcaaaacttctttttctagtttgtcatcatttacttgctctaaaatccattttctttcttgagagcgattgtcagttgcatgacgcagttcatgcaattcctttgaaatttttttgtccaagtttgctgagttcattttatccattcttatattatatcacagccagccatacgaaatagatttcctagggctgattttggctgaccaaagaagaccgatgatggtttgcaaaaccactttaacgagcgagtaaaaagtctaatgaaagaggtgagggatatttagataagaaagtgaggtctcagaaactttgtccaattttttctgcattagtgaacgctttctctttcaattcagcagaacgttctggatagcgagcatatccttctacgaagagttgcttgcgattttcgtcagtaattcccaccattttcattgtttggtcaatataggcagctcctaaatcattcgccatatgggttggatcttgttcattatgataaaaaccgccagcggattggatatgaagtgatttttttccttcaagtaaaccaatcggaccattttcagtataacggaaaagctttctaggtacggcaatgacatcgatatattgtttcaattcagcagtgacaaagccattgtacataggattgacgaaaacatatttatcagctgacagaaattcttctaaatattcttcatgacgatggagtaaatttttgtcagcctcattaagtaaatcgggagtatatttattacgcttccaagctgcaaaagtttcgttatcaagagctggtactttttctgcaaataaatcgcgaatgattattttatcagaagtgtttgtttggcggtaagcttctttgaatttttcagttgtagcaagagaccaactgaaatcatcagtgtgtgggtgggctaagacgatgagtaatgttgtcattttatttcttctttctttttttgttgacaaacaacattatagacttaattttgttgcttgtcaacattaaaccgaattaaaaatcgagtgttttgtggtatttcagtttgtaaaagctatgtaaaagtgttacaattaattgtaatatccacttatttatgtgaaagagaaaatatgccaaatattattagaaaacttgtcgaaaacgacaaaaaagagctcaaaaaactcaataaaatggcgctccaagttgaaagtttcgctgatgaaatggaacacttgacagatgagcagttaaaagccaaaactccagaattgaaagaacgtattgcaaaaggagaaagtcttgatgacctcctctatgaagcttttgccgtttgtcgtgaagcagctcgtcgtgtgcttggattgtatcctttccatgttcaaatcatgggtgggattgtcttgcataatggggacgttcctgaaatgcgtactggtgaaggtaaaaccttgactgcaacaatgcctgtttatcttaatgctttatcaggcaaaggggttcacgttgttactgtcaatgaatacttggcaactcgtgatatgactgaaatgggtgagctttatagttggctcggtttaactgttggtttgaacttgaactcaaaatcaccagaagaaaaacgtgaagcttataactgtgatattacttattcaacatcagctgagcttggctttgactatcttcgagataatatggttactcgtgctgaagatatggttcaaaaaccacttaactatgcacttgtcgatgaagtagactcaattttggtcgatgaagctcggactcctttgattatttctggacaagccgaaagttcatcagcactttactatcgcgctgaccaatttactaagactttaaaaggtcaaaacttgaacgttgcaacttctgattacgaagagggcgatgattacaagattgacttacaatcaaaaacaatttctttaactgaagaaggaattgataaggctgaaaaattcttccaaatcgaaaatctttatgatatggaaaatgttgccttgactcactttgttgacaatgctttgcgtgccaactttatcatgcttcatgacattgactatatggttgatgagaatcaagaagtcttgattattgaccaatttacaggacgtacgatgcctggtcgtcgttattctgatggtcttcaccaagcaattgaagctaaagaagctgtgccaattcaagatgaatcaaaaacaatggcttcaattaccatccaaaactacttccggatgtataaaaaattgtcagggatgacaggtacggctaaaacagaagaagaagaattccgtgagatttataatattcaaatcacaccaattccaaccaaccgtccagttcaacgtttagaccatccagatttgctttacccaactttggaagctaaatttaaagcagttattgatgatattaaacgtcgtcatgctgaaggtcaaccgattttgattggtactgttgctgtagaaacttcagaattgatttctaagaagttggttgaagcgaaaattcctcatgaagttttgaacgcgaaaaatcacttccgtgaagcacaaatcatcatgaatgcgggtcaacaaggagcagtaacgattgcgaccaacatggccggtcgtgggactgatatcaagcttggtcctggtgtaattgatcatgcagatcctgaattccgcggacttgctgttattggtaccgaacgtcatgaatctcgtcgtattgataaccaattgcgtggtcgttctggacgtcaaggtgacccaggggtttcacaattctatctctctcttgaagatgaattaatgaaacgttttggttctgaacgtgtttcagctttcctagatagaatgcgtatttctggtgaagatgctgttatcaaatctgggttgattactcgtcagattgaaagttcacaaaaacgtgtcgaaggaaataactatgattctcggaaacaagtcttgcaatatgatgacgtaatccgtgagcaacgtgaagtaatttatgcgcaacgtcaagaagttatcttgactaaagaagatatgactcctgttttgatgggaatgttcaaacggacaattgaccgtcaggttgatggtcatgaacttgcagggaatcttaaagacgaagaaacagtcaaagatctcttacaaacagtgcaaaacacaatgttgccagaagaggcaattgaattatctgaattgactggtctgtcaggacaagcaatgaaagatttgatttttgataaagtcaaaagtcgttatgcttcacagatggaaaaattagctgacccagaacgtcagttagaattccaacgtgcggttatcttgcgtgtggttgataataactggtcagaacatattgatgctcttgaccaaatgcgtcaatcagtcggacttcgtggttatgcccaaaataatccgattgttgagtatcaagaagaatcatataaaatgtacaataatatgattggtgcgattgaatttgaagtcactcgtttgatgatgaaagcacaaattcaaccacaaacggcaatccgtcaggaagcgccaagaatgacaacgacagcttcacaagaaaacattacaaatgtcggccctgacacttcggtcagtgaagaaatttcatttgaaaatgttggacgtaatgacccttgcccatgcggctctggtaagaagtttaaaaattgtcatggacgtacacacattgcctaaaaggccaattaatttactgacaactttgtcagtaaatttttttatcaataatggacgcaaataaatgtagaattaattaaaattttgatacaatagataaaataacaaagcgaaatacgaggaattagaatgacttttaaagaaataagtcctaagataaatattgatgccattaagatgttgggtcatctcaatagtgagcaacaagaaaaaaagatgcttcgagataaagaacttgaagcaattatcaaaggcgaagatgaccgtttgcttttgattatcggaccttgttcgtctgataatgaagaagcagtattggaatatgctcgtcgtttagccaaacttcaagaagcagtcaaagacaagatttttatggtaatgcgtgtctatactgctaaacctcgtacaaatggagatggctataaagggttgattcacgaacctgatgcggatggtcatactgacttaatcaatggaatcaaaatggttcgcgacttgcattacaaagttatcactgaaactggtttgacaactgctgatgaaatgctttacccagaaaatctgccaatggttgatgatttggtcagctaccatgcgattggtgcacgttctgtggaaaatcaacaacaccgttttgtagcttctggaattgatgttccaacgggattgaaaaatccaacttcaggaaacctaaaagtaatgttcaacggtatctatgctgcgcaacaatcacaagatttcctttttggtcgtgcagaagttcaaacttcaggaaatccactggcacatgcaattttgcgcggtggacaagatgaaaatggcaaataccatccaaactactatacagataacttgcttgaaacaattgagatttatgaaaaaatgggcttgaaaaatcctttcattctcattgacacaaatcatgataattcaggtaaaaaattcatggaacaaatccgtattgtccgtcaaacattggtcaatcgtgattgggatgataaaatccgccaaaacgttcgtggctttatgattgaatcatatcttgaagatggtcgtcaagataagccagaagtttttggtaaatcaattaccgatccatgtttaggttgggataaaacagaagcgctcgttcaagaaatttacgaagctgaaagtaaaaataaataaaattaaaagctgtcaaaactgacagtttttttaaattttaaagagtataaaagtagtttaaaaaatattaatttgatcaggaaatgaagcggatagtagtaaggcttcaaaagtagccctgaaaaaaaacttgaaaatttaacagcagatattgcaaaccctttcgttttgtggtacaatatcaagagtgatagatattttagatatcgtcaataaaaatgaaaaaacatctaaggagaaccataaaaatggcatctaaagaattccacatcgttgcagaaactggtatccatgcacgtccagctacattgcttgtgcaaacagcttcaaaattcacatcagaaatcactttggaatacaaaggtaaatcagtaaaccttaaatcaatcatgggtgttatgtcactcggtgttggtcaaggcgctgacgttactatttcagctgaaggtgcagatgctgacgacgcaatcgcaacaatcgctgaaacaatgactaaagaaggactcgcagaataatcatgacaactatgcttaaaggtatcgccgcatcatcaggtgtagcagtagctaaggcatacttgcttgtccaaccagatttgtcttttgaaacaaagacaattgctgatacagctaatgaagaagctcgccttgatgcagcacttgctacatcgcaaagcgagcttcaacttattaaggacaaagcagtaacaacccttggtgaagaagcagcatctgtatttgacgctcatatgatggtccttgctgacccagatatgactgctcaaatcaaagcagtaatcaatgacaaaaaagttaacgctgaatcagctcttaaagaagtaactgatatgtttatcggtatctttgaaggaatgactgacaatgcttatatgcaagaacgtgcagctgatattaaagacgttacaaaacgtgttttagctcaccttcttggcgttaaattgccaagtccagcactcatcgatgaagaagtaatcatcgttgctgaagatttgacaccatctgatacagctcaattggacaagaaattcgtaaaagcctttgttactaacattggtggacgtacttctcactctgcaattatggctcgtactttggaaattccagcagttcttggaacaaataatatcactgaacttgtttctgaaggtcaacttttggctgtttcaggattgacaggtgaagtaattcttgacccatctgctgaacaacaaagcgaattccataaagctggtgacgcttatgctgctcaaaaagcagaatgggctgctcttaaagacgctgaaactgttacagctgatggacgtcattatgagcttgctgctaatatcggtacacctaaagacgttgaaggtgttaacgataatggtgctgaagcagttggtctttatcgtacagaattcttgtacatggatgcacaagatttcccaacagaagatgaccaatacgaagcttacaaagctgtacttgaaggaatgaatggtaaaccagttgttgtccgtacaatggacatcggtggtgacaaaacattgccttactttgatcttcctaaagaaatgaacccattcctcggatggcgtgcacttcgtatcagcctttcaacagctggtgacggaatgttccgtacacaattgcgtgcgctcttgcgtgcttctgtacacggacaacttcgtatcatgttcccaatggttgctctcgtaactgagttccgtgcagctaaaaagatttatgatgaagaaaaagctaaattgattgcagaaggtgttccagtcgcagaaggtatcgaagttggtatcatgattgaaattccagcagcagcaatgcttgcagaccaatttgcaaaagaagttgatttcttctcaattggtacaaacgacctcatccaatatacaatggctgcagaccgtatgaatgagcaagtttcttacctttatcaaccttacaatccatcaatccttcgtttgattaacaatgtaatcaaagcagctcacgctgaaggtaaatgggctggtatgtgtggtgaaatggccggcgaccaaactgctgtaccattgcttatgggtatggggcttgacgaattctcaatgtcagcaacatcagtactccaaacacgttcacttatgaaacgtttggattctaagaaaatggaagaattgtctagcaaagctttgagcgaatgtgcaacaatggaagaagttattgccctcgttgaagaatatactaaataatattttcaattagtttcgaatgataagcctgtcaattaatgacaggtttttttaaaaatagtctgtttagctataatagattttttagaagtaaaaaaacttatccacggggataagtttttttctatcaaatgaatttgaaaagagtataataataagtggataaggagttttatgaaaaagctaaatttttttgattattggctaattggagaattaatcttttgtttaatacttctcttaattttaccccagcaaattaagctgaatttctggataattctgacgagtaaagaaacaagcggttcagtcttgaatatttttgtgcttcctcttattatggctcttcctaatattattcaacgctctgtcagtaagagtggcatctactggtcaaaattgagagtaactaccctgattttcaatattatccttcttttattgaccactttttggttgctgacactgccttttggacaataaaaaaattactgatgaaaagtcgagtctctttgtactctgagagtttatagagagactctgacaattctgtcagtaacttatagaaaggattaaaatggtaatcctttagtgaattttccgagtttttgttctgtaactttttcaatttgactaagtgcatcattaaccgcatcagtaaccatatcttgtaaagtttcaggatcttcagggtcaataacatctggattaatgttaagagatttcaaggtgcgatcaccagaaaattcaaccgttacaaggtcttgagcagatttaccaacaaaagttgtattggcaatttcttcttgtgaaacttgcatttgtttttgaagtttttgtgcttgtttcatcattgattgcatattcatcatggaaatgtatacctcttttagaaattttgttgaaaggctttcaacaccttactattttaccataaaaaagataataaaaaaaataagctaacaaaggagaaagaaatgaaacttactaaaaaccaagaagaactacttaatttgatttatcaagttgtgttagagcaaacggtcagtccgaaagaacgcgagtattttattgatgctaaaaagcgcattgaattaggtaaaaattttgatagcgaaatgagtgaactcttaaaagaattgatgtatattcccaattctccagtggtgaaccaatttacagaagaagcgcgtaaaaggatgttggtaggcccatcaacaggagggacaactcatggctttttaaattatcaaaccaaaaaatgaataaaaaagtgattttattattgtaaaatcactttttgaattactaagggtgggtcagtacataattttagaaaataaaaaaactcagccttagctgagttaatattagtgcggtgggcgggacttgaacccgcaccaagaaaattcccgacaggatccttaatcctgcgcgtctgccaattccgccaccaccgcaaaacagtacctaaatataataccatttttcgccttcttctgtcaagaaaaaactcataaatcactgatataaaagtcaataaattacggattataagtcttcataaattttgaaattgtttgacgatagagtgtgggatttgtttcgaaagaccgagcgtgagcagcatttttaacaactaacatttctttgggcgttccgggcttgactgatttgtagttctcatagaccattgaagttggaacatatgtatctttgcttccatgaatcaagagaatgggaagtttatctttggctagtgctttagttgcgctagcttcttggaaaacccacccttgtcgaattttgctttcaagagaaacgctgtaaaccagtgggaaagctggaatgttatagctttctttggcttgatatacaatttcatcccaagcgttagtataaccacaatcttcgataatattttttactgatgatggtaaactcttttcgctagaggccatcattacggtagaagcgcccattgaaagaccataaaggctgatatgactttcgggatttttgtcagttaaatattttgcccaagcgatcacgtcaaatttatcatggtagccaaaagtaataaaattcccctgtgaatttccggcaccacgattatctggcatcaagacattatagcctaactcatggaaaagttgaccataatgtcgcatcgcagatttatcctgacgaaagccatggacgacaatcacagtattattggttttttgttcagctggcacataccaagcatcaagttttaaatcattatttgtcaatgtttcggtagattttggtagtttattaaatttttgaaccagagaataattaggacttgaagttttgacttgtccaattggttgattattccggacacaagcaatttgataaaaatataaagtagcccctaaattaaggattaaaaggacagatataatagcaattaatatagtccaaattcgttttcttagcgattttttcatgaatttcattatacatgaaaaaatgttataaaaccaatataaaaaatctataatgtcgtacaattttcgtggtggatagattaatgtgtgtttttgtgataaacttattctgaaagtaattttttgtgaaggagctttcaatgattgaaaaatgtaaggagtggaaaaagctaaacatgaaaaaaggaataatagcatttttgacagtattgacaattttgctaacgggagcggtcaaagtttcagcagactcaacacaggcagaaatttatcgactttataacaagaataccggagagcatttttatacaagtagtgcctttgaacgagattctgttaacaaatcaggttggtcttacgaaggagtaggatggattgctcccaaaaaatcatcaacgccaatttatcgagttttcaatccaaatgccaaaggtggagatcattactacaccaaaagtaattatgaagctaaccaacttgtaaaaaaaggatggaaatgggataacaaaggtcaaccagtattctattctggagggaatattccagtatatgttgcatttaatcctaatgccagctctggttcacacaacttcacataaaattcaaatgagcaaaagaaccttcttaattctggatggaaatatggagcggtcgcttggaactctgaagcttggataagtccaaaaccacaaccttcttggaagccaggcgtttctcgtttgtacactattccaggagttgcccgcaccgtttttggtgacaatatcatggaagagtcaaatgtcagtaaattaggacctgtaacagtagaggtaagtgccgatttaaatcttactggctctggacgaggctatcatgggaaactgatgctaggtgatatgaacggtagcaatgtatccttcgggattcagtatgatgccaaaagcggtttagatgatggtcaatgggctggaaaaggagtctatttatcagaaaatgttgcaggcggaggagtacatgaaggcggaaatgctttatacgttgcctatggaccagctcctattgggaaaaaagttcacctcagtttggcttattatcaaagccgtcagcttgtagcattctttgctgatggagtattgatgggtagtcaaaaagttagctttaatgccacgaaatcaacgacaaatgccatcctaaatcaagatcgcacaggtttgacagaaacaaatgcactctatatgattagtgcgcaaggggcgactgcttttggaggagattcaataaatgcagtatttaccaatattaaaacaggaggagttcctgtgggatatgaagactgggtagataaacctggaaatggtgcgctcaattggtggaacatattggctaaaaactattcaagcacttaccaatcaaatggtatcgcagatagccaaaaaattccagaaaatgcccaagtaacagttaacggaacttgcaacctacctgctggttatgactgggattcattcccaggagcaaaacaaccgacgggaggaattcaaattccaacaggaatccctcttaactaagcggttcgagtttaggctccaaaatttcaaaaaattatttagcattttttgaaaaagtgtgatagaatgaagaaaatagaataaatactccaccgggagttaaatcgtatgaacgattgtttgcatttcagtaggtctgagaagaaatgtagatagtcgttctttttttagctgaggaggcgaaaatgacttggatatatctactaatagcaggaatttttgaagtggtttgggcaacaataatgaagttaagccacagattttcaaatataaagtttacattattaacaatcattgggatggttgctagttttggctttctcgccctagctctaaaaaagcttcccttagggattgcttatccaatttggacagggattggtgcagtgggctctatcttaattggtcttataatatttaaggataaagttccgccattaacatggcttttcattgcctgcttagttgtggggattattggaataaaagtaacaagcggtcattaaagttgacacagccttttaattttttagtatatagatttcatgatataataagagaattggtaaaaaataaaagaaatagcaatagctgagtctatttgctatttttgaatgaggaggaaaaaatgaaaaacaaaaaaagcataatgaatttagcaatttctaatctgttcttagtatttttgggtgcaggtttagtcattcctgttttgccaacccttaaagaacaaatgcacttttctgggacaacaatgggaatgatgatttctatttttgccattgctcagttaattgcctcaccgatcgctggtgctttatctgataaaattgggcgtaaaaaactcattgcgatcggaatgattattttttctttttccgaacttttatttggactggcgcaagcgaaaacaggcttttatatttcacgagctttaggaggcgttgcagcggcaatgctgatgccatcagttacagcttatgtggctgacatgactacaatttccgaacgccctaaagcaatgggactcgtatcagcggcaattagtggtgggtttatcattggacccggtgtgggtggattcatcgctcattttggtatccgtgttcctttctacgttgcagcaattttagcttttattggttttattttaacaataacgattttaaaagaacctgaacggacaatggaagccaatcatgaaaccgaaaaagtttcattccttgatattctcaagaacccattatttggctcattatttatcattattttgatatcatcatttggattacaagcttttgagtcaatttatagtatcatggcaagcattaactttggatttagcatgggggaaattgctttagtcattacagtaagtggtattctggccctctttttccaactctttttatttgatacaattgtcaataaaatcggagaacttggtctaattcaactgactttctttgcaagtgcaatttttatagcaattattgcatttacgaaaacaaatttagttgtggctctttcgacctttgttgtattcttagcttttgacctgttcagaccagctgtgacgacctatttatcgaaacatgctggaaatcgtcagggagcaattaatggtttaaattcggcctttacaagctttggtaatatcttagggccaatggctgcaggatatatgtttgatattaatcatctattcccttactatatctctgcgattattttacttggaacaggatttttatcattattcttaaatagaaaaaattggggtaaagcttaaatcacttttcagatagaaagtctacggtcattcgtaggcttttttctttatattcaagacttctagagaaattataaaacattaaaaaacttcattacatttttttattattattaaataaaagtaggattacaataaaaggtaataaggtaatccgaaaagcagaaattctgttgatttttaagggtacataaactatactaatatcagcaaaggatgggaagattctattttaaatgagaaaaaatgattaatatagactatcctcagtattaatatctaagaaaatgagaataaaataatatgaaattatcaattgttgtttactcaatcttcacagatggttggattcattgaaagagtcgctaaaaatgaaagaacggataaaaataatatttttgttaattccacacaattagctgatggcgtgattgtcaaaataaaaggtgattattataaagttaatcttagtactgatcagcaatcatatacccttaccaaaagttacttgattaatccagaaaaataaaaaatttaggagttataatgcaattatacagtccaataatattaaaatttgctttagggattatttgtttaattattcaaataaatttaatgggtaaaggtaatcttgctccctcatcagcaatggaccaagttcaaaattatgttttaggtggaattattggtggagtcatttataatgattctattacggtcttacaatttgtcttggttctaatcatatggacgctgttagtattaattttgaaatttgcaaaggagcacaatcgctatgtaaaattaatcattgatggtaaacccttgactctaattcaagatgggaaagttagagtaaatgaatgcctcagaaatggaatctctgctaatgaattaatgtttaaattacgttccaatggtatctatgagatacataatgttaaaagagctattttagagcaaaatggtcaattgacattgattgaatttggcggtgaaaatattaaatatccaattattgttgatggacaagcaaattttgacgttctcgaattaattgataaagatgaagtttggcttgaacaacaaattaatctgcaagggtacaaccaaatcaaggaaatttatttaggtgaatacttatcaggtgaacttaagctttacggatatacaaagtaaatattagcaggtgaatacttttcttttaatttaaatttagctaaattatagatggatttacaaatgataaaagtctcaaaagatgattatttattgtcgctatattgataataaagatataaattttataaatagaattttgatactgtaagtaaaacaattgaaaaatccttagaaatctttataataaaacataaatccctttcgttttacaaatttatattgtagtccaaagggatttttgataaaataagcaaaactgaaaagatgaaaactagaggtcttacaaatatgtaaggaaaaaaatcggaaaagtattaaaataagatattgatgtattcatttgagtaagtatagaaataaaaaatatctgagggaagtatagatgcctgaaaataagaatttcagtcggcgtagtaaaaaagaaacaggaaagaaaagtttaaaaattcctaaaatacgccctaaaaaacaaaaaaaacttgaagaagaaatagaaaaaccagctaaaactaaatttggtaaatttatgagatcgataaaacgtttctggaaacgttataacttaacaaaaattacaattatttttgttttggtagcgatcgttgcgacaggctcatatcttttttacttggctaaaacagcaaatgtgaaggttctacaaagttctatttctgctcagacagttatttatgataaagataataatgaagctggaaatctttatggtcaaaagggaactcctgttaagattgaccaaatttctaaaaatattacgaatgctgtagtggcaacagaagatagaaccttttatgaaaaccacggggttaatttgaaacgttttgctctggcggcagtaacacttggtcgttttgggggtggttcaacaattactcaacagttggctaaaaatgcttacttgactcaagaacaaaccattgaccgtaaggcgcgtgaatttttcttggctcttgaaattaacaaacactatagcaaagatgagattttagatatgtatttgaataactcttactttggtaatggggtttggggaattcaagatgcagccttgaaatattttggagttccagccagtgaagtaactgttgatgaagcagccagtcttgccggaatgctaaaaggtcctgaaatttataatcctttatatgaaaagggaaaatatgccaccgaccgtcgcaataccgtcttacaaaacatggttaatgctggctatcttgagcaatcacaagcagatagctttatgaaggttgatttacaagctcaattgcaagataattatcaatctaaaagtagtcagtacaaatatccaagctactataatgcggtaatttctgaggctgaacgtaagtatggtttaaccttacaagaaattatgaataatggctataaaatttatacgggaatggatcaaaatatgcagtcaggtttacaaaaaacctatgcggatccaagcttcttcccacaagcagcagatggaacctatgcccagtcagcatcggtggcaattgatccaaaaacaggagctgttaatgctctcgtgggtaatgttaatacagaaggttctaatagttttactgattataactatgcgacaatgtctaaacgttctcccggttcggtcatcaaaccattgattgtctatgctcctgcaattgaagcgggttggtcaattgacaaaacagttgatgactctccggctgattataatggttggaaaccaacggactttgataatcaatggcgaggacaaattccgatgtatacggctttagccaattcatataatattccagccataaatacctatcaagccattggtccaaaagttggaaatgctttgggacgtgaatttggtttggatttaaatagtaaaaatgatgttttaccaacggctcttggcgcaggagttgaaacaaatccatggcaaattgctcaggcttatcaagcttttgccaatggtggagtaatgaatgatgcgcatctcattactaaaattgaaaatgcagctggtcaagtcgttaaaacggcaaaagtaaacaaaaaacgtgtcgttagtaaagatactgccgataaaatgactcaaatgatgttagggacttacactaatggttctgcttggaaagcttcacctaaatcttatactttggcaggtaagacagggactaacgaagaccaagaccagtgggtagtcggttatactccagatgttgtgatggcgctttgggttggttattctgatggtaaatataaattgacaggttcatcagaaggacaaacgtcagtaattttccgtcaggaagcaagttatatgttgccttacaccaaaggaacacctttcacagttgaaaacccttatgctcaggcaggcgttgcagctcaacaaccttattggactcaacaaagacaatatcaagatgatattgtagaccaagaacaggcagaagcgaatacgactggaaatactccagaaagctctagttctagcacttcatcatcttctgattccaatggtttggacctaggtaaaattggtaaaaatattggtgatgcagctaaaaatgcttgggataaagttaaaggggtttttggcaactaaaagtaaaaaaaacactgaaaatatgataaaattaagaagaaagcgtagtagttttaagacaaaatgaacttaaagaataaagatagaaatcgagaaggaaaatgaagcgttacgtcacaggttttaatggattacggactattggagttttaacggttattctttatcacctctggccaaatcatgttcagggcggttttcttggtgtcgttttattctttgtcctttctggttatttggtgacggactctcttttaagggagtacgaaagaagtaaaaagattaatatttggaagttttggggcagaagaattaaaagactctatcctttattaatctcaatctttcttcttgtcacaccttatattattatcttccaacctaatttatgggctggcttacgttcaaactttctttcggctgttttttcagtgcagaactggtggcaaatttcgcaaggaagttcttacttcgctgatattgctggggcttcgccctttaaacatatttattacttagcaattgaaggacaatttttcatcatctggcctttgcttttaattgtattacttaaatttgttaaaaaacggggtcgaatttttatcattgctaatgttttagctattctttcagcaattttgatggcggtgctttttgttcctggggctgacccaacacgggtttattatggaacagatacgcggttctttagcttaatgatgggggcaagtttagctttcatctggcctttaaataaactttcgcataaggttaataaaaaggcaactaagattgcttggcagctgatcattggcttatctttagttctattggttgcttatatcttcatgccggctcaagggacattcgcttactatggcggaatgtggctggccagtctagcaagcgttatattagtagcactagtggcacacccaagtctaccagctaacaagctattttcaaatcctgtttttgaatacattggttcgcgttcttatggaatttatctttggcaacttcctgtttttgcctttgctgaggctaaagtattagcaccaacttcttggtacaatttgatttggcaattagcgctcattcttatcctgactgaactgtcatatcgtttgattgagttgcctacacagcgttttgattatagtaatgtttttgaaattgttcaaaatttcatccgagaaaaaggctggaagttgaaaaagaatattggaccaatgattctttctggacttattctgataagtttaggtttcataattttttcacctccttcaccacatgaccaaagacttattgaagaaaaaatcatggcccaacaagttgctttgcaaaagaaacaattagccgaagcgaataacaaggttcctctgtctttgaagacagttgcagaaaaatatgaaattcaaccagttgttgctgaaaaagcttcacaaatgaatgttctagcacttggagattcggtcatggttgccgcttcaacaaatttgcaagaggtcttcccacatatgtatattaatgcagcagttggtcgtcaagccgagtcgcttgcaacagatttaacgaatgctaaggctaaaatgcctaatccagatgcttatctgattggtctgggaacaaatggaacaattaaagaatctgaaattgaagccgcaatgaaggttgcagggaataaaccagtctattggatgaacattcatgccgatcgagtttgggcaaaacctaataataatttactgaccaaaacggctaagaaatataaaaacttaaaaattattgattggaataaaaaagcatcgggtcataacgcatggttttacagtgacaatatccatccaaaaggaacaggtgcagaagaatacgcgactttggtggcaaacagtctgattaaggtagcaaaatagtttgcgcttgtaaataatttttgatagaataagagataatatgttaagaaaagctggattagcgtgtaccgtttgtggttcacgaaattatacactcaatctttcatcagtagcgaaagaaaaacgagttgaagttaaaaagttttgccgtacttgtggcaaacacacattgcacaaagaaacgcgttaaatcgtattactttaataggatttgaacacgtcgaactgacagacttgtcagtaaacttttaataagaaatggactctgtcagtaataatgtggcagggataggaaaaggttatgtttaaatttattggtagcattgttgaagaaatgaaattgacaacttggccaagcagaaaacaatctgttcgtgatttttttatggtcattgaatatacagctttcttcttggtgtttatcataattttcgattgggtaactcaacatggaattacatttagtgttagccacttggtaccatttctcaaataagcgattaatctgtcatttttgacaggtttttcttttcttaactgacaaaagttcttttaattcaagataaatatgatataataatattatctgataagggcttggccctttttcttgtacccaaattactgacagaaatgctctagaagctctgtcagctgggatttcactaattacgtaaaaaaataaatacagaggtatttcaaatggaagataataatttagtaagttttgaccaaggttggtttgttattcaaacttatgcaggttatgagcgtaaagtcaaagaagatttgcttgaacgtgctgaactttataatatggcagataaaatcttgcgcgtcgaaattccaacggaaacaattcgtaccgaagtgaacggtaaaatgaaagacgttgaagaaaacttgttcccaggatatgttttggtcgaaatgaacatgactgatgaagcgtggtttatcgtgcgtaatacaccaaacgttactggattcgttggttcacacgggaaccgttcaaaacctacaccactttttgaacaagaaatccaagatatcttggttggtatgggcaaagttgttcgtgaaatcgactttgacgtttttgttggcaaacgcgtccgtattgttgatggagccttttcaggatttgaagcgccaattactgaaatcaatggcgataaattgactttgactgttgatatgtttggtcgtgcaactccagttgaattggacatgcaccaaatcgaagatattcaagcctaattaattattataaaaaaagccacgagaattcgtggctttttgcgagtttacagaatatttgttataattataaaaaatgtgattggggaataaatatcatggtaactttttatcaatcaacacgggataaatcaaataaaaaaacagcctcacaagctatcttgcaaggtttggcagaagacggtggactttttgttcctgttgacttcccaaaagttgatttagactttgaaaaattaaaaaacgcttcttatcaagaaattgctgaacttgttttgaaagcattttttgatgatttttctgctgacgaaattaaatcaatggttacaaaagcatacggagaaaaattcgatagtccggaaattgcaccgcttaaaagacttgggaatcactatattcttgaactttttcatggtgaaacgattgcttttaaagacatggcactctctatcttacctcatttaatgacccaagcggctaagaaaaatggtgtgaccaatgaaattgttatcttgactgcaacttctggagatacaggaaaagccgcaatggctggttttgctaatgtgccccaaacaaaaattattgttttttatcccaaaggtggtgtcagccatattcaagagcaacaaatgctgacccaaaaaggggctaatgttcacgttgttggaattgatggaaattttgaccaagctcaaacagcagtaaaagaaatgtttaataacaaagttttacatgatcaacttttgaaaaataataaacaattttcgtcagcaaattcaatgaatattggacgtttgattccgcaagtcgcttattatatttatgcttacgcacaactggtcaaaactggtcaaattactgacggagaaaaaatcaatttttcagttccgacaggaaattttggaaatattttagccgcttattatgctaaaaaattgggcttgcccgttcatcagctcatctgtgcttcaaataaaaataatgtgctgacagactttttcaaaacaggactttatgataaaaatcgagaattttatgtgacaagttcaccgtcaatggatattttggtttcttcaaatcttgaacgattgatttttgatttaactgacgagaatgatgatgagactttggctttactgacagctttgtcagcagaaggtcattatcaaatttctaaaaaaatgatgagtaagttacaaggttttatagctgactgggcatcagaagaagaaatttcccaagaaattaatgaaacttttgaaaatgaaaactatgttcttgacccccacacagcggttgcaaactatgtctatcatcaaattcaaccaaaagaaaaaacagttgttgtcagcactgccagcccttataagttccctaaagttgttttagaaggacttcaaaagtcaggaacggacttgtcagagaagatagatgattttgctgccgttaaatcacttgaaaaactcagtggtattccattacccaaagctgtgttagggcttgaaaaagctgaaattttgcatcatacagtagttccagttcaggaaatgcaaaaagaagtagagaaataccttggtttaaaatgaaaacaaataaagaaatattaaaattcgcccttcctgcgattattgaaaatttcttgcaaatgttagttggtgtgagtgatacaatgattgttgctcaccttagtctttctgctgtggccgcagtttctcttgcgaataatttaattacggtatatcaggcaatatttatcgccctaggaacaattatttcaagtttatttgccaaggtacttattgaaaaaaaggcaaaagaaaagctaaaggaattaattaattctgcaactaaactcaccgttttaatcggtttagtttttggtctattttccctttttgctgctcaaccgattctttatttgttgggggctcgtcagcaagttttagaactttcaatcatttatctgagtttagtgggtggtttgattgttcttttagctttaatgacaacttttggagcctttttacgggctgatggaaatacaaagacacccatgtgggcgtctttctttgcaagtgttctaaatttattattttcaattgtttttatctttgtttttcatttaggcgtcttaggaacggcacttggagcagttcttgccagagtaattgggacagctttcctctattataaattaaaagaaaaacggcccagtcttcaattttataaagtaaaactcaatcgtcagttaatcaagctaagtctacctgcggcaggagaaagattatccatgagattgggtgatttattaatcatgatgattattgtccgtttaggagaacgtgtctttgcggggaatgcaattggcgagagcattacacaatttaattatatgccagtctttggaatggcaaccgtgacagtgattttagtagcacaggcaaccgctgaaaataatattgaaaatattaaatcttacatcaaaaaaacttactggttggcaacaagtatgatgtttgtcattggattagttcttttactgacagccaatatgctaaatcatttatttactactgataggattgccatgggcgcaagtacgatagtcatcttattttcttttttagcgactttcttcgtcacaggagcgacgacttatacggcggcttttcaaggaattggaaataccaaacttccgttttatgcaacaactttaggcatgtttggcattcggttaatcttaggcgcatttttagctttagtattgaagctaggcttagaaggtgtttggttagcggtcttgcttgataacttttttagattcgtttttcttaagataaaatttaagaaaacactcataacagaaatttaatcaataaaaaaactgacaagattttgtcagtatttttattattttttcaacaagtcgcgaatttcttggagagtttccaattcttcgtttttttgttcttcaacaatttcttcctttttagggaaaagtttgttgataaattttataagaacgaaaataacaaaagctgtaatgacgaaattgataacatcgtttaagaaagctccgtaagtaaatttagtcttaccaacagttactgataagtgggcaagagcgctgctttggacgaacattccaatcaaagggttaatcaaattatcaaccaaagatttaactaaagcagtaaaagctgccccgatgataaccccaacggccaagtctaagacattgccacgcaaaataaagtttttaaattcctttaacataaatcctcctatataaatagtttataaaacctttaatcaaattatatcaaaaagtttaaagatgacaaagtgtgggttcttgtctttttcagtaaattcattgattttatttaaaattttaaaagatatataaaaagaactggaaagaataaaaaaagtctaaaaagtccttgacaaggcacatctcctttgatagaatagacaagtgctgttaaaaacagtatgtagcgacgaaacgagaggttgcgacacacccgaaggtattgccatacctaacgtgtcggttttcccgtggagctagcctattgaatacaatagacgagaggagaaaaaatggcaactaaaaaaattcgcattcgcttgaaagcatacgaacatcgtatccttgacgcagctgcagaaaaaatcgtagaaactgctaaacgtacaaacgcagaagtaagtggtccaattccacttccaactgaccgtagcgtctacactgttatccgcgcgactcacaaatataaagactcacgcgaacaattcgaaatgcgtacacacaaacgcttgatcgacatcatcgaaccaacacaaaaaactgttgattcacttatgaaactcgatttgccaagtggtgtaaacatcgaaattaaactctaattaagaaaggtaattctcatgtcaaaaggaatcttagggaaaaaagtgggaatgactcaaatcttcacagacaacggtgaattaattcctgttactgtgatcgaagcgactccaaacacagttcttcaagttaaatctgtcgaaacagacggttacgaagcaactcaagttggtttcgatacacttcgtgaagttttgaccaacaaacctgccaaaggtcatgctgctaaagctaatacgactcctaagcgcttcgttcgtgaattcaaaggactcgaaggcgctgaagtaggagcagaaatcactgttgatacatttgcagccggagatgttgttgatgttaccggaacttctaaaggtaaaggtttccaaggcccaatcaaacgtcatggtcaatcacgtggtcctatggcccacggttcacgttaccaccgtcgtcctggttcaatgggtcctgttgcagctaacaaagttccaaaaggtaaaaaacttgctggacgtatgggtaacaaacgcgttactgtacaaaaccttgttattgcacaagtgcttcctgaaaagaacgttatccttgtaaaaggtaatgtcccaggtgctaagaaatcattgattgttgttaaatcagcaatcaaagctaaataagaaggaaaggagatagaaatctataatggcaaaagtatcattatttaaacaagatggttcacaagctggtgaagttacacttaacgactcagtatttggtatcgaaccaaacgaatctgtcgtattcgacgttgtaatctcacaacgcgctagccttcgccaaggtacacatgcacacaaaaaccgttctgctgtatctggtggtggtaaaaaaccatggcgtcaaaaaggtacaggtcgtgcccgtcaaggttctacccgctctccacaatggcgtggtggtggtactgtcttcggaccgaacccacgtagctacgcttacaaacttccacaaaaagttcgtcaattggcgcttaaatcagtttactcaacaaaagttgctgatggtaaattaatcgctgttgatacacttgactttgcagctccaaaaactgctgaatttgcaaaagtaatttcagcactttcaatcgaacgtaaagtacttgtggttcttccaaacgaaggtaacgaatttgcagaactctctgcacgcaatcttgaaaacgtgaaagttacaactgctaattcagcatctgtacttgacatcgtttctgctgacaaactccttgtggttcaatcagcattgacacaaattgaggaggttcttgcataatgtcactttatgatatcatccgtaaacctatcattactgaagcttctatggctgcaatggatcaaaagaaatacacttttgaagttgattcacgtgcgcataaacttctcatcaaacaagctgttgaagctgtctttgatgtaaaagttgcctcagtaaatactatcagcgtaaaaccaaaatctaaacgagttggtaaatatactggtactaaatcaggctacaaaaaagctatcgttactttgactgaagattctaaaacaattgaaatcttcggcgaagacgcagaataatagaggaggaaaatcgtgggaattaaagtttacaaacctaccacaaacggtcgccgtaacatgactggtagcgacttcgctgaaatcactacaagtactcctgaaaagagcttgcttgtaagcatgagcaaaacagctggtcgtaataacactggtcgtatcacagttcgtcaccacggtggtggtcacaaacgtaaatatcgtatgatcgacttcaaacgtacaactgacaacgtagttgctaaagttgctacaattgaatacgatccaaaccgtacagcaaacatcgcattgattgtttacgctaacggggttaaatcatacatcttggctgctaaaggccttgaagttggaatgacagttgtatctggccctgatgccgatattaaagttggtaacgcgttgccacttgctaacattccagttggtacattgatccacaacattgaattgaaacctggtaaaggcggacaattggttcgttcagctggtgcttcagctcaagtactcggttcagaaggtaaatatacactcgttcgtcttcaatcaggcgaagttcgtatgattctttcaacttgccgtgctacaattggtgttgttggtaatgaacaacaaagcttaatcaaccttggtaaagcaggacgtacacgtcacatgggtatccgcccaacagtacgtggttctgtaatgaaccctaacgatcacccacacggtggtggtgaaggtcgtcaaccagttggtcgcaagtctccaatgactccatggggtaaaccagcccttggtctcaagactcgcaacaagaaagcaaaatcaagcaaacttatcgttcgtcgtatcaacgactaataagtcgctttattttcacaagagccttctcggcgtcttgttaaatttgataaaacttattatcaaatttaatgagatgtcgaaagtgcatctataaattccgccaactccgccttagtagcggcagtggtacaaatatttaaaggagaaactcgcaaaatgggtcgtagtcttaaaaaaggacctttcgtcgatgagcatttgatgaaaaaagttgaagctcaaaccaacgccgaaagaaaatctgtgatcaaaacttggtcacgccgttctacaatctttccaaactttgtaggacttacaattgctgtttacgatggtcgcaaacacgtaccagtttatgttcaagaagatatggttggacacaaacttggtgaattcgcaccaactcgtacttaccgtggtcacgctgctgacgacaagaaaacacgtcgctaataggaggagaaaaaaatggcagaaattacttcagctaaagcaactgcaaaaacagttcgcgtttcacctcgtaagactcgtcttgttatcgatcttatccgcgggaaacgtgttgcagatgcaattgcaatcttgaaatttacaccgactaaagctgctgtagaagttgaaaatgtacttaatagtgctatcgctaatgcagaaaataactttggtcttgaaaaagctaacttggtagtaagcgaaacattcattaacgaaggtccaacaatgaaacgtttccgtccacgtgccaaaggttcagcttcaccaattaacaaacgcacagctcacattactgtagttgtagctgagaaagaataaggaggtaaaaacgtgggtcaaaaagtacatccaataggaatgcgtgttggcgttattcgtgattgggatgccaaatggtatgctgaaaaagaatatgcggattaccttcacgaagacttggcaattcgtcaacttatccaaactaaacttgctgatgcatcagtatcattgattgaaactgaacgtgcaattaacaaagttattgtaactttgcacactgctaaaccaggtatggttattggtaaatcaggagctaacgttgatgcactccgtgcagaactcaacaaacttactggtaaacaagttcacatcaacatcgttgaaatcaaaaaacctgatttggacgctcatcttgttggtgaaggaattgctaaacaacttgaagcacgtatcgctttccgtcgtgctcaaaaacaagccatccaacgtgctatgcgcgctggtgcaaaagggatcaaaactcaagtttctggtcgtttgaatggtgctgatattgcccgtgctgaaggatattcagaaggtacagttccactccacacactccgtgcggacatcgactacgcttgggaagaagcagacacaacttatggtaaactcggcgttaaagtttggatctaccgtggtgaagttctccctactaaaaaatctgtgaaaggagaaaaataatccatgttagtaccaaaacgtgtaaaacaccgtcgtgaattccgcggtaaaatgcgtggttatgctaaaggtggcgacacagtatcattcggtgaatatggtcttcaagcgactacatctcactggattactaaccgccaaattgaagcagctcgtattgctatgactcgttacatgaaacgtaacggtcaagtttggattaaaattttccctcacaaatcatacactgccaaagctattggtgtgcgtatgggttcagggaaaggtgctcctgaaggatgggttgctccagttaaacgtggcgttgtcatgtttgaattgggcggcgttgatgaagcaactgcacgcgaagcgttgcgtcttgcatcacacaaacttcctgttaaaactaaatttgtgaaacgaggtgaagcgtaatgaaattgagcgaaactaaatcacttcttaaagatttgcgcgctttgtcagttgaagaattgacaactcgtgaagctgaattgaaaaaagaattgtttgatcttcgtttccaagctgctgctggtcgtctcgaaaacacagctaagcttgacgaagtcaagaaaactattgcacgtgtaaaaactgtgcaagctgaattgaacaaataataggtcaggagaaactataaatggaacgcaaacaacgtaaagtttatcaaggccgcgtggtttcagacaaaatggataaaactatcacagttgtcgtagaaactaagcgtaaccaccctgtctatggtaaacgtatcaactattcaaaaaaatataaagctcacgacgaaaacaactctgcaaaaactggcgacatcgttcgtatcatggaaactcgtcctttgtctaaagacaaacatttccgtcttgtagaaatcgttgaagaagcagttattatctaagcaaaactaggaggaatatagcatgattcaaacagaatctcgtttgaaagttgcagataactcaggtgctaaagaacttttgactatccgtgtcctcggtggttcatcacgtaagttcgctggtatcggtgatatcgttgtagctacagttaaatcagctgcccctggtggagcagttaaaaaaggtgaagttgtgaaagcagtcatcgttcgtactaaatctggtgcgaaacgtcctgacggttcatacatcaaatttgatgaaaatgcagcagtgctcatccgtgacgataaaactcctcgcggaacacgtatctttggcccagttgcccgcgaactccgcgaaggtggctacatgaagatcgtttcacttgctccagaagtactctaatcaagcattatagagatatggttttgtcggaaaaattttttgacagagtcatattttactgttattattaacagaatagtcccctgatagtaaaatatgagggtgcccatcgggcgtaagaaaggaaataaacatgtttgtaaaaactggtgatacagttaaagttatcgcaggtaaagaccgcggtactactggtaaagtaatcaaagctttgccaaaagtaaataaagttgtcgttgaaggtgttgctatcatgaagaaacaccaaaaaccaaactcagaaaacccaagtggtgctattcttgaaatcgaagctcctatccacgtttctaacgtacaagtgctcgacaaaaatggcgttgctggtcgtgtaggttacaaagttgttgacgataaaaaagttcgtttcaacaaaaaatctggcgaaattttagactaaggcggaaaggagaaataatatgactaatcgtttgaaagaaaaatatactaacgaagtagtaccagcgttgactgaacaattcaactacacttcaatcatggctgtaccaaaagttgataaaatcgttatcaacatgggtgttggagatgctgtaaacaactctaaaaaccttgataaagctgttgctgaattggctttgatctctggtcaaaaaccattgattactaaagctaaaaaatcagttgctgctttccgtcttcgtgaaggtatgccaatcggtgcgaaagtaactcttcgtggcgaacgtatgttcgaattcttggacaaattggttactgtttcactcccacgtgtacgtgacttccacggtgtttcaaacaaagcgtttgatggtcgcggtaactacacacttggtgtgaaggaacaattgattttcccagaaatcaactatgatgatgttgataaagttcgtggtatggacattgttatcgtaacaactgctaacactgacgaagaatcacgtgaattgcttgctaaactcggcatgccgttcgctaaataagatagggagaatacataaatggctaagaaatctatggttgttaaaaaccaacgccctgcaaaattctcaacacaagcttatactcgttgcgaacgttgcggacgtccacattcagtttaccgcaaatttaaactttgccgtatctgtcttcgcgaattggcttacaaaggtcaattgccaggcgttaaaaaagcttcatggtaatttgttaattatcgtgtaacgaataaaaattactgacaggatttctgtcagtaatttttttataccttagaagtattatgaaaacatggtctatttatagtggattaaaagtgagaatttgctataatggtgaggaaataggagggatttatgaaaaaaatatcagctaatattaaaaagtttgtaggaattagcctaattcttttaggaactttaaccgttttatcggcctgtggcagtaaagaaagtaaaaagtctgaacaaagcagctcctcttcaagtattaaaaataatgaaagtattcaaagtagtagttcgtcttcaagtacaagttcatcaaattcaagttcttccagtcaggaaggatttggaaacagttcacaaattctttcagggaattattcttctttgaatggaacttggcagactgctgatggtacttctaaaattattttaaaaaacggtaacatcatttttagttcagaatatgtgagaataatatcaaatccaatagctaaggatggaataattattgctgatgcattgaatgacaaaagacacatgggctttatgtttgccgctgcttataattctccaatctttccaaattcctcaaatttagataagacagattcgggaaaagaccggcttataataactacggatgaagaaggcatagaaatatttgatacgatgccaacatcattttattataaggtaagtaatgataccacaagtttgagttcataagttataacaaattactggcgatcctgtcagtaatttttattctaaaaatccatgacacacccgaaaacattgtaaagaaaaatgttgacagagtgcggaacttctgctatactaattaagttcggtctttttatgaaaaagacctcattaatttgaaagtgggatttgaacaagcccaaactacaaataaggagaaattacactatggtaatgactgacccaattgcagatttcttgactcgtattcgtaatggtaacatgcgtaaattcgatgttgttgaagcacctgcatcaaaaatcaaacgtcaaatcgctgaaatcctcaaagctgaaggttacgtgaaagacgttgaatacgttgaagataacaaacaaggcgtaatccgcgtttttcttaaatacggtaaaaacggtgaaaaagttatcactaacttgaaacgtatctcaaaaccaggtcttcgcgtttacgtgaaatctgatgatgttcctaaagttcttaacggacttggtacagcaatcatctcaacatctactggtgtcgtaactgataaagttgctcgtcaaacaaatgttggtggtgaagtaattgcctacatctggtaattattttaggaaaaacttcattttctgaagttttatcctcacattcgacacttctaaatgctgtgttgaactgacaagcgatttttcgtaagtcaaatttactgacaaagataattttatttttgtcagtaaaaaattatatcttttaagtcaaaattgatttaaaacccgtgaaaacagattgaatcaaatctgataatttaacaggagaaaaaaatgtcacgtattggtaacaaagtcatcgttatccctgcaggcgtaactgtagaagtaaacggtgcaactgtcactgtcaaaggacctaaaggtgaactcgttcgttcattcaacgaaaacatcacacttgaaattgctgaaaacgaaatcactgtaaaacgtccaaacgacactaaagaaatgaaaatgctccacggaactactcgtgcccttcttgctaacatggtagaaggtgtttcaaatggtttctctaaagcacttgaaatgatcggggttgggtaccgcgcacaattacaaggaactaaacttgtattgtctgttggtaaatctcaccaagacgaagttgaagcacctgaaaacattaagtttgttgttgcaactccaacttctatcgtcgttgaaggtatcagcaaagaagctgttggtcaaacagcagcttacatccgtagccgtcgttctccagaaccttataaaggtaaagggatccgttacgttggtgaatacgttcgtcgtaaagaaggtaaaactggtaaataatttttgcgtcgggcttgcgtcgttagcttttgctttatgtacgtcagtacgattcagcacggacttcgtcctaaaagctgcctagcaatcctttagcaaaaaatgttatccgtaattggtggtttgatttaggtcaaattgccagtattttgtcaatgctaactttgttagacagacaaaaactccccgcttgctaattattttattaatcagtaagaaaatcgatggcaaaaactatcgaaatttaaaataatatagaggtagaattgtgatttctaaaccagataaaaacaaactccgccaaaaacgtcacacacgtgtacgcggaaaaatttcaggaactactgaaactccacgtttgaacgttttccgttcaaacacaaacatttatgcacaagtcattgatgacgttactggtacaacacttgcatcagcttcatcactcaaattgactggtactaaaactgaacaagccgcagaagttggtaaactcgttgctgaagctgcaaaagctaaaggcgttgaagaagttgtcttcgaccgcggtggttacctctatcacggacgtgttgcagcactcgctacagcagctcgtgaagctggattgaaattctaaggaaaggggtaattaaacatggcagaaaacagaagaaatgatcgcgaacaaagcgaatttgaagaacgcgtagtttcaattaaccgcgttactaaagttgtaaaaggtggacgtcgtcttcgctttgcagcacttgttgttgttggtgaccgtaacggtcgcgtaggtttcggtactggtaaagctcaagaagttcctgaagctatccgtaaagcaatcgaagcagctaagaaaaaccttattacagttcctatggtaggtactacacttcctcacgaagcacttggtgtcttcggtggtggtaaaatcctccttaaaccagctgtagaaggtgctggagttgccgcaggtggtgccgttcgtgccgtcctcgaactcgctggtgttgctgacgtaacatcaaaatcacttggttcaaatacaccaattaacgttgttcgtgcaacagttgatggtttgactcaattgaaacgtgctgaagaagttgctgcattacgcggtaaatctgtatcagatttcgcctaaggaggaaaaaatggctcaaattaaaattacattggtaaactcaccaatcggccgtatccctgctcaacgcaaaactgttaaagcactcggtcttggtaaactcaacagctcagtagtaaaagaaggttcacctgctattcttggtatggtaaactctatttctcacttggtaaaagttgaagaagcataattactattgcataaaataacaatcctatctttactgataggattgtttttttccttaaaaaatccgtcagtaatttaaaaacttgtaaattttatctcaccaattcaaaagataactttagaattgtaaaatgcaggacaaacgaggaaatggcttgtaattccaatcgaaaaatagtaaaataataggagtctgttaatagacaaataaatatattgaagtatcggcgagtttaattttcacgttccttacatgaaaattaggcgacagcaaggtacaaaataaggagaaaaaaatggaacttcattcattgaaagctgctgaaggcagtcgtaaagtacgtaatcgcgtaggtcgtggtacatcatcaggtaacggtaaaacatctggacgtggacaaaaaggtcaaaaatctcgttcaggtggtggagtacgtcctggttttgaaggtggacaaacagagttgttccgtcgcatgccaaaacgtggtttcttgaatgttaaccgtaaagaatacgctattgtcaaccttgaaactttgaaccgtcttgaagatggagcaactgtttcagctgaaactcttgtagctgctaaaatcgttaaggacgttaaatcaggtgttaaagttcttgctaacggtgaattgacagctaaaaaccttacagttaaagttgctaaagtatctgctgctgccaaagctgcaatcgaagctgctggtggttctgtagaagaagcttaatttttacatttcaattggcggttgaagcttcaaccgcttattgtctatttacaattaaaacgctttaaggagattttatgttttttaagacgcttaaggaagccttcaaggtaaaagacgtccgagcaagaattctctttacgatcttcattctttttgtttttcgcctaggtgctcacattactgtacctggcgttaatgtacaaaatctacaacaagttgcggatttgccattcttaagcatgatgaacttggtttctggtaatgcaatgcaaaactattcactctttgcaatgggagtttcgccttatatcactgcctcaatcattgtgcaattattacaaatggatattttaccaaaatttgttgagtggtcaaaacaaggagaaattggacgtcgtaagctgaatcaggcgacacgttatattaccttagtgcttgctatggcacaatctatcgggattactgctggtttccaagccatgagctcgttaaatattgtgcaaaacccaaattggcaaagttatttgatgattggggtgcttttgaccacaggttcaatggttgttacttggatgggtgaacagattaatgaaaaaggttttggatcaggtgtttcagtaattatctttgctgggattgtctctggtattccatcagccatcaaatctgtttatgatgaaaaattcttaaacgtaagaccatctgaaattcctatgtcttggatatttgttattggattgattttgtcagcaattgtcattatttatgttacaacatttgttcaacaagcggaacgtaaagtaccaattcaatacactaagttgactcaaggcgcaccaacaagttcgtacttaccacttcgtgtcaatccagctggtgttattccagttatctttgctggttcaattacaactgcacctgctacgatcttgcaattcttgcaacgttcacaaggtagcaatgtaggttggttatcaaccttacaaaatgctttgtcatatacgacttggacagggatgctcttctacgcattattgattgttctctttactttcttctattcgttcgttcaggtcaatcctgaaaagatggctgaaaaccttcaaaaacaaggttcgtatattccatctgttcgtccgggtaaaggaactgagaagtatgtttctcgtctattaatgcgtcttgcaacggttggttcgctcttccttggattgatttcaatcattccaattgcggcccaaaacgtttggggacttccaaaaatcgtcgctcttggagggacatcattattaatcttgattcaagttgcgattcaagcagttaaacaacttgaaggatatttacttaaacgtaaatatgcaggatttatggataatccacttgaaacaaaataaaatcttgtcattagacaaggtttttctttatttttcagtaaaaatacgctaaaatagtgtaggtaaaagacagtgcacatctgcattttactgacagagctgtcagtaatttataaaatcaaaatcaggagaaaacaaaatgaatttattaatcatgggacttccaggagctggtaaaggaactcaagccgaatttatcgttaaaaattatggtgtaaaccatatttcaacaggagatatgttccgtgcagcgatgaaaaatgaaacagaaatgggtaaacttgctaaatcttttattgataaaggtgaacttgttcctgatgaagtaaccaatggtattgtcaaagaacgtttagcacaagacgatatcaaagcttcaggtttcttgcttgatggatacccacgtacgattgaccaagcgcatgctcttgatacaatgcttgaagaacttggcattaaacttgatgctgttgtaaatattgttgttaatccaaatatcttggttgatcgtttaagtggtcgttacatctgccgtaattgtggagcaacatatcacaaaattttcaacccaactaaagttgaaggaacttgtgacgtttgtggtagccatgacctttaccaacgtgctgatgatgtaccagaaacagttaaaaaccgtttagatgtcaacatcaaagaatctgcaccaattattgaacattacactgaacttggacttgttaaaaatatcgaaggcgaacaagaaattagtcaagtgacagatgatattaaaaaagttttaggctaataaatcataaaacctctgtcagaggttttttattttaaatatgaaaaatgaaagataaaatttactgacagaaaagtcaacaagcttaaaaataaaaagaaacacccgaaagcattgccataggtactcttatcagataatctgaaaataaaaatggactcaggctagaaaaataaaggcttttatgaaagaaagacttgcatttgttgttgaaaaatgctaaaatacataagtccgactttttagatatatttaaatttgtatttatatctttcgggaaatttttaaggaggtacttttgcttggcaaaagatgatgtaattgaagtagacggcaaagtcgttgacaccatgccgaatgcgatgttcactgttgaactcgaaaatggtcaccaagtcttggcgacgatttcaggaaaaattcgtaagaattatatccgtatcttgcctggagacaaggttcaagttgaactctcaccatacgatttgacacgcggacgaattacttaccgatttaagtaatccggacattcattgagtgcatgatgcacagtaaccatagaaaggaagacacaatgaaagtaagaccatcagttaaaccaatctgcgaatactgtaaagttattcgtcgtaacggtcgtgtaatggtaatttgccctgccaatccaaaacacaaacaacgtcagggatagaaaggaaatagaaaaatatggctcgttttgctggagttgatattccaaacgaaaaacgcattgttatttcattaacatacgtattcggtgttggacttcaaacatctaagaaagtacttgcagctgcaggtgtttcagaagatatccgtactaaagatttgacatcagatcaagaagatgcaatccgtcgtgaactcgatggcttgaaactcgaaggagatcttcgtcgtgaagtgtcacttaacatcaaacgcttgatggaaatcggttcttaccgtggtatgcgtcaccgtcgtggacttcctacacgtggacaaaacactaagaacaacgctcgtacacgtaaaggtcctgctaaatcaatcgcaggtaagaaaaaataattaaatagaaaggagttaaaatggcaaaaattacacgtaaacgtcgtgttaaaaagaatattgaatctgggattgttcatatccaatcaacattcaacaacacaatcgttatgatcacagacgttcatggtaacgcccttgcatggtcttcagctggtgcacttggtttcaaaggttctaaaaaatctacacctttcgccgctcaaatggcctcagaagctgctgctaaagctgctcaagagcaaggtttgaaaactgtatctgttacagttaaaggtcctggttcaggtcgtgaatcagctatccgcgcactcgctgcagctggtcttaatgtaacatctatcagtgatgtgactcctgtacctcacaatggtgcacgtcctccaaaacgtcgtcgtgtataattagtcactcttgtcactaatcacttttcgctttagaggagaacatacatgattgagtttgaaaaaccaaaaattactaaatttgacgaatcagaaaattacggtaaattcgttgttgaaccacttgaacgtggttatggtacaactttaggtaactctctgcgtcgcgtccttttgtcatcacttcctggtgctgctgtgacttcaattcaaattgaaggtgttcaacacgaattcgcaacaatccctggcgtacgtgaagatgtcatccaaatcgttcttgcggttaaaggaattgccatcaaatcatacgttgaatctgaaaaacaaatcgaacttgacgttactggtcctatggatgttactgctggtgatatcttaactgatagcgacattgaaattgtcaacaaagaccattacttgttctctattgctgaaggtcactcaatgcgtgctgtaatgactgttaaaaaaggatacggctatgttccggctgacgaaaataaagtcgatggagcgccaattggcacaattgctgtagactcaatttacacaccaataagtaaagtaaattatcaagttgaacctgcccgtgttggtggagattctagctacgataaattaacacttgaaattactacaaacggtactatcgtttctgacgaagctttgtcactctcagctaaaatcttgacagaccacttgaacttgttcgttgatctttcagaagttgcagctgaagctgaaacacttgttgttaaagatgaagttaaaacagaacgtgtgctcgataaaattattgaagaaatggacttctcagttcgtgcttacaatggtttgaaacgtgcaggtatcaacactgttgctgatattgttgaaatgagcgaagctgacatgattaaagtcaaaaacctcggtcacaaatcagtagaagaagtcaaagttaaattgactgaattgggactttcccttaaaaaaagaaaataataatataggaggaaacaaatgagcaatcgtaaactcggacgtacatcttcacaacgtaaagctatgcttcgtgatttgactacagatttgatcatcaacgaaactatcgttacaactgaagctcgcgctaaagaagttcgtcgtacagtagaaaaaatgattacgcttggtaaaaaaggtgacctttcagctcgtcgtgcagcagctgcttacgtacgtaatgaaatcgcaattaaagatttcaacgaagaaactgaaactttcccaactgcccttcaaaaattattcaacgaccttgctaaacgctacgaaggacgtaacggtggttacactcgtatccttaaagttgaaccacgtcgtggtgatgctgcgcctatggcaatcattgaattggtttaattttattaaatcttgaagtaataaaatactaaattgagtgttatgatgttggcgggggtttctgtgggtgcatgtgttgagttgtgattgactctctttcgcatcagccttgcttatagtctagctctgtctgattagattaaatttctaatctggtcagaccactcaatttatttattttagccgttgtagctcagtcggtagagcagcaccatggtaaggtgaaggtcgacagttcgattctgttcaatggcatataaacttagacaaataaaaaaactcattttggattagatgagtttttttatttgtctaagtttttttgtaatcaaaaaagggcggtcaacaagattgcctttttcatttataaaaaatttgagaaatgttagggaattcactaaagaaaatgaacggaatagtgtaatgtgttgtatccttgtgattacaataaagaaataaaagtatagataaagaaaaaataacatgatttgttgacaaaaaatataataatgcgtaatatagatgtattagaaaagtttgactatttaatatatgtatctaaaaaatttgtaacatcctcaactgtaaaataatagaaatgctcaatcttttatgaaatagtatggagtgattgaaagctttagtggtaaccttttaccaagacaaaatgagagcagcaaaatttaaaaaattagaaattaatatatgttatgaatgaatatacatcaagagagtttgaattcaaaagcatcgtagacttgaaaaaggttgaaaacttcatactcaagtcaccgctttttgatattttgcagacaccatcatggagaaatgttaaagatgaatggaagtcagaatttttaggatttacggaaaaaggggagacagaacttttagcttcttgtttagtactgacgcgttctttacctctgggttttaaaatgtgctatattccacgaggcattatcatggattattccgatgatgagcttttaagctttgttgttttgaagttgaaagaatatggtaagaaagaaaaggcgctttttattaaatttgacccgcttattgaagagaattcggagggaaagcgacttattgaaaagttaactctattaggagtggcttatggaggaagaacaaaagaaattcatgaaacaattcaatttcgttttgatgcaacaatctataaagacgattatagctatgagaaactatcaaaaaagtttaatagtcgattaaataaagccaaaaaagcctttcctgaaattaagattggtcaagaagaatatagcgaggattttgctcgcttaatgacattaacagagacaagaaaagttataaatttaagagataaagcatattttgaaaaaattctagctgcttttcccaaaaattctgctattgttattgtttatacaaatgttaaagaacttttggatgaagtaaagaccgaaactttgaaattatcaaaaagaatcaaagatataagtaatgaaaagaaaaaagttcttttagaacatcaacttcttgaaaaaaaggctgaggtgaatgacttagaacaaatcataaaaacttcgggagaaattgtcccaagtgcaggaaatttaataatatattatggtgaaaagtcatacaacttgtatgtagggatggatgatgctttcaaaaaatattatgtttcttatctttcttgggatgaaagtataaagtatagctttctaaaaggagctttgatgcatgatatggggggagtagaggcagattctggaggtttacgctcttttaaaaaaatgtttaatccttcctttaaggaatatgttggagaatttgatattcctacaaatagacttctttatcctctaatcaaacgactctataaaatgcgaaaggataaaaagtagagaattatgcctaaaataagcattattgttccagtttataatagcgccctctttttagaaagatgtttagattcgattattaatcagacttttcaggatttcgaattaattctaatagaagatggctctgatgataaatctcctcaaatctgtaaacactaccaacagaaagatcgtcgtatccaactattttatgagcaacatagtggacagagtatagccagaaatctgggtctaactaaatctcagggaaaatatatttattttatagatagtgatgattatgttacttctgattatttggaacggctttatgaagtgatagcgcaagaaaaagttgacctagtaagttgtcagatgagaggggagagctacttaaaaagtttgacaccaaaagagaggggaaagctcacctatttccaaacaaatgatggtttaatggctgcctatcttcaagaaagtccgtttagttttggaccggttacaaaactttatcatcgagcattgctagaagggatatatttttctgagcataaaatatatgaggattactatttcaattaccagtatttttcaaagataagctcggcagttgcaattgattttgtaggttatttttacattcaaaatcaagagagtactgtaagaaaatcctttgatttaagacaacttgacaatattaccgaacaacataaagtaatcaaagaagttaaagaaaaatatccagaatacttacccattgctgcttataatttagcttggggttactattggattatcataaaatgtctggctttgcttaaagagaataaagcaaaatctaaagagtatttaaagcttatcagaaactatctcactgaagatcaagaaattttgcaaagagctcttgctcttaaaactaaaagagaaaagtggacgattaaaatggttaaatcttgtccgaatattatctggtgggcttataatataagattctatttcaaatgaagggcacctagaataataatgaaaaatataaaagtttcggtcattgtgccgatatataattcagaaaaacatattcgtacttgtctagagtctttaatcaagcaaactttaaaacccattgaaattattctggttaatgatggttcgactgatcgtagtattgaccatatctttgatttgattgaaaaatataattttattcgacttattgagattgaaaatagtggggcagctgaagctagaaataaaggacttgctcttgcgcgtggtaattatattagttttgtagacagtgatgattttgtgcattctacttttttagaaaaactttatcaagaagctgaaaataaaaaacttgatatcatttgtggaagtttcgaagcaacttacaaaaataaagtttccaagaaaatggaaagaaataacgaacttttgagggctggagtccaagaaggaatagtactttttaagaaacaaattcaactaagaaattatattccaatgatttgggcctatatgtatcggcgagaattcttaacaaaaaatagtctttggctttccccaaaaacgattcatgaagatgagaaattcacccctcgggtttggaaccttgccaaacgagcaaaaattatcgagactttcgagtacatttatcaaagagagcatgaggattctattattgagagtagagatgaaagctccgtcctagacttggaaaatatattaatttcttagttgaaatatgaagaaaatttatcaggaaaaagcaaagaatcttttgattatgctctgttatacgtactagatcattatgtttactatggccggatgacaaaaactcttaataaattgctgataaaaggcatttattctagattaaggcgagcaaaaatactaaccttcaaacaaaagataaaatattttctaataataaaaagcacttggctttattttttagttcaaaattatcaagaatgagaagtgaaatgaaaaaaataatagttgatatggatggtcgtttaggcaatcaaatgtttcaatacgcttatgccttgaaactaaaaaaagaaattccaaagagtgaaattattattaatttctatagaatttcgctttatggagatttagcaccaaatgagcaagggtggatgaataatcttcaatactttcatgcagattatcaactggatcagcaaaaattatcaaattttttaattcagtatttatcaaaaagacagtatttctggctaagagtaacaaatcgcctcttacatcatttatcatccttcaaaaggcactcatactttccttttgataaattgcctaactttctgaaatattatagtcgctttctgtatcgaaagggtttgttaatttatcctagtaagataaaagacttaaactatgagcctcaaaataaaacaatcttacttcattcatattttgaagatgctggtttttttgaaggaatgcagactgagctacaagcaaccttttctccaagagagggattacttgagcaaaataaagagttttatagaaaaattcaagaaagccagtcgatttgtattacaatccgccgaggagattatctctcaactgaaaatcgtcagtccttttttcaatgtgatgaatcttacttcatcaaaggaattgaaatacttaagtcaaaaatcgtcaatccagtttttttcttttttagtgatgacttagagtacgcaaaacagtttgcagaggatgtgatgacagaagaggataattttatggtcgaaaaagagggaaaccctgtttgggagaaattaagattaatgagcgcctgtaagcattatatcattgcaaattccactttttcatggtggtgccaatttctatcagctaatccacaaaaaatcgttgtaggccccaaaaattggtaccctaaagattctattaataaaaataatgccctagtacaaagtgattggatacaattatgagaattcaaaattccttacgtaatatgataacagcagtgatgcagattgttgttacaatcattctaagatttatagctcaatcctatttcatacatattctaggtttgaaatatcaaggacttaatggacttttttcaagtattattggcatgcttgggattgctgagcttgggctggggacagctatcttatttaacatgtatgagtatattgctaaacgagatattgaaacgataaaatcattattaaaattttatcagcgctgttatcaagctatttccggatttgtcattgtttttggtcttgctcttatgccctttttacatgtttttgttaatatgtcttcgattaatgaaaatgtatatgtaatttatttactttttttagctgattcagctttttcctatttattaatttataaacaatcaatactgattgctcaccaaaaaaaacatctgattaatctggcagatttagcgtatacgattatctataatttagggcagattgctttgttaattctaacccataattatattcttattttgttgcttgttctttttcttcgtttagctgaaaatattatgattagtcgagttgcggaccgacgttatccatatattaaagataaaaaggttcaattgttggataaaaaaattgctcgaagattaataaaacaaatgaaaggacaagcttttcacgtcatcggaggatttgttgtttttggaacagataatatgataatcagctccttcttaggacttactgttatggggctctatagtaactatttactgataacgaatacgctcaacagtttttttacttcaagttgtaggaagtgtaactccgagtgtgggggatttattaacggaaaaaaatggtaaagaaaattttaaagttcatcagcatttaacctttatctgtttttggctctactcattttcagcaattgggatttatattgtaacgcagccttttattgagttatggttggggaaaaattatctcttatctggtggtgttctgttggttgttgcacttaacttttatgttcagggaatgagaagtccaatgacagtctttcagcaagcggctggtattttttatgagaataggttcgtcccagtagctgaagcgataacaaatttgatagcttcgattgtattgattaaatacttagggcttgcgggtgttttactgggaacaattatatgtacgatgatactttatggttacagttttccaaaatatacttttgttccgatattcaaaaagaaagtttctgtttatgtaattgagcaactcagctatctttttatctttgttttactctttatatccacagtagtcgtatcgcattttttagacgtaagcaatgtctggggaaattttatacttaaaattgtaatttgtctcattatacccaatgctttacttatcttactttttagaaaaagtagagaatttagatattttagaagcttggtcaatggtttattttcaaaaaataatagttagaaatataaatattaaggagaaatatttaaatgattattgtacgagccccctttagggtatctttcgcaggaggcggaagtgatattgcaagtttttacgagaaaatggaggttgtgtcctttcaacaacaatagataaatatatttatttatccgttcatccatctttcaatgctaatgaaacaatattacgttataaaaaaagtgaagtggttcaagaaatttcagaaatcggtcatgatattgtaagagcttgtctccaaaagaaaaatataaaaaatatcgaaattcattcagatgcagacattccagcaggaacagggctgggttcttcaagtacatttacaacggctttattaacggctttgaatagctacaagggacagaaaacagataaggaacaacttgctcaagaagcttgtgaaattgaaatagaggatttaggaaacccaattgggaaacaggaccaatacgctgcaagctacggtaatcttaacttttatcgatttcaaaaagatggttctgttagtgttgaagcagttaagatgagttcagctgataaagagaaaatggcaaataacttattgatgttctatattggaggggttcatgatgctccacagattttgtcagagcagtctaaaaatattcaggaggtaagtaaagaaaagaacttgattaaaatgtgcgagcttgctgaaaaattaaaagttgagcttgaaagtgggaatattgatgctcttggagaaattttacatgaaaattggcttttaaaaagaactttggcaagaggaatttccaatcctagaattgatgaatattatcaattggctttggaagcaggtgcgctaggtggtaaattgctgggcgcaggtggagcaggatttttattattttatgccactaaagactcgaaagaaaaaattaggaaagctttgaagctccctgaaattaaattttcttacgataccgaaggaactaaagtcatttatgaggaaaaataaaagccatatatttctactaataaaatgattatcagctatgcatagcaaaaggagaaattaaatgaattatacagaagaaatcacaaactattacgcacgtcttgaaaaaacaatagaatcacttgataaagaagcactaaatcaagtcatgaatcttttgcaagaagcttatgaaaatgaagtaagaatttatgtttgtggaaatggtggctctggaagcactgcttcacatatcatgaatgattttaacaaaggactttcttatgaccaagacaaaaaatggcaccttgtttgtttgaatgataacgtggcaactttgatggctatttccaatgatgatagttatgacaaggtattttcaaaacaacttgagggaaatatcacaaaagacgacattcttcttgcgatttctggaagcggaaattcaaaaaatataattgaggcggttaaagaggctcaaaaagtgggagctaaagtcgttggaatgacaggttatgatggaggaaaactttatcaaatgagcgattttaatatgcatgtacctatcaatgatatgcaaatcgctgaggatattcaccttacttttaatcatatgatgatgtctgtcttttataaaaaggttgcgaatgaaaaatgagaaaagcaattttctttgatcgtgatgggacgctcaatgaatttaaactaggagattatattacacaagttgaagagcttgtattacttaatggagcagcaagggcagtaaaaaaggccaatgcagcgggctatttgtgtattattgttaccaatcaaggaggagttattcataacagatgagttgcttattctgaggttgaaagaataaatgaacgattggttcaacttttgaatgaggaggggggcaaaattgatggaatttatgtttgtccgcattatcctggctttgagtcttgtacatgccgtaaacccaaaactggcttgattaatatggctgtgagtgatttcagtattagtctgaataattcatatataatcggggattctgattctgatgtcttggctggaaaaaattcaggtcttaaaacagtagggataggtgagcgaataaaaaccgaggcagatttttgtacttataatgtcgaagaagcggtgaattatattttgaaaagagagagtaaatgccaaaagtcagtgtaattgtacctgtatacaatgttgaaaaacttttagagagatgtttgaattctgttctcaaccaaagcttccaggattttgagttgctattgattgatgatggttcaaaagatagttctggtcaaatctgtgataattatgcaaaaaaagatcagcgtgtgcgcgtttggcatattccaaatggagggcaaagtgcagctagaaacttgggaattgataatgtctacggaacctatattgtttttattgacagtgatgattttgttgaattagattacttagagcagctttatcagccaatggttgaatatgaagctgatgtcgtgagttgtcgttatatcgcttattcggaagaacgagatgaagaagtaaagaaaataattcgggaaaatcaagcaaaagtctatcattttaggaataatcaggatgttatgcaagattttttagagaaagaattcaaagatgatagaaattttccttgggagtcttatgcaaatctttataaaaccgagcttcttggagagattcgttttgaagtgggcagagaatttgaggataatttcttcaactatcagtactttaaaaaagtccaaaaggccattgcaacaagctacattggttattattattacgctaatccgacctcaaagacaagaattactttttacgaaaaacaattcgatttaatccaacaagagcgtttaataatagaagacgtaaagattaaatacccggagtttatagatttagaagctaataatttagcactcaaatattgttggctttatggtaagatttttggtgatattcgattttctaatttttcggttagtaaaaaaaatattcggatcattcaaagtctttataaagaggataaaaaatattttctaaaattagatattggaaaaaaatggggaacatttttgaaattggcaagttcatttccttatgctactggattatccaatcgattatacagactactaaagcagaaataaaccaagcattttcctttatatcatgatatttcatagataataacgataagtcaaataaagtatggtagaataataagataaaaaattatttatcagggtattttaggacgatttattcgcttttttgttacatctgaataaattttacgtataaataagtggagggaaaatggcgaagaaaaaatcatcttttgtttgtcaaaattgtggttataaatctgcaaagtatcttgggcgatgcccaaattgtggagagtggtcctcttttgttgaagaagttgaagtacaggaagtcaaaaatcagcgagtgtcgatgtctggtgaacgttcaaaaccaatgaaattagatgaagttgagctttttgatacaccacgtattgaaacagatcttgacgaatttaatcgtgttttaggtggtggtgttgttcctggttcactcgttttgattggtggagacccaggaataggaaaatctacgttgcttttgcaagtatcgactcagcttgcatcaagaggacgggttctctatgtgagtggtgaagaatctgctcaacaaattaagcttagagcggaacgtttgggcgatattgatcgagatttttatctttacgccgagactaacatgcagtcaattcgtgctgaagttgaacgtttgaagccaaattttttgattattgattcgatccaaactattatgacacctgaaattcaatcaactcaaggctctgtgagtcaagttcgagaagtgacaggtgaactcatgcaaattgccaaaacgaatgatattgctacttttatcgttggtcatgtgacgaaagaaggtcaattggcaggaccaagaatgctagagcacatggttgataccgttctttattttgaaggagaaagaaataatacttttagaattcttcgagcagttaaaaaccggtttgggtcaaccaatgaaattggtatattcgaaatgcaagggcatggtttagttgaagtaactaatccttctgaggttttcttggaagagcgattagagggttcaactggttctgctattgtttgtgcactcgaagggacacgtccgatattagttgaaatacaggctttaactacaccaacaatgtttggaaatgctaagagaacaacttctggtttagattttaatagagtgagcctgattatggcagtacttgaaaaacggacaggcttattgatgcaaaatcaagatgcttaccttaaatcagctgggggagtaaaattagatgagccagccattgaccttgcggttgctgtcgctgtagcctcaagttataaagaacttccgacggatgcgcgtgaatgttttattggtgaaattggcttaacaggagagattcgtcgtgtgacgcgaattgaacaaagactgaatgaagctgctaaattaggattcaaaaaagtctatgctcctaaaaattcaattgtgggaattgatattcctgaacaaataaaagtaattggggtaacaaccctaactgaatgtctaaaattagtatttggctaaaataaaaaacaaaagctatttggatagataaatagcttttgtttttttatgaaaatttcagattataagaatatagtatataacccgaatcttaatgaaaaagatatcgctgaattttttaaacttttttctaatgatggacgtttaaaaattatttccagccttgctactgataatttaacggttaatgagattgttgagcgaactcaactttcacaatcactcgttagtcaacaattaaaattattaaaaaacgcacgtattttaaccaatgaaaaaattggaaaaacagtcacttatagtatttatgaccgacatattttgcatcttttgaaagacgttgcagagcatctggacgagcaagaaggaggaaatcatgagtcttaaaaataagaaagctctcaaattggagcacgagcatgaccatttggacaagctcgtttctcaaaatgtgacgattgtttttgcactgaacctcttctttgcaattttagaattcatctttggagtcatttttaattcaactgctattttgtctgatgcagtgcatgacaccggagatgccgtagccattggtttggcctggtttttccaaaaattttctaaacgtcgggaggataaacatttctcttttggttatcaacgttttagtttacttggcgcctcactgaccagtgtaattttaattacagggagtttcattgtccttttcgaggctcttcctcgattttttaaccctcaacctgtggaagcaacaggtatgctcggtttggcaatttttgccattgttgccaatggttttggggcctggcttttggctcgtggttcctcacgaaatgaaagtatcttaaatcttcacgcgcttgaagacgttttaggttggttaggcgttctaattgtttcaatcgtccttcattttgttgattggtactggttagatcctcttctttctattttaattgctttgttcatcttatctaaagccattccaaaattctggggcactttacgtattcttttggaatcggttcctgaagatattgattacaaaaaactcctgattgctcttgaaaaactcccagaagtacgtagtgttactcaacttattatctggtcaattgatggagaacaaaatgcggccatgattcacattgtaattcctgaaaatcaagatttttctgaagcaaaaattgctgttcgcacgcttttggaaagtgaaaaagtgtgccgctcagcaattgaacttgacgaaacggttgacgaacataaaaaacacatgatttatgaagtctaatttactgaaaacttttcattaaatttttatagattacaccacttctgtcagctcaatgtgctgatttatgcactttgaactgtcaaataaaagttttgattgtttactgacagaactgtaaatttatgagattattgataaatattaaatgggtaaacaatgatttcaaggatttactgacagcatccttgataaacaaaagactcgacttttcataagccgagtcttttaatattttcaacgaatttgtccacatccatcaatcagatatttagttgaggttagagcctctaagcccattggtcctctggcatgaagtttttgagttgaaataccaatttcagcacccaaaccaaatacaaagccgtcagtaaatcgggttgaagcattgacataaaaggccgccgcatcaatttcatcttgaaatttttgtgcattaaaataatcatgagtaacaatactttccgaatgacgacttgaataagtattaatatgctcgattgcctcatccaaattatcaaccgtttttactgacagaatataatctaaaaattccattccaaaatcttcgtcagttgcaggaattccagctgacagagcttttaacgatcgttcatcagcacgaaattcaacttcatggactttattgatttcattttggagtttaggtaaaaactcgtcagcaatttttgcatgaaccactaaactttcggccgcattgcaaacacttgggcgctgtgtttttgcattaatcacaatccgagtcgccatatccaaatcagccgattcgtcaacaaaaatcgtacaatttccaaccccagtttcaatgacagggaccgttgctttttctttgacacgattaatcaatctagccgacccacgtggaatcaaaacatctaagaacttatcagcttgcatcatcttttcagcttcagcatgactcgtgtcagataaaagttcaaccactccgtcagtaatttttgctgacagcaaattttccttaataatttcaactaaaaccatattggaataaatcgcatcagacccgccacgtaacaagacagaatttcctgttttgaaacaaagtgaaaaagcatcgatggttacatttggacgactttcaaaaatcattccgaccgtaccaagtggcactcttttttgaacaattttaagtccgtcaagattagtgaaaccttgcaagacttgcccgattgggtcaggaagttccgcaacttgtctcaatcctgtcgccatatcagagattctctgagcagtcaggcgtaaacggtcaaccataatttcagaaattccatgtcctttggcttttgctaaatcctttgcattttcgctgataattctgtccgtattttcgacaagactgtcagccaatttttgcaaaaaagtgtttttttcagcagttgatagctttgccgcttctttgctcgctgtttttacctttaatccaatttcttcaatcatcgtttttatccttctttctttgaggcctgcttcgctaggctgaccatgctcgctatgtcgctcaaacacctagtcacatcgcaaaaacggctttgctttttagaagtacctcaaaatttttgatgaaaatatgttccaatctcacgtccttcgataatttgttgaatttctcgaatccgctcgccattggtcagaaccatctcctgatcattttcaaataaaatttgggcagccgccaatttcgaagtcatcccaccagtaccaaaacgagaaccggcacctccagccatttggcgtaattcatcagtaatttcatgaatttcattaaaaattttagcatcatcataaatcgtcggatttttatcaaaaagtccatcgatatctgaaagcataatcaacaaataggcatgaaccaacttagacacaatcgctcccagtttataattatcgccaaattttgtttgatggtccatttcatcaacagcaattgcatcgttttcattgataatcgggataatatccagtgcaagtagagcattcaatgcattttcagcattttcacgactcgttggaaaatcagttacatcacgagtcaaaagtaattgcgaaactttttgtgaataacggcgaaacatttgcgtataaagactcatcaattcgacctgaccgatagaagccaaagcctgctggtctgcgattccttttggacgtttatccattccaaggacattcaagcccacaccaatcgccccagaagtcaccaaaatcacttcatagcctttattattcaaatcagataagacaaaagccagttcgtcaatatttgataaatttatttttccatttggcaaaatcaaggaactcgtgccaatcttcaccacaattcgctgagctttcaaaatattttttcttgtcataatcatttattataccaagatataccaacaaatacgagagtaaatcgaacaaaattaaaaatttttataattttattttcggtcctaattttatcaagaaaagagtccatcagcaatttttaacttatcggctagaaaatttatcttctcaaacaaaagtctatttgtcagctagcatctttttaacaaaatcaggcatttcaccgctgccaactttgtcagtatttttttcattgatttagctacttgattctcatattcagaagtcgttttttcatgaccatctaaacgcttttctcctaccaagttctgaatggccgtaatatcttgcgaaacttccaaacaccccagatattctcctgtttcttcatcccgcatcgcaaagtagcgaatatatacttttttattgaaacgatgcagatcaatccaaaaatcagcctgatcacgcgcacctgatttaaagtcttccaatattttttcaaccacagccattgattttggcggatgacagtcaatgacacgccgtccaatcacagattttgcgcgtgggaaaattcgttctcccccagagaaaaaccgaacaatatcctctttatcaacaaaactcaagtcaacaggtagaaccttaaataaagctgtcaattcattgaggtgcatcatcccagttggcaaaacaacaactccctcactttctaccttttcccagtcatattgacgctttatgtcttttgctttaacaactttagtggattcctctttggcaatatctgctgtaattgctttagcagactcaatcgccacaagcctttgtggttctcgttctttttcctttgcaattgattccttagacgcttgccattttaaaggctctgcaataaatgaataaccaatttcattagaatcctcctcaatctgttcccaatcctttaaagaaaaaacatctaaacacattggaatcatgattgcttcttctttaaaaatcatctcttcaatttctgtcagtaaattttccagcatttcgcgtaatgggtttaaagctgttttgtctgtttttaaataagcaatgacttctttattcatctctcgcacggcatcatctacaccccacatcacttttggtggcgcagtgattccatatttttccataaaagaaaaaatcaatgtttcttttctagcataatgcttatcaatattatataagtcttccactgccgcaagtaaacgacccttcaaagtccaatctcctttttcaattttagaaaagacccaacgaatttcgtcatttagtaaggaagcaatcacgtgattttcgagtttcattgtatgaactggatgacctggaatattttcttctaaagaagactgatggatatctttgattgaacccttaaaaacagccccatgaatattacataatttttgaatttctgacggattgagtcctccttgaattaatgctttttcagcaccggtaatttcagacacatcaactccatcaaactcttcattgaagatttgttttgcctcctcaaatgaaccaccctcatgcaaaagccttaaaatttcgacaattcttttttgacgctccattgttgttgattttttcatgtcagtcatttttcttcctccatcggttttgaaaattcaaaaccagcttcagcaaaaacatgaacaattttatcccaatcaatatgtttcatttttgcacccatgggaatcgttgccattcttcccgcagtttgtagcataccaggcatttttatctcatgaaaacccaagtcgtccattaaatcaataatctcaggatgagcggttgccaaatcataaagtttagtatttatatccagttgaatcattctaatctccttttcagatgtaaagaaactttgacatctcatcttattctaacaaaatattagtctcattaaaagataaaaagaatccgtaatttacagattcttttttgtctttctataaaataacttgaattaatgcgagagagataattcccacaaggacaatgaccaataagtttttgcttaaaattgcagcaataattgtcggtaatgaagccaataaattagtccaatttacagaaggaaaatgtcctaaatgttgaacaaaaagattagaaatccacaaagccgacataataagtacgggaacgaaactcaaatattctacaagaggctgaggtaagttaacatttttgagtaaaataaatggtaaaattctcgagagtaaagtgacaagtccacatataataatcgtcagcataacaaaattaaaagaatacatgttttacccccactcctatggcacaaacaagcaaagtgacaaatataatcaataaattacttggaataaaaattagtccaaaataaaataagattaaagtaatcccaaccatcaacaattgtaatttcaagtctaaagtcttatcaccaataagttgcaaatagagtaaaccgataaacattgcaataattgcaaaacccagccccaacttttctggatttgttaataaatttcctagaagtgcgcccataaggctagataaagcccaaaccgtatatgccagtatgttcgaggcattaaaccaagaaaaacttaacttaccctcagtataattttgtttattcatccccagagcaaaagtttcatctgtcagcaaagttccaataaagatattttttaataaactttcatttttaaaataagaggctgtcgtcatagacatcaaaataattcgtgaattaactaaaaacacactcaatacaatcgataaaagtggactatgaactgcaagcatggtaataataataaattgtgctgaacctgcataaacaatcagtgaaagtaataaaattacccacgcactaaaccctgcactatgaccgatcattccaaatgctgctccgataccaatatatccaaaaactgttggcaaagtattctttaatccttgcctaaaagtcaattccgaattcatatttttaacccctacttccaaaagatatatctaaatattatcacataaatattcagctaatgtcaataaaatctcattatatttttgccttttagttaatttgtctcttattgagtaagattattatagatttaattttttcagtgatataatcaaattaataactaaaatacataattaagaggaggaatatcatggatattagtatttttggtaaagggaagatggggatagcaattggtgataattttaccacttccggaaatgcagtcaattacatcttatcggattcagacaaatcacctctaggagaaattgtcgtttttgcagttccttatagtgcgcttgaagaaattatcaacgaatatgcagacgagcttgatggtaaaataattgttgatattactaaccctgttgatttttcaacatttgatgaccttctagtgccagctgatagttctgccgctgcaattattgctgacaaactcccaaattctaccgttgtcaaagcatttaatacaagcttttccgaaactttagcaacaaaaaaagtctcaaacaaacaccaaacaactgttcttttagcaagcgatagtcaacaagccaaagaacaaatctttcgtgctcttgaaaagagtggcttatcgctggttgatgctggttctcttaaacgtgcacgtgaacttgaagcattaggatttttgcagattagcctagctgcctctgaaaaaatatcttggaatggtggttttgggctttttaaatagtcgcttaaaattttgagtcttgttataattaaataacaagactttttatttttaagaagaaaattcaaacaaggagtaagaaaaatgacgacattaacgaacgaaacaacaatgagaattagagccttagaacgaacagatttaagaaacattcatattattaataataaggctgaaaccatgcgtctttggtttgaggaaccctatgaatcattagatgaattaaccagtctttacgataaacatatccatgataatacagaaagacgatttgtgattgaagccaacgatacatttgtgggcattgttgagctaatgtcgattgattatattcatcgtacttgtgaaattcaaattatcattattggtggtttttctggaaaaggctatgcccaaaaggccctaaaaaccggtgttgattatgccttcaatactctaaacatgcacaaagtttatttgtgggtagatatcgacaatgcccctgccgttcatatttataaaaaattaggttttaaaattgagggaacgattaaagaacaatttttcgccggtggaaaataccatgacagttatttcatggggattcttaaatccgagtatgcccagaaagaaaaaatgattaaataaaaaaaacaggaaaaattcctgtttttttatttcttagcgttttttcttaccttttttcattttcttttgagcacgtttcatggcttgcttcatagcaaattcagttgctttacctttcaaaccaccaccaaacatagaactcatatctggcattccgtttgcggaaccatttcccatcattccttgtaaatctcccaaggctgacatatctggcattccagaaccggttggcatatttggcatttgtccaccagctccacccatcattttttgcatcatcgcattcatatcaccattcatgattccttgcatcatttctttggattgattaaattgcttaatgaatttatttacttcaataaatgaatttccagaacctgcggcgattcgacgacgacgagctggcgatagttctgcttctaaatgacgttcagcaggggtcattgacaataccattgctcgttttctagcaacatctttagggtcaactttaactttatccaagccaggcatttgtgacattcctggaatcattttcataatatcttccattggtcccatatttgtaacttgatctagttgctcaacaaaatcctcataatcaaaacggttatcagccattttttcagcgagttttgcagattgttcctcatcataattagcttgcgccttctcgatcagagtgagcatatcacccataccaagaattcttgagctcatacgatcagggtagaaaacttcaaggtcggttaatttttcaccagtccctgtaaatttaataggttttccggtaatttcacgaattgataaagccgcaccaccacgtgtgtccccatcgagtttggtgatgataacaccggtaatatctaatttttcatcaaaagttttagccacttgtgcggccacttgaccagtcatcgcatcaacaacgagtaaaatttctgttggttgcgcaagtgctttaatttcttgaagctcattcatcaatgtatcatcaatttcaagacgacctgccgtatcaatcaacacataatctttacgttcttcttgagcttttaaaagaccattacggacaatattaacgggtttttcagacgttccttcatcataaacaggaatgtcaagttgttctcccaaggtttttaattggtcaatcgctgctggacgataaacgtcggctgcaatcatcagtgggcgagcattttgttcttctttaagtttttttgcaagtttaccagcaaaggttgttttacctgccccttgcaaaccaaccatcatgataattgttgggattttaggagatttgagtaattcggcttcaccaccgcctaagatagctgttaattcttcatcaacaattttgataacttgttgagctgggttcaaagcctctgatacttcaacaccgacagctcgctcacgaattgccttaataaattttttgacaactgggagagcaacgtcggcttcaagaagagctactcgaatttcttttgtaatttctgtgacgtctgtctcagtaatttttttctttccacgaagatttttaaaaacgttttgtaaacgttcagttaagttttcaaatgccatattttataatccaattctattttttacaattacttcattataacatttctttacttaaatttgaatacatctaaagttttagttattatctttttttctctttttgaaaaatataatgaaccatcctatagcacttccaatgattattattaaaagactaatgaaaagcttaatttttgaattatttttacttagcacatcagtatgatctaatttatgattatcactaattatcgcgccagcttcttctctttcagaaaacaatttatctcgattttctatattgaattgtccttcctggttcaaattatcactatcgctcttacttgaaatacccgaattttgagtgctggaatcaggagttgtcaaagccatttcgctcttttccacagcaatcctgtcaaaatcaggacttgttttccaactttcatcctcaatttgattttgcttatctttagctattaattttacattactgattttatctgaatctaaagctagcggtaaatttttcgaaagttgtgactgactctttttgacttctttattggactttaatattctttttattattccttgatcaatgttcgctgaatctatcggactgttttttagtataggcagaatttctttcaaatgctgagccggattttgttctgttaagtgtgaattggaatcctctggctcgactttattaatcgtatttttttcagataaattaggcaatatttgtaaaatgttttgtggactggctgctttatcactgctctcctgattatttgctggagcaactggaagctgcttgcctgaaccagctgacttatcaggtgacgagtcttttagtgggttttcatcaactggttgatttttatccaattcttttgctgaatttacagtagtagatttattagaatcaaatttactttgagctgatgctattgtttcttctgtatcttttctactttcggtaattttattaataacacttgtgttcgtagttggacttccttccgactcaaaagttggggctgattggtccgttttgatttctgaacttgaattagtttttttgtcagtcagtgattctggactagaacttccatcagaactattggttagggcagaatccggttttgaactttctgtagttgaacctctttgggatgatttttcattactagtttctacagttattgatggagcattttcttctgtctttaaatctttctcttggtttgttgataagtctgaactagaattactagcagacttgtcagtaacttcagaagagggggagtttgaagttgaactttctgtatttgaagtttttggttccgtttctgggcctttgattatctctggaggagtggtcggaggagtttcagtttttgggtttagatttgtactagccgatacatctgaacctgaactattactagcattatcaactatatctggggaagataatataggacttgtattttcattagcttgagcactggaatcatttcctgagttactgggatctaccgatgttgaagaagcgagtgaaccattgttagcttcttggttcaagatggttccctcattttctgatgggtttaggtctgaattattatcaggattatcagtttcctcggaagacggtagggttgagttttcagtatttgaagttgttggaactgaactggtcgaatctaaactagaatcattttgttcattagaaactgaatccgttgataaatctgagtctaaaccattagtgggattctcattcgagttggagcctaaagaactggaatcagactctgaattaggttctaatttttcatctcgattaggtaaagttgttgttgaatcgttggaggaactattatcagaggcatcagacaaatccaactggtcagttacttcatctgaaattgctgcatctgtgcccaaattatttgagttattatttgtagaatttgaactttcagtatttgtccaacttttttccaaaattccattactatctactataattgttcgaattccacttgttggtaaatcagttaattgtccaaaaagaggactaactttattaaaggcatcatcagctaaactcactccatttcctaaggtcaaaaagcaaacagggcttcctgaaaatgctgtcgaatcaactgttgtcagtgagtcagcatcaaatgtgattgaacttatttgattgctttgaaatgctttaggcatgatttcagttacatttggtccaaaagaaagttcggtcagattattattagcaaaggctcttgttgcaatcttaatgactgaatttggaaatatgatactggtcaaagcattcccagcaaaagcatctgtttttatattttggacactttgtcccaaaacaacttctgttaaagcatttttataataatctgaataggcagccgttgtttgaaaggcacttgtattaatgtccacgacattatttccaataataaccgaatgaattcctgtatttgaaaatgcataagttccgattgaagttacagcgtaggtttgaccgttacttacaactacatctggaatgataatatcagcaccggccgaaccagaaaatgacgtaacctcggcagtttttgctactgtatccaaactgtaagtaacttgctgagcatctgtataggtgattttcgcactcgccgcttctactgacgaatctaacactacttgctgattgatgacagaaggactcatgatggctgtcagtaatcctaccccaacggtcattgtaattttcttaatcgatttttttgacataaaaaacctcctaactttctatacgaaaaaaaggagattttgtaacttttattttttattatgattttttttggtgtaacgtttgtttaaatcttgaggttgacgggcttccatcacgactggaagaatcaccggtttacgttttgtttgctcatataagaatttaccaagagcatcacgaattgaacctttaatttctgcccaatcaaattctttacctgcaagatatttgtcaactgttttatttactaactcaccagcttcacgcatcaagtcacgcgatgttttaacatacacaaaaccacgagtatgaacacgagatttgctgacaattttgcgttctgtcttagaaatcgtgataaccgcaatgaaaattccatcttctgacaagactttacggtcacgtaaaacaaccgatccaatatctccaactcctgaaccatcaatcataacattttcagcttgaatgactccagcaggaaccatgtctccattttccaaacttacggtttcaccgcgtttggcaataaagatatgctctggcaaaatatccatttccatagctaaatcagcatgagcactaagttcacggtattcaccttggattggaatcaagttttttggacggaagatatcaagaagaaattgtaagtcgcgggcattagcatgaccagatattttcaaatctgaagccaacattttcatgacaccaccagctttatagatttcattttcaatacgagcaatcgttgtttcataagagacagatggacttgtcacagcaaggactaaatctccatctttaattttaacgtatttatgacggcgatgagccatatctcccaatgctttgagaggctcacccattcgtcctgtttctaaaataactaattcattatcagcaaattttttgatttcagctggtttaatgattgattttttatcaacaatttgtaatttattaagacgagttgctgtttcaataatttggtccatatcctcaccagtaaaggcgacacgacgaccgagcttgattgctgcatcaatcgtttgttgaattcgtcctaagttacctgcgttacaagcaataatgacccgaccttcattgtcatcaatgtggtcataaattttttcataaatctcatgttcactggcagattgcattgttgacaaagcatttggtgatgatgaaagcaaggcaagaacgccactatttccaatttccgctaagcgacgcatatttgtacggtaacctttggcaactgctgggtcaaaacggaaatcacctgtataaacaatgttcccgtcagttgttgagatgacaattcctaaactttctggaatcgtatgtgtcgttgagaagaaagaaatcactgctttaccaaagtcaatttctgtatcttcagtgacaacatgaaaatcattaaacttacggctgtcagcataattttttacattaatttttgcaagttcaattgtcaattctgaaccgaatacaggaacttttaattcagaaacaatataaggcaaagcaccaatagagtccgcgtgcccatgggttaagaaaattccagctacgcggtcagcattttctaagagatatgtaatatcaggaataacaaaatcaacaccaagttgatccatttcagcgtatttaagccctgcatcaagcacaaaaatttgctcttcaacttcaaccaaatacatgtttttaccaaattcacgtacaccacctaatggggtgattttaatattagacataaaaacctttcttgtcagtgtaatttataattttttcgatataaaaagaatctgtaagttattgacaaattctgtcagtaaatttacagtcctgttttttgcaatttccttaccttattcactctcgaaatcggtcgagtgggacaagcgatattgaaaagataactctaatgagagttaaaataaaagagattggcattccaatctctaccgagaatacactaatataagtttaacccaaagcaagtaaaaaagcaagtctgtttcattttttatgagtcttactttttttctaattaaaatagcgatataatggaaagtaagttttaaatgacaaggaggaaattttatgcagattactttcttaacacaaatggattggttgattcgtctaatcctagccggaatttgcggatatgcgattggttacgaaagaaatagtcgttctaaaaacgcgggaatccggacccatttaattgttgccttaagtgctgctttgatgattattgtctccaaatacggatttatggacatcattagcactcacggggtcagtctggacccttccagaatagctgctcaaattgttagtggtattggtttcttgggagcagggatgatttttgttcacaatcaatcggtaaatggtttaacgactgccgctgggatttgggcgacttcgggtattggaatggcaatcggttctggcttatattttataggtattattgccactttactcatcttgctctttcaaattattttacatcagaattatcgttggataaaatcagcaacaagtgaccatcttattcttcagttggaaaaccttgaaggacttcaacttcttcaaaatcaattaaaagatgagcaggttaaaattctcagtttaaaagttgaaaagaaatcaaataattgtttgagagttgatttatatttgaagttacctaaaaattatgaaatcacttcaattctaaacttattagaaacaaacggcaaaattaagtcaattgaatactgacaagaatattttaataaaaaaatacctttaaaggtatttttaattttcaatttgttcaataattatttttgcttcctggtcagtacaagcgacaagtggtaagcgtaatcctccaactgcataacctttattgttcaagactgttttaattggtgctggacttgtcacactaaagagcgcattgatttttggtaatatttttctttgaatagccacggcctcttgaatcgagccatggtctatttcagcaaacatttcaaaaaattcttgccccaagatatggctggcaaccgagatgactccttgtcctcctagagttttcgcatgaaaagctaagccatcttctccagtataaacaagaaaaccttctggtacattctcaataagataagctagattgtcagtacttgtacactctttaactgcaattacattttccaactgggccaaacgtaaaattgtatctggtagaatttcagtcactactcgtcctggaatattatacaaaataattggtaagtcactagcacttgctattgctttaaaatgttgataaatgccttcttgggaaggtttattgtaataaggagtcaccgctagtcctgcatcaatataacctaattttgcaacttcttttatgaactcaactgaatcccgagtatcattagttcctatgccggcaatcaaaggaacccgtccatctacgagctgattaattgaggcaaaaatttctaattcttcatcatgcgtgagcgttggcgattcggctgtagttcctgctaaaataagcccttctgtatgactggcaagcaaatcctcaacaagttttggaaatgcttcaaaattaatttggccattttctttaaagggtgtcactaaagccgtgataattcgtgctttttttaatttttcaattgtttcttttgctgacatgtcttctccttttgggtgagcttattgataagcttctgtcaagaggtcaaaaagaacctctttttatgcaaaagaggctctcaaaagttcgtcaaaaatgattttgattagctcccccttctgtcagtactgacagaaagacagtctgtaggatttaaccatacagcccaagaaaaattctgtgacaatttttctttcggcaaagaacgccgccaccagtttcattgcgttcaccgctccactaattttttcgtctttgcaacctctaattttgtttgattcattatagcatactttagtaaataaggtcaaaaatattatttcatcgttactctttggaaatttttcgaataaaatcttcaataacacgtcgatttggctcatgaatatttttagggatctcagtaatttcaaaccatttgagttgattgacctcctcattttgtggtcttaaatcacctaaaaaatcacgacaaatatagtaaatccctggcatataaacttggtcttcatttggatacgtgataaagcggtcttgacccgaataaatccctaaaagctcaagatttcccgcttttaatcctgtttcttcgagtaactctcggcgagcagtctcttcaagttcttcaccaacctcaactcctccggcatgtaaagcccatttaccattatcttttcgttcttgtaaaagaattttcccatcatcataaacaatgacgccagctccaagataaattaataaatcatgtccaattttcttacggatatcgctgacatagctcatttaaataccttatttcaattcaaattttaattctttagttggtctaaccaagccacgttcatgcaacgtttcggcaatttggacagaattccaagcagctcctttgagtaaattgtcagaaactacccaaagatgaatcccattggctgcatccaaatcacgacgaatacggcccacaaaagcttcacgacgaccaactgaattaatggcttgtggataaatttgatgtgcgacatcatcttccaagatcgcccctgggaactcagaaattagacgcttgacctcagcaatatctgcttcttttttcgtttcaacataaactgattcagaatgaccatagagaactggaattctgacacaagtcgccgaaaccgcaatcgaatcatcttccatgattttcttagtttcattggtcattttcatttcttcataagtataatcattgtcagtaaaaacatcaatctgagcaagggcattataagcaatcggataatgctttttatcaccagcagatggtaaaatttctgctgacaattctgtcagtgcttttccatcaagagcttcttgaagttcacgattagtttcattaattgcggactgaccagcaccagatactgcttgataagtactgacaatcacacgttcaagcccataagcacgacgaattggctctaaagcaatcatcatttgaattgttgaacaattaggacaagcaataattccattatgttgttcaagtgcatgtgcattaacttctggaacaactaaaggaacattaggattttgacggaaaaacgatgtattatccacaactaccgctccagcttttacagcataaggggcaaatttttcagaaaccgaacctccagctgaaaacagtgcgatatcaatgccttcaaaactgtcatcagtcaactcttctatgacaagctcttgacctttgaactctacaattttacccgccgaacgtttactggcaagtgcacgtacggtttctattggaagagtagatttttctaattgctcaagcattcttgttcctacggcaccagtagccccaacgaccgcgatattatattgtgtcataattgtctgtccttttcagtaaattataatcattatagcgcttttaagttctaagggcaagaaaaaatctgtctgataggcagatttttttcattttatttaaacatgagtttaaatactgtagctgcaattactgcaccaacgattgtggcaaccactggaacccaagcataccaccatttagcgtctttattttcaccaacaactgattgtggcaagaagctataaacaatacgaggaccaaggtcacgtgctggattcaatgctgcaccagttggtccaccaaatgctgtaaccaaaccaacaaacattaaaccaatggcaagggcaccaaccattttagatgatgaagcgcctgaaacagaagcccaaatttggctaagtgtaccactagaagtgatatctgcaccttgttgttgagcgtaacttgtcatccatttgattgattctgagccaaagaaattcgttgtaaaactgagaattccgaaaacaaatacaaacattccgattacttcattgacaaaaccgttgaaaattgcttttcctcgatttgaaccatcatccaaagcgttagttgtggcaaatgcgcctaaagaaattgctccgtcattagttttagcaaagtattctttgtaaatcgctacgacgagtaactgaccaataattgcaccaataagttgagccaagatatattgcgcaacatgaggccaagggaatagaccagctgaagcaagtccaagtgtaattgctgggttaatatgagcccctgaaacatttgcaaaagcaagaacaggaactagaatcgcaattccgtatccccaagcgattgcaaggccacccatgccctcatttttagagcctttgagtgttactcccgcaattgtaccattaccaagcaaacgagaagcatagttcccaatccctcaccaatatattttgtcatccatgaaacatccatgatagtttcctttctatttttaaaaatacataaaagatgtgacactataagtttatcatatttttcttaactcttgctaataataacattgtaagatacaattatagtgttaaaaaattcgttagcagaaacatttttagtctagttaactttcaataaataaaatcacaaaaaaaagcccttttacaagggctttttaaggcactaaaagtgtgtcaaaaaggttcacacattttgacaaatgctcacgcttcctgcgcggaaaactcaatttcccagcactccttagcttcgaaattctacaaaagtagaattattcgactcatcgcatagacctattctatcatattaattcaaatgaaacaagaaggcaagcaatattgagcccgaacccacaaaacttataacacaaatagcaaatcttattgtaaaaatagatacgccaatattctgataagactttcttgtccgttttcctcgataaacaaacaaggagatcactgacagagctgtcagtaaatattgaatcagttggttttgaccatacataaaattcaaaagcgagcccccacccgcaagaattgcaagtaaaattcccatatttaaaacctataattttcctttatttttcttgacaaataattttcgtcagcaatttttactgattgttttatcaaaatagaaccctcagtaaattttatcagtaataaatgttactgacaaacaaataagccttgacatctgtcaaagcttattttatagattacttaatctaaagattgatatactttaattacattttcagcagtaaatccgtaagccggaagaacgatatttgctggtgccgaagcgccccaagtgtctactgtgactgttgcaccatcaagtccaacatatttaccccaaccgtaacttgttccagcttcaatcgctaaacgacgtctaactgatttaggtaaaatttcttcgcgatagtctgctgactgctcgtcaaagatattcattgaaggcattgaaacaacacgaataccagaacctaaagtcttcttcgcttcaagagccaatgctacttctgaaccagtggcaatgatgattccttcaagttttccttcttcttttgaaagaatataagccccacgattcagaccttcttcagccaattcataagtatcaggtaaaactggaagattttgacgagtcaaaataagtgcggttggacggcttttacttgaagcagcacgacgccatgcagccaccacttcatttccatcagctggacgaataacatccaaattcggaattgaacgaacagaagccagttgttcgacaggttcatgagttggtccatcttcaccgacagcaatcgaatcatgtgtccagacataagtaactggcaagctttgtaaagcagccatccgaacagaaggaagcatatagtttgagaagacaaagaatgttccaccataaacacgagttccaccatgcaaagcaattccgttcataatggcacccattgcgaattcacgaacaccgaaccaaatattacgtccaacatagttatctggcataaagtcttcttcaactttaaccattgtattatttgaagctgaaaggtcagcagaccctccccagagatttggcatttgagcagatagttcttgaatggcttcttgggaagtcacacgacttgccttacttgtttccatttcatgtttggtcaaagtaagctctggtgtttcattttcaaaagcttttacatattgttcagcaagctcaggatatttttcagaataatcatcaaaagtgctacgccatacttgctccatcgcttcaccacgcgcaaccgttgtttctaaaaagcgttttgaaacttcttcaggaacagtaaattctggataatcccaaccataagctttcttagcaaaagctacaccgtcagctccaagagggactccatgaactgctgaagttccttgtttttcagcaccaaaaccaatgactgttttaacttcaataattgttggtttagatttttcagctttagccacttcgacagctgctgcgatttcttccaaatcattaccatcttttaccaataaatgttgccaaccatatgattcaaaacgtttttgaatatcatcaataaatgacatagataaatcaccatcaagagagatattatttgaatcatagaaaagaatcaatttaccaagtttcaatttacctgcaagtgaagctgcttcttgtgaaacaccttccatcaaatcaccatcaccatttaaggcgtaagtgtaatggtcaacaatatcaaaaccaggtttattgtattgtgcagctaaatgtgcctcagccattgccattccaacagcattggcaattccttgtcccaaaggacctgttgttgcttcgacaccatctgtatggttaacttctggatgtcccggtgtttttgactgccattgacggaaaccctttaaatcatcagtcgttacattatatcctgccaagtgtaacaaactatataacattgcagaaccatgaccagccgacaagacaaaacggtcacgatttgaccatttacgactcgtttttggatttacattaagaaacttgctccaaagtacataagccattggggcagagcccattggaagtccaggatgtcctgaatttgctttttgaatcgcatctaatgatagagtacgaatcgtatttacagccaattgatcagtagtatcaaacataagatttctccatattttttatttatactcacattataacacaagttagaaacggttttcattctccgaaattaaaatctttttcttttttttagtttttatatgaaaatctttttaattttggtgggaaggcttgttattgcttggtttatgagaatataaattttttacgataatttattcgatttatttaattttttagaatgaagtctatctctcctgttcaaaattaagctagttattagaacaattgccaagaaagctaaaataaagacaatcaatagccctgaaccagcttttcccattactcctagtaagcctcctgatacaatataatcagagtcagcaaaggtcgaagacgcgtctgccccaaatgaacctaaagcaggcaaaattaatagtggaccccaagctaatagtaatccatttgcaagtgagccgataatcgccccacgtagaccaccaaaagcattgccataaacaccagctgctcctccacaaaagaaaataccaacaaccccaggaataattaccgttgttcctaagccaagcattattagcatagaaataactccaacaataaaggagacaaaaaatcctattaaaaccgcatttggtgcataaggaaatactatcgtaacatcaagcgctggtttagaatttgggacaagttttttagcaatcccttggaaggccggaataatttctgacaaaatcatccgaactccttggagcaccaccacaaaacctgcagcgaaagttcctgcttgagtaatcgcatatacaatataattagttccggctgacaataaggaactttcgacaaaacgtggaccagcaattagagctaaacctacatagacaaccatcattactagcgaaatagaaacagtagaatctctcaaaaatccaaggtttttaggaatattcaatttttcagttgatttttctgggtctttattccctaatttttctcccaaatagccagaaagtgcgtaacccatatttccagtatggcccattgcaaccccatcatttcccgtgattttacgcatgtagcgttgagttagtgcgggtgtaattgtcagtaaggttccttcaaatattccacctaacaagattgttaaccaaccattacctagtccagctgaaataaggacaacagcagacattgttgaaacataaagcatggcttggcctgtcaagaaaatatatttgaatcttgtaaaacgtgcaagtatcacattcacaataaaacctacaatcataattaaggcagctggagtgccatattttactaaggctaaagcaactaccgcttcatttgatggtacaactcctttagcattaaatacatgttgaaacatcgttgcaaagggatttagcgaggtaactaaaattccagctccacccgtcaacactaaaaatccggcaaatgttttgattgagccttggataactgcagtggcagcttttttttgcaaaatcaaacccaacatggcaattaatccaactaaaagtgctggagtcgttgccactgatacaataaagtttaaaatcccgttcatttttttctcctctagtctgtttatatcctaattagacctgatttattatctcttattgatgaggaatattattttcatcaagaactttataaagtccttcacgcgtgacttctttatcaataattgaactgagtggaataattttttcctcaggaataatgggtagggcagaaactaaggttgcctcaacaaaaaaataatctgcactatctggtgtcgctgaaccaacatccatatgttccagttcaaaattatcaatatttacttccgattcttctaataatgactgaatgttcatttgaaccataaaactcgttcctaatcctgattgacatacacatgcaaatttcatattatttttctccttcttcttctaaaagtatttgttcaacttctgctgcatttgttgctgcaagtaactgactcaagcgttctttatttgataatatcttagtaagtgttgataaagctctaagatgggtctcattatcaatggctgctaaaacaataaaaagtttaatttcatgctttacatcatccatcagttttacgggatgttcacatcttagaaatgacattcctaattttttgactccttcctctggacgagcatgaggaagagcgattcctaatcctaagtcaatataaggaccgaaagcctctactttatcaataatagctttgatataacgctcttcaatttcatgtttatcaagaaggggttgcgcggctagttcaattgtttcttgccagcttaattctttattggtaaatcttattttttcttttgtaagtaaatctgttagcataactcctgatagtttcccttcttttcttgtacgatttaactttttttcaataatctttattaaatcttgtctatttactgggtcttttataataatataaggttctattgaatctaaaatagtttgagcagatggttttgcaaagcctaggagctgaaaatcttgcaaaacttgattatagagtttattttcttcacgttggtctgggaaagcggacataagataaacttttttgtctgattttagaggaactgtcgaaaaaataatatcgtatgaatttataggtaatttttcaaaatgagagacccgagcacttaaaataaattccattgttggaaataaactctctaatcttttttgcataattaagcttgaactaataccattcacacagagtacgattgcttttaatgactgccctgagtacttgtttttataaatctctccaccaaataaaatcacaaaatatgccttctcagattctgaaatttcaccaacctcatcttttaatggacgaagggcgttatccatcaataaaaacaaggagtgatattcattttttattcgttcaagcaagacatttttcaattcaaaatgatttcttattcgataatatgcaggagttagatgagctaatagtgccataaaggtctttgtgaaatcatcaaattcaattgcagctagtttcataacattttccatgatgttaaaagccattcggtataaaccattatcttgcccaattgcacttttaccgtctgacatcccaataattaatgatttgagtaagtcattaatgttttcactattcttttcgaaagttctatgccttaagagacatgcaaacagtaatgtcgaaagatagcgactataaacaatctcaatctgtagctcttgcatcatctttttcaatagctgattattcttaaaaatagttaatggttttttatcatttaaaacttttgataagatataaaatcctgagtcctcagataaattttgtaaaaagtaccaagccttctcctgcaacattttctcctcaaaattaaggtaaaatcctttttttcttgaatattcaacctgaatattttcgctcattagctcctctctatgtttttttaaatcacttaaaatcgtatttttacttacttgaagataggtttgaaagagagatattgaaagtggcgttttattaataaaaataagtaaataaattaatgaccgcctttcaacttctgttaaaataaatgtcttttgattaatagaatatctagtttcttcaaaattttctactttatcaggaattgctaagagtccatttttatattccaatttttttaaactttgtttttctaatttttgattaaattcctccagcattcgataaattttttctttgtcaagattagtgacctccagtatccgctctaatttccataatttatgatttgaaaaaaagagaatgtctaaatcataattaatcatagaaacgctcccttgtattttttattataactcaattattttaccaaaatatagcgcttacagtccaaattacttttgctaaataaaaataattggactgaactgtagaaaataaaaaaactccaaaatttgaagtttttttattattcagagggaaaaatcaatagctaaaccttatttcttagctgccttaaatgctgccataaatttcttagcattttcagtgaccatcccataatcgttggtggctgcgggagccgtgaccccacctcctgcgctaacagctactgctcctgctgcgaaccaatcagcaacattatcgacatttacccctcctgacggaaggatattaatataaggaaatggtccttttaaatctttaatcattttaggacccgtaatatctcctgggaagagcttgattaactctgaaccgtattctaaagcattttgcgcttcaagtggggttaaaacacccggaacataaggaatttgatagaggttgcaaatttttgcgacttctttattaaaacttggactgacaatgaattgagccccagcaacgatagccaaacgggcagaggttggatctaatactgttccagcgccaatcactacttctgttccaatatatttagctaccaaatcagaaataacctcgttggctcgaggaaccgagtaagtcaactcaattgatgtgattcctccagagacaacggcttctacgatttttagtgccttttcaccactttcggctcggacaaccgagacgactcctgattcaatcactttatttaataattctgctctttgcatgattacttctccttataaaatgcttctaattcttcttttgtgggataaccttcactatctcctgaactttgaaccgctaaggccccaaccgcacaggctcgtttgacggcttctttttgtgttttccctccaagtaaagcagactccagaccaacagcgaaaccatctccggctccaacagtatcaataacctttgtcactttgaatcctgagagggtaaatgattctccacttttcaattttgcgaaggcaccttcagcccccaatttgacaacaacagtttttgttagaggactctgcttgagatagaaatctgcaattttttctggttcagatgaaccggtcaagatttcgccttcatttattcctggcagaatgatttgacttcgctttgctaaatcattgattgttcttatcattttttcttgattatcccaaagtacaggtcgtaaattagggtcaaaaatggttaaaatatttgcttcatttaacttttgattgaatgtttgaaaagtttttaaactggtcttagaaagggtaggaaaaattcctgaaagatgggcaatttttatctctgataaatctatcgtttctagttcagaactagataaattagcggcggcagagtttttgcgataataatcgacagtcggatcgccatcactcactttttgtttcaaataaaaacctgttgagtattttttgtctttggttaaataggaatcgtcaattttagcctttcttattgattcaataataaaatttccaaatgaatcatcaccaactttagaaatataagttgcttcatgtcctaaacgactcattccaatcgcaacatttaactcagcccctgctagaaatttgctaaaatggtccgctgcttctaagcttatatcctgattttctgaggcgagaacgactaagggctcaccaatggttataaattagctcattgcttagaatcctcatttttaaagaagccaaagtagtcatgaacattgttataacttatatcttcaatcatttttccgaaaagtgcttcatcatcgggaattctgccactttcaatcagttgtccaacaaaattacagaggactcgacggaagtattcatgacgtggataacttaaaaagctccgtgaatctgtcaacattccgacaaaattgggcagtaagctttgtgaagcaaaaatttcgagttgtttttccattcctttggctgtatcattgaaccaccaaccaagctcccagttgcaattgttgaacgccttcaccttggaaacagccaatcagtgtcgctaattcaagccaatcattttgattaagtgaatagagtatcgtttttggtataatttcaagttctgctgctttgctaaatagtttggttagttcttctgaaatgttagcttgggtccccatactatcaaatccagtattttcgccaattttccgaatagcaggaccattgattgagcggttaacattgacatgaagtttcattgtccagtcaaattttttatttaatttcataatttcaagaattaatgctgtaatgtattgattgtattctaggtctgttaaagtttgtttttctttagctctctgaatgattgaatctaaatctacatcatccgtttccgcaaaagtataagtggaaagagagtggtcagacaaacgtccaccgaggcttgtgaaaaattcaaatctttgttcaagtgccttaatcattgtcttaaagtccttgatttttattccagaaactgctgacagttccgtcagatattctgcaaaatgtccgtcagtaatggaaattaaatggtcaggtcttaatgctggcagaaccttaaaatctttttcttctttggctaatgatttatgataagagagctttgaaacaggggcatctgttgtacagacgactttgacatttgaatttttaatcaatgcgcgtggtctgaaatcatctgttgcgagcatttggttggcttcgtcccaaatttcttttgctgtttcgcttgaaatcaacttatcaatatggaaaaatcgttttaattccatatgtgtccattcataaattggatttcctaatgatttttcaagcgtttttgcaaaagccaaaaacttttcgtagtcatcaccatcgccagtaatcaatttttcaggaatgccattcgcacgaagtaaccgccatttataatggtctccacctagccaaatttgtgttaattttcatattttttgttttcataaatttctgcttgttcaagatggcaatgataatcaataattggcattttttccgcatgtttatgaaagagtaatttagcattttcattatttagtaaaaaatcttctgataaaaatttcatgattctcctttattattttctattaaaatttaattcaacttcgtaagttttagactcatttgctttgaggaggatgttcccttctttttgcaaaagttcttgtttctgattgacaatatcaggcaagccttgaaatggctcaatacaaagatatgaaagattttcatcttcttttgtccacaggcaaagataaggaaaatccgccattttcatagtcaattgatagtcagagctttgtgaaaaaagtttcacttgctcaattttattgtcaaaaatgactaagcctttttcaaagaattttctttcaagttgaaaattactgacagactttgtaatttctttgatttttcccgagcgataaggaaagggatttttgacaatttcaaattgttttaagctcgtgtcctgagtctcaaaaacaagttgataatcttcaaaagttcctgacaagttaaaagccgggtgaaatcccaaagcaaaagtcaaggattttactgacaggtttttgatgtcaaatttaatctttaattttttactgaccaattggtaagtaactttaaattcaaaatgaaaagggtaggattgatatgtttcttcgttatctttaaataacaaacttagctgatcatctttttgctcaataatttcaaaggaataatctgacgcaaatccatgttgctgcatcgggtaacttttctgatctagcaaatattcatcatcagttgaacgtccaatggctggaaataaaattggagcatgtttgggccattcagaaccattccaaataaaatcaaatttattttcagcatcaatcacatgtgttaattcggcacctttgggattaatttggacagtaagttcattatttttcagtgttaataattgattttccatcgtttttctccgataaatttactgacagaagctgtcagtaaacttttaagcttttgtcactaaatatctgcttggtctggccaacatttttcatagggatgacctgtcaataattcaacgacttgacgtgcttctagtgtgacatcagcttttgagccaccctcttcaaggcgttgtagttcagctttcaaaatatcatgattggcacgattaagtttgaaagtacgagcggcaatcaaggcagccactaacaagccaattggaacaaagatgaaaatcaacataatcccgtgtagaatacctaatggcgtattagcatgagtcgtcattgtagttgaattaaagccaatttcttcaagagcccaaccagcaatatatgttgcaagtgcccctgttgatttacgaaagaaagtcatgacagaagcataaacgccagccttatctccatgtgtaaaaattcgatcaacatctggaatgaaaggaaaaacattccaaggggtaaattctaaaattcctcgcccaagttgataaatgatagaaacaatcacaagcatccacattggattattaattcccgtcagataaatgactaaataaccgagcatggcgacgataattgacaaataactcaaagtgaataaatattttggaccgcgagtgaccatcaatttaactgccgcaatggttgatagaatcccaaatgccgagagggcttgcaagacccaaggagcattagcagatgttccagacaatccaatcacgataaaagttggaagcaaagtagaatagaaatcttttcctgtaaatgatagtaaataaactaataaatgcttcctgaatgatttgtttttgaaagtcccaaagtaatctgtcactgtttttttcataaatcctccaaaaccaagccgcggttgagcatctagcgctgctagaaattctggacttagggggcgttcccaacttgcacgccaagaagtgaagatggcaatgacaaaaataactgtccaagtaattcccgtataaagataggcattaggattgttaaatgatttaagtacagccaaggtaaagaagacaatagccgtcccagttgccgaaatgaacattcggcttcctgagagagtcgttctttttttataatcaggcgtcatttccgtaggcaaagtttcccaaggaattaatatcatcgaaatcgccacttcaatagcaacataaacccaaagataatattgccaactactagttgaaatccaaaacattggaaataaaatcgcaaataatatcccgccgagcgcaataaagaaatgatgtcgtccatattttcgccctaattttgtccgatagaaccggtcagtaattgccccaaaaaagagggaccagatggcatcaataatccgaccaatccccaaaactgctcctgtaaataagggacttattccttgtgaaagaacaaagacaaagatgacgccagaaacaatattgttccagcctccgcccattaaatcggtcaagccgtaaagaagaccacgccttgtattaatttcttttggtgtgtaaacccatgaagttttttgtttttctgccattttaaacagattctcctatttttatatttttgtcagtgaaaattgacaaatttttccataaactttgttaagttgtgaactttgtgaaacgcttactccgtcgttctaaatttagcggagaaaagtctccgcacatttttttcacaaaaagttctttaaaatagattccttcataaaatttttatttactgattatttttttcaagagcctcccaaagcccattaagataacttgccccaagtgcacggtcatataagccatagcctggacgtcctgtttctccccaaatcattcgaccatggtctggacgaatatatccatcaaaaccattatcatacatggctttcagtattttatacatatcaagggaaccatactccgacatatgaggagcttcgtaaaaatctttttcaccacttggcaaaaatttgatatttcgcacatgtgcaaaaggaattcggtctcttttgataaattcagccataatttcatagacattattggctggatcttcggcaattgaccccgtacaaagggtgattgcatttgatggactatctacaacattacaaatccaatctaaatcctcacgatttttcacaacacgaggaagaccaaacataggatatggtgggtcatctgggtgaaccgccattttaattccaacttcttcacaagtgggaatgattgcttttagaaagtaggcaaagttttcgcgcaatttatgctcatcgacatttttgtaggcttcaaagaggtctttcacttctgacaatctttctggttcccaacctgggagtgaaaagccaccatcggccgcttgaacacggtcaataatttcttgaggattttctggaatgtccccagcaacaaaagccatcgtttgcgaattatcagctaaacgataatccaaatctgatttcaaccagtcaaatacaggcatgaagttataacaaatgacttcaattccaaattcagcaagattacgaatcgtttctttatagttctcaatatatttatcacgagtcggtagaccaatcttgatatcatcatgaatattgacagattcaattacttttaaacttaaacctgcggcttcaatttcctctttaagggccttaattctctctttgggccaaacttctcctgctggaatatccataatcattccaacaactcctttaacacctggaacttgggcaatttcagaaagttctaccttatctgcatttgaaccaaaccaacgcattgtcatttccatttttatacattgcaaattctgtcagtgtcagaatttactttcctttcttttaattgactcatattgtcagtaatttttactgtcaggtcctacataaactttctgtcagtaatttttaagtttatttttactgacaactcataatctgagcatctgtcagtaatttttcccatgtttttttagagcattttgtagcgtcgcaagtacagcccctttgccttgaatcatctcttcaaagtaagtctcaattttttctgctaagcccgtttgatacatctcatgtgggaaaatttgatgattagataagatgggtttcaaaatttcatgaatttctttttgactaccatctaattttacctcggcaacaaaagcttgtaactcttcaagaagagggtcaggacttggagaaaaactttctaactcatcattaattccgatcaaataacggcaccaagctgcaatgactaatggaataaattccaattctttgacagaaaatcttgggttggcaatatagtggccaatcgttaccccatagcgaacaggaattttttgtgacgtatctgccgcaattctctgtggtgtatctggaatatttttatttggtaaacgtttagtcagtaactggtcaataaactctgtcggattgataattttcggattcttaaccacaggcaaagcctcaccatatcctaaatttttaataagtgctaacaagtctggattagcaacttcttcccaaattgaatgataatctaataagcttccaaaaatggctaaagcagtatgaagagggttcaaacaagctgtaactttcatctggtcagcatcatttaccgtttcacggtcagtcaaaataactcctgctttttctaaggcaggtctcccgtttggaaaggcatcttcaatcaccaaataatgaacttcttccgtattaccaaaaggagcgatatttgtatgtttttgactatgtaaaatttctgtatcctcaaaaccgtcagctgtcagtaattctgctactttttcagacggattgggagtgattcggtcaatcatcgaccaggggaaactaacttttttaggattgatgagataatcatagaaatcttgttctacgatttcattttcaacccaagccttagcaatggtcaaaatcgcttcctgcaatttcaaaccattttctgaaaaattatctgtactgaccatggcaatcggaaatttaccggctttaaatcttgcataaaggagataagtaattgcgcccatattggttttgggcttacttcttccttgcatatcttcaagtgccaaaggcgtcaattgatctttggaatcacgaagtgaataacctttttccgtaattgaaaaagttgtgaattgcaaagatggattttcaaatacttttgttaaatgagcccaaccttcggtattttcagaattaaaataaaaactttcggaaacagaagcaattaattctttatcaaaagttccatcctatttcattgttactgatagaaaacgattatcataagcatgatagattttctcaatgacctcatcatcataagtttcagcaactataatcccagagttcagttctccttgatttaacaagtcttgcgcgacaaccgcgtgaaaacatctaaaaagatttcctccaccaaaatgaacccagaccggattatctgttgttgattctgcgacttttccttggtcaaactttggaatattaatctttgcctccgcaaatctctcgcttttttccaagtaattatcaagcaatttcaccattatttctcctttaattcaaaagtgatatatcagtttctcgtttacaaaaactagtatatcaattttaagtaaccgttgtcaaggatatatttaaaaaaagacaatgttttaaagcattgccttgatgatttgattttagacttgccctactttacttcaattcagtgtcgtgaaagacaaaacaaaaaaagaatagacggtgtatagctttaacaaaaatgtcccttttagtcattttcaacactgacataacagaagaataccttaagtaaaagctaataaaaaaaggaaatttattgcccttgtttcactcggtcagaattaaaaaaaggctcacagcttgaaaccttgtttcgacctactggttgtgctataattacagaatgaatgaattgaattttaatctacagaatcaagcctataagcaaattacaggtaaaattctccggaatgaatatcgtcctggacaaaagatttcacaaaaaaatatcgaaattgatttacaactcggtcgaacgcctgtcagagaagcacttcttcgtttacgccgtgatggactcatttatagcattcctcaatcaggaacttacgtcacaaaaattgatttagatgcagcaattaatgctcgattcattcgagaaaaccttgaagctaaaatagttgctgaggcagcttctttaaataatagtcttttgctaaatcaagcacgtgatgccattgaacttcaagaaaaatatgctgccaatgctgaatatcacaatttttttaatgctgatgaggaatttcataaaaccttttatttgatgaccaatcacgctcaggtttgggactggcttcaaaccattaatattcaattcaaccgattccgttggctgcgtcttgcgatttctgatttaccatggaataccttgattgaacaacacaaggaaattttaaaggccgtcgaaaatcacgatggagaaaaagccgttgctgctgctgccaagcacttacacttaatgtttgatgaagaaatggcagttttaaaagctttcccagaatactttgataatttaccagaataaaaaactctgccggaattccgtcagagttttttgatgagtaataaattaatatttattcaaggtttattttacagtcttagaatctggaatcaaaaacgaagtaaagaaagcaataataataagaatcaatcctgtaacaatcccacaaatataaccagaactgcttccaccaacactcgtatgtaaaactgttggtacagcatataaaataatgaaactgagaccagctcccagattaaacattccagcatttaatcccggaagatagcctggattatcctctggtgaaagcacaattccgagaccatttaacataatatttgttattccagcataggtaatcccaatgaaggtagataccaacaataaaagccagattgaaggttgtagcacgccagcaacagccaaaactattccgataatcgtcgttaaaagccccactcgaaggaccttcgcaaaaccaaagcgagcggccaagaagcctgaaacaggaccaaagaataagccagcaagcgcataaggagtaagggtgacaagagaaaccatatctgccccaagtcccaaaccaaacttaccatcttgacctaaagctggaataattccattcataattgcaaaaacaccagtcattgttaatagagttgtaattaataatccccatgttcttctttgcttcaaataattaataggaaccatcggatggttcactcgtttttccacttgccaaaatccaacgaaacaaatcagacctaaaagagccaagactgaagctaaaagccaattaggaagtccaagatttccaaagcttccttgcaaagcattcaccgcacttaagagcgcacccattgctactactaaaaggatgactccagtccaatccatttttggcgtatcttttgcagttgactcttgcgttccaaaacttactaaaagaatagcaagtgctgccgtaattcccataacaaaaaatacagaacggaaaccaccatggctcactaaccagccacctgctaatgcatcaactccagcaattccaccattaattgaagtaagtatggccattaattttgcatatctcttctcattgcgcactttcacgtgcaagatgattaaacaaagtggaactacagggccagcagcaccttgtaagatacgaccaatcatcaaaattcccacatttgtagcaaatccagaaataagacaaccaatcattgttaaggtaagcattccaatcagaactttttttcgtccaatcaaatccgccaaacgaggcagaaacaaagcaaataaggccgcagctgtaaaaaagatggtttgtgtcagtgctatagacgaagctgtcgtatgtaattgagcctgcatggtaaccaaagcaggcgagagcattgaagcattaagctgaaaagcaaagattgctaccaatagggcgaccattaaagccactattgagcccacattatcactagatttttgaggaacagtattttctcccattttttctcctttttttagaggataaactctctttatgtttcgcaaccttaaaagagccccagctatctattatattataaattttactttttgcgaagtttgaaaaggcgacttggacaaatttcttactttaagtcatgttaactctccattattttggataacttttatttgtgccagacacctattttacggtaaacagtgtcactattcttatcggataaattattatatagatttttttaaaatcttttatttaaatctcaagtttttatagaaaaaacagccaatataaagctgtttttcatcaattcatctcatcttacaaatacttttcttatcttgaatctggaaccttctagaggtcatatcctgcatttatcccagccactcttggagtaccaaggggaatgtttttactaatataattttatatgtatgattttgaacaatatgagcaggacttaaggggcttttatttgaatgtccctgaggatttacctaatgacatcatcaaaaaagaagaagaattattaatgaaaattaatgacggaaattttgattttgaacgattgaaggattttaatcaaaaatttaacttatggaatgatgggaaagcttgttctaaagttgttaagaggatttttaatgaaaactaaatcaattattttgacaataattcttggaattttttatccttttgccttcattatgagggtgaagaagaatcggattacttttatttctttggagcatggtaatttgtcaaaagattttaagttaatttatgaccgtttgaagcaaaaagataaatatgaactgcggacggttttgttcaaatttgaatcttctctttggggaaacataaaatatggctatgcttgtattcgtcagttgtttttaattgagagttcacgtttagtcattattgattataataattttgttgtttccaagtttccacatcgtaagaatgttaaagtcttgcagttatggcatgcgacaggcgcattgaaaaaatttggaaatgatgtggaacgagattatatcgttaatcattatgattatacaatcgctaactctgattttttaaaaccaatttttgcgcgtgcatttaatgtgacagagtctcaagtctttgtgactggaattccaaataatgataagatttttgaccaaaaatttgttgaccagacttctcagagattactagaaaaatatcctcttttaaagggaaagaaaattattacttatgcgccaacatttagaggacgaattagtacgcattttaaagaagcactaattgatttagagaaggttcatcaggcagttggaaatgattatcttattatttacaaaagccacccgcttattcagcattcaaattatgaaaaaaatgaacatgttttgtatattcaagatgaattgatttcttcacttttttgtgtgacagatattttagtgacagattattcggcgattgcaattgattggatggtatttaataaaccaattattgcttatagtcctgatttaatgacctattcgcataagccgggatttacgattgattatgaaaatgaatttccaggtcaagttactaaaaatgaagatgagttaattaaagcaatcacggctgttaatggtgaaacagagaatgataatttgaaacggcaacgatttactgacaaaatgtataaatttagagatggaaaatcaacggatcgagtcttagatttgattgaatcaataatggcaggttaaggagaataaaatgagtaaatccagaattgcagaaaatgacagtcacttaaaacgtggagctaaaaaaaagaaaagacctactttaaaaataattttggctgtgcttttgtttttggtccttcttataggcgctgttggtggaaaagtttattttgatgtgaaaacagctgtaacgaaggcttatgtgaatccgccaacgcaaatgacttctgtttccttaaaaaagaaggaggcgtttacgacggccattcttggaataagtaaaattgatgggaaagacgtcttagtttcggcagatatggcagcgacgaatccgcgtttgcaacaaacgacggttatcaatctttcgacaagtgctctgctgccagacaatcaaagtttactgactctctataattctgggggagaagcagcggttattaaagagatggagaagcttcttcaggttaagaccaataaatttgtaagaattgatttagaccaaatgggagaattagttcaggccattggtggtgtatctattcagaatgctaatgaatttactgcccaaggtttcaagtttcctcaaggaaccgttgccttaaacaataccaaggaagtagcagcttatttcactcgtttaaataccggagatacaaaaaaagattttgcacgtcagcaagaagttgtaatggcagttatcagcaaactcaaaagtccgctgcttttaatcagacattatggtcaaattttgacagtctttcctaaggtttttaaaactacttttaattttggaaatgttaaggctttagctttaaattaccatggagcaataagtattaaaaaaattaatatccacagtagcaaagtagcaggtcagtcagaagtcactgcgatttcacaagcaaatctcgatttggctaaagaacaatttcaagaaagtttaaaataaaaagataaaaatcattggtcaagcatccaatgatttttttatgacatctatttattaaaaaaagcaatttttggcaaaaagaatgtctttttcttaacagctttgactgcccttttttggatagtttatgtataatagaattagttagttttgctattgatatagcatcagaaatggagagatataatgcctaaaaaatttggtcgtattcatcttgttgtaatggactctgtcggaattggtgctgcaccagatgctgacaaattctttaatcatgacgttgaaacgcatgaagcaattaatgatgtgaaatcagacacgattggtcatatttcagaaattcgtggacttgatgtgcctaatcttcaaaaattaggttggggaaatatcccgcgtgaaagtccactcaaaacgattcctgctgcacaaaaaccagcagcttatgtcacaaaacttgaagaaatttcaaaaggtaaagatacaatgactgggcactgggaaattatgggcttgaatattcaaacgccattcccaacttatccagaaggatatccagaagatttacttgaaaaaattgaggaattttctggtcgtaaaatcattcgtgaagcgaataaaccttattctgggacagcggtcattgaagatttcggccctcgtcaattggaaactggagagttgattatttatacttcagctgaccctgttttacaaattgctgcacatgaagatgttatttctcgtgaagaactttataaaatttgtgaatatgttcgttcaattaccctagaaggttctggaatcatgattggccgaattattgctcgtccttatgttggagaagccggaaactttgaacggactgatggacgtcgtgactatgcgctctcaccatttgctgaaactgtattagaaaaactttacaaggcagggattgatacttactcagtcggaaaaatttcagatattttcaacacagtaggtgttaaatatgatatgggtcataaccataatgatatggatggggttgaccgtctacttaaagcaatgacgaaaactgaatttactgaaggattttcttttacaaacttagttgatttcgatgctaaatatggacatcgtcgcgatgttgaaggttacggaaaagcaattgaagactttgatggtcgcttgccagaaatcattgatgcaatgaatgaagatgatttgttgatgattactgctgaccacgggaatgacccttcatacgtaggaactgaccatactcgtgaatatattccactcgtaattttctctaaatcatttaaagaacctaaagttttacctgtgggacattttgctgacatttcagcaactattgctgaaaacttctctgttaaaaaagctcaaacgggtgaatcattcttggatgcgttagtttaaaataaagtgattctgtcagtcaattttactgacagaagcagaaagaaaaatctatttatggctaaaaaagcattttgccaatcttgcggaatgccaatcgctgatgattcttacaaaggaacagaagcaaacggcgaattttcaacagaatattgtatctattgctatatgcaaggtcgttttgttaaaccagatcttacttttgatgaaatggttgaaattggacgaaaaggtttggataataatccaatgcctaaaatgcaaaaatggcttttcaaaaaactttatccaatgcaactcaaaggtttgaaacgctggaaaaattaagttcttaacttactgacgaaaattctgtcagtaaatttgataattatattaaaagaaaaggaaattaaaaatgccaacaccacatatcgaagctcaaaaaggcgaaatcgcagataaaattctcttaccaggagatccacttcgcgcaaaatttatcgcagaaaacttccttgaagatgctgtgcaatttaaccaagttcgcggaatgcttggctttactggaacttacaaaggccaccgtgtctctgtcatgggaacaggaatgggaattccttcaatctcaatctatgctaatgaattgattacggaatatggcgttaaaagattaattcgtgttgggactgctggttctgtaaatgaagatgttcatattcgcgaccttgtcattggtcaggcagcagcaacaacttcagccattgtccgtcatgattttcctgattttgatttcccgcaaattgctgattttgatttgcttgataaggcttatcatattgcaaaagacctcggaattacaactcacgttggaaatattctcagctctgatttgttctatggtggaccagatgcagttaaagttggaaaactcggtgtgaaggctgtcgaaatggaagcagctggtctttattatcttggggcaaaatataaagtgcaaactttgggaattatgacaatttctgaccatattttgacaggagaatcaacaacgtctgaagaacgtcaattgacatttacagatatgatgaaagttggtttggaaactttgattgctgaataattaatttagagctttgttttactgacaagttgagttaattctcaagctaagtaaatttctgtttcttaaaaaaaatagacctttagaaggtctattttttatcactcaagttctattttattagaagagttttccatcttctgttatttctgaaaataaaaaagcttattcaaaagcttttttttattttagataaactttccttccatcttttcagagatgaggtaaagtttcttatgcattaaatttagatttacttgtaatttggccagaagctttgtcgtattgaacggtaacactctctgttgaaccttttgtccaagaaactgaagtccagtttactgtaactaaagtttgatctccaatgctagattcagaagttgtagttggtttaccaacttttccttcaatatcagcataaggtgtaccgccactttaagccattgttccatcattgttaaagtttgcagttgctgaaacgatagaatcataaatttcttgtgtccaaccagattttcgtttttcagaagagctagatgaagccttagaattgctagaagatttagaggccgccgtagattttgaagaagaatctttattcttatcttttcctccgcctccaagcgcgctaccaatgataacaacaaggatgactacgacaatccaaaaccaaattcttttatagattgttttttttggttttggagtttttccatttctcataaagtttaatattcctaacctaattaaagcttataaatcaaaaacatttgggggaaaaatcaagtttttgtagtttattaattctttgaaatattctttaatagtaatgtaatttacccatataaacaatcaaagtgaaaaaatgtttttaaaaagtatttataaatacggttacaagaaatattaaatatagtgtaagtagaaacttatcaaaaaagtaggagaggtgagaaggatttttgtaaaataaaaacttcacttaaagaatttttttatattcattttttagtcaggcgggtcaatacaaaaggaatctatcaatttcatcgggcttttgaaaaggtagatagaaatcttaaaaatttaagcatctcgcaaggattttttgactacatttaatagctatgaccatctggcaatttattagtgaaaattttcatttttggatggaacatttcttagtcaaaagctgtaaatttttgatatgatggaataaatgaaggcaatttagaaagcctcaaaaggagaaaagatgacttacgaagattttatcaaagaagcaggattggcaagagaaaattttagatgggcttgggcattttgtaatgaggttaatggtccaataactgagccagaactagcagatgaattattaaacttagttttagtgggaaaaaagagtgcaactgcaagtgctcttgctgattatggagaagatgaaccattgccaagtgttgatgggaagtttgatattttattagatgggaagggtcaaccaagagccgcaattaggacttcaaaagtatatgttcgaaaattttctgaagtgagtgcggaacatgcttacaaggaaggcgagggagaccaaagtttagaatattggcgagaagttcatcaggatttttggaatgggctaggcatctatcaaccggatatggatgttctttgtgaagaatttgaagtgctctaccaaaaatagaaatagtaaataaaaatcgttgattatttttaaagtcgtgctataattatcttaaatttatgctttacgaaaagaggaacatgatggatgatatgcttattgtgaccaccaatgaggttgcgggttatcgaattgtagaagtttatggtgaagtttttggcttaacgactcgttctcggaatttattttcaagtgcaggtcaacaaatgaagactgttgtgggtggtgaaataaatggttatacaaagcttcaacatgatactcgtgaaacttcgattggtcgaatgaaagaagaagcgaaagcaaaaggagccaatgcgattgttgcaatgcgctttgactcatcaactttccaaaatattgactctgtcgctgcttacggaacagcagttaaaattgagaaaatctaaagattagctgaggctagtctttttttatttccgaacaatttttgaccaaaggaactatattaaatatttttgagagtaaattatagaaaaatttgttagaataatattaaaattagtatgatttaaagaaaatttaagtttatattttcagaggagaattatgaaaacagatattgaaattgcccaagctgctgaaattcaaccaattactaaaattgccgaaaaaataggattatcttttgacgatattgaactttacgggaaatataaggctaaaattcccttagaagtgttagaaaagtttgatgaacaaaccgatgggaaattggttttagtaacatctattaaccctacaccagcgggtgagggtaaatcgacggtgacagtggggcttgctgatgcctttgccagacaagataaaaatgtaatggttgctctacgagagccttctcttggtccggtcatgggaattaaaggtggagcagctggtggtggatttgctcaagttcttccaatggaagacattaatcttcattttacaggagatattcatgccattacaacggctaataacgcaatttcggcttttctggacaattcgcttcatcaagggaatcttttaaatattgacccacgaagaattatctggaaacgtgtgcttgatttgaacgaccgtgctttacgtcatgtaacgattggactgggaggaccgcttaatggggttcctcgtgaggatggttttgatattacagtggctagcgaaattatggctgttctttgtctggcgacttctatcagtgatttgaaagagcgtttagcaagaattgtcatcgctcaaaattatgaccgtaaacctgtcagtgtcggagatttaggggttcagggggcaattgcaatgctcttaaaagatgcccttaaaccaaaccttgttcaaacaattgaaggaacaccagctttaattcacggtggaccttttgctaatattgcccatggatgtaattctgttttagcaacaaaaacagcacttaaattggctgatattgtcattacagaggcaggatttggagctgaccttggtggtgaaaaatttttggatatcaagacacgtcagttagggaaacaacctgatgctgtggtagttgtggctacgcttcgtgcgcttaagatgcacggtggcgttgataagaaagaattgacaagtgaaaatgtcgaggctgttaaaaaaggttttgctaatttggaacggcatatcaaaaacatgcaaagttatggcctgccagtgattgtagcgattaatcaatttgcatcggatacagagtcagaaatttcaactttaaaagaactgacagaagctttgggagtttcagtttcactaactcaagtttttgctaaaggtggcgaaggtggtttagatttagctgaaaaactgtcagcaatgttacaagcaaaacctgattttcgttatctttatgagctaaatcaacccttgtcagtaaaacttgacaaagttgtgacagaaatttatggcggttccaaagttaatttatctccgaaagctaagcgtcagatgagagaaattgaagaaaatggttggaataacttaccagtttgtatggctaaaacgcagtattcattttcagaccaagcgaatcttttagcagctcccgaaggctttgaggttacagtgcgtgagctgattccgaaaatcggtgctggatttattgttgctcttttaggagatgtgatgacaatgccaggtctgcccaaaaatcctgctgctttaaaaatggacgtgactgatgatggtaaaatctcaggattattttagaaatggatttcaagggatttgttactgtaaaattaagtgtaaatttttttggtaacaaatttacaaaaaattaaaagcttgtaaaaccgcttgtcaggcggtttttttgtgttatacttgctaacaatgttgaaaaaaataattatttccgcagcacttatggtaagttttagtgctgccatgattgctaatcctgcaaaagcagattcagtatttgaagacaatgacgcgcagagttcactaacagatctgtcagcagcgactagttcacttgatgttttaacaaaaacaatgaatgaaacagtcagtgccgtatccaaagtagaaaaaacacaaagtgttgccaaagaagttcaatcacgagctgataagcttgtaagtacagctaaaaaatatatgggtgttccctatgtttggggtggaactacaccagccggctttgattgctcaggattcacaagctatgtctatagagaagttttaggtaaagaaattggtcgtaccacttgggaccaaatcgcaagtggcaaacaagtagcactcgaccaagccaaagttggagatttgattatcttttacggcggggaccatgtaggaatttatcttggaaatggtcaggttatacatgccccacaaccaggagaatcagttaagatcagttcagttaccgatatgccagctgatttcgccttagaatactaaatataatagaagaaagtaatgatatatcgttacttttttatttgttattcttatagctaaaagtggctataagtttttttatggcaaattggttaagttcatgttaagataggtctatcaaatttttaaaggggaacttttatgagaacatcactaaaggtcacatttgctgctctttcacttatcgctgctggaactttggttgcatgctcctcaggttcaaaaaagacgtcagataataaaacaacatcaattgtaattgcgacagatggtgcaacaaaaccatttacttattcagatagtcaaggaaatttaactggttatgatattgaagtcgctcgtgctgtcttcaaaaaattgccgcaatacactgtgaaatttcaagccacagacttttctggaattgcgccagggattgattctggtcgatatcaaatgggtgctaatgattttggttgggaaaaaagcagagctgaaaaatactatttctcatcaccactttccaaatctaataacgctgttcttgtgaaatctggaacttataaaaccttggcagatttggctggaaaatcaacaattggtaatccagcttcaaattatacaaaatcaattcaagattggaacaaagccaatccagataagcaaattaaaattagttactcagcagattccacttctattaatactcgtttcacacaagtagaatcaggtaagattgatttcatgctttatgataaaatttctttacagtcagctgttaaagaacaaggatttgataatctaaaaattgaagatatcagtatggatactggcgatgctgaacatgacggttatgaatatttcctttttggtaaagataaagaagggcaaaagcttcaaaaagatgtgaatggagtattagctaaaatgcaagctgatggtagcttggctaagatttctaagaaatatcttggtggagatttcgtcccaaaagctgagatgtttaaatagacagttctgacgaaaaatcctattttaattagctcattttgtcagtaaaataaatattttataattcatcaatttactgacagctctattcgtaaaaaataggagaaaaaaaggccaaaattttgtataatagtagaagtgatggtaaggtaaaaaatcgagccaattagtaaaaagcatgatgctaaactgataagctcaaaaattcctaataaactctgtcacttttttactgacagagttttgcctattagaaaattaaaataatatgaaaaaaaacaaaaaaataattcttggaattgccttacttttggcacttatcattttgccagctcttccatttctcttaattaaaggtcagtacaactttcatgacttttggacaatgtttttcacaaagattttcagttggtcagcctttgtggacgcctttgtaccaattattaaaatgattccatcttcacttgaaatgacaatcattgccatgatttttggtttgcttttgggacttattcttgccttagttcgtatcaataaaattcctattttaaatcaacttcgtgctttatttgtcagctttattcgtggaacgccaattttggtgcaattatatctttcttatacagggattccactgattttaaaagcaatcaatatgaactatggaacgaattataatgtgaacacgattccggcaatgctttttgtaattgtggcctttgcccttaatgaaggggcttataattcagaaactattcgagcagcgatccaatcggtagataaaggacaaattgaagcggctaaatcacttggaatgacgaatttccaagtctttatgcgtgtcactttgtcagaagcggcaacagttgcgacagctccgttaggaaatgctctgattggtcttttgaaatctacttcactcgctttcgttgcgggtgtggtagaaatgacggctcgggctcaaattattggtggctcaactttccgactgtttgaaacttatttggccttagccttggtttattggccaatctgtatcatttttgaaattttgattagagcattagagcgcaagttggacgtcagaatgccaaatgataaacgtaaaaatcgtgctcaaatttctttgagtaaaaatccgtttgaccaagcataaggagggctctgatgattaaaattacaaatataagtaaaacattttctggcaatcaagttcttgaaaatataagtttggacattgaagaaggagatgtcgttgcactcatcggtgcttctggtgcaggtaaatcaacttttttaagaggattaaatgatttagaaagacctgatagtggtcagattgaaattgatgatttaaagattgattactctacaatcactaaacaagaagtgcttgaattgcgccgtaaaaccggaatggtctttcaacaattcaatctttttgagagacggacggctcttgaaaatgtgatggaaggtttgattcaggtcaaaaaattatctaaagcagaggcgacagtaattgctgacgccgaattggctaaggtaggtttgacagaccgtaaagattactatcctaaattcttatccgggggtcaaaaacaaagggttggaattgctcgagctttagcgatggaaccaaagctcttgcttttggatgaaccaacatcggcacttgatcctgaattagttggcgaggttcaagaagtaattcttaatgccgccaaaaataaacaaacaatggttcttgtcagccatgaaatggactttgtttataatgtggcgacaaaagtacttttccttgagcaaggaaaaattatagaagcaggaagtcctaaagaagtattttactcaccgaagaatcctcgtacacgagagtttttatcacggcatgtcaagaatttagaggtcaataactaaaatgatgattttacagttttatctaaaaggtttactaatttcagccatctttgttttattggtgggtgggttttatgcttttacttacctagtgagaaatacaaaaaaaccatgggctgaaagaagaaatagaatttttgatttgattttggttgggatattaacaacaccaattttgagttttgccgttttaggcgttcttgtaattttaaaaattcggggcctatgaatttaatttatttttttaaataaatctaattaatggaaaaaaatcgtttgacaatgtaaaataaggctataagattttagatattagaaaaaagagtttttagatctaataaatgaagagctcaagtttgcttaaaagctagcttgagtttataaatttaagggaagttcttaggctcttagaaaagggattaaaaaatgacagaaaagaaatatgatgttgtcatcattggttcaggccctgcgggaatgactgcagcgatgtatactgctcgttctgaaatgaaaactttgcttttagagcgtggtgttcctggtggtcaaatgaataatacagcagagattgaaaactatcctggttatgaaacaatcatgggacctgaactttcaatgaaaatggctgaacctttggaagggttgggagttgaaaatgcttatggttttgtgactggcattgaagatcatggtgattataaaaaaattatcaccgaagatgatgagttcatcacaaaatcaatcattatcgcgactggagctaatcaccgtaagctagaaattcctggagaagaagaatatggagctcgtggagtttcttattgtgccgtttgtgatggtgcattctttagaaaccaagaaatcttagtcattggtggtggggattcggctgttgaagaagcactctatttgactcgttttggtcaatcagtgacaattatgcatcgtcgtgataaattacgtgcacaagaaattattcaacaaagagcttttaaagaagaaaaaatcaactttatttgggattctgttccgatggaaatcaaaggagatgataaaaaaattcaatctgttgtttataaaaatgttaaaacaggtgaagtaactgaaaaagcttttggtggaatattcatttatgtaggacttgatccagtagctgaatttgtgagcgatcttggaattactgacggagcaggttggattattactgacgaccacatgaggacaagtatccctggtatctttgccgtaggagatgttcgtcaaaaggatttccgtcaaatcacaacagcagttggtgatggtgctcaagcagctcaagaagcttataagtttgttgttgaacttggataaaataaaaattactgacaaagaagtcagtaattttttgtaaaaggattcggaatgacatttaatagaaaatatggtaaactgtaagtaacgcaattttgaaaaaggagattaggctcatcgcctaaataatttataagactatggaaaaagtaatttatgacattttgcttgttgcaatgcttgttgtttcagcatttattattatagcgattttcatgcaaccttcaaaacaagatggagcggcagatgctttttctggtggaacgggtgaattgttcgaacgtcgtaaagcgcgcggttttgaagctgtgatgcagcgttttacagcaatcatgattggtttatggctagtcattggatttgctcttgttgttttatcaacacgttaaaattgcgggctgaaaacagtccgtattttattttttaaaattgtgttaaatgtttcaatgtcgcaattgtcagtggtagaattgattctatcagccaactgggtctgataaaatgattaataccactgataatcattagaatattagctaaaaatcgagccaatatttaaaaatattataataagaaaggggcttcttgtccgatttttgtggtcaaggaagcttacttgagagaataaaaatgagtattagagaagtaattatggactatcttgagaatagttcaaaaaaagctctgtcagtggaagaattgtcagttgctttacatatgaataaggccaaagattacaaagtttttgttaaaactttggcttcactagaagctgaacacttgcttcattttactgctaaagggaaagtagaattagcagaacaagaggaagcaaaagtagttatcagcgggattttccgagcaaatgcggctggatttggttttgtaagtattgatgctgacgaaccagacgtctttattggacgcgggcaaacaggttttgcacttgatggagatgaggtttttattgagattgataagaatgccaactccctaaaaggaacggctgccgaggggcatgttgttgaaattatccgtcatgagcttcatcaagtcgttggaacttttgttgctttaaatgatgaagaaaaagagcaaactggactgattggtttcgttaaatctagaaataaaaaaatcccttatcgggtatatctgggtgatgaaggactcaaaccagaaaataaggcaattgttcgtgtagaaatcacacattatcctgataaagaatttcctcaaaccatgcaaggactggtaacggaaattattggacaggcaaatgaccaagggatagatgtgttagaagttttgacttcaatggatattgtatcagagtttccaaaagaagttttggatcaagctgattcagtgccagaagaagtgccagaaagtgaaattgcgggtcgagttgattatcgtaatgaaattacgttcacaattgacggagctgatgccaaagaccttgatgatgctgtccatgccaaacgtttaggaaatggaaattatgaattaggtgttcatattgcggatgtttcccactacgtaacggaaaattcacctttagataaagaagcttacgaacgtggaacatcggtctatgttactgacagagtggtaccaatgttgccagagcgtttatcaaatgggatttgttcattgaacccacgtttgaatcgcttgactcaatcctgtgtgatggaaattagcccagaaggtcgagtggttaattatcaaatttcacaatcaattattaagacaactgaaagaatgacttatgatgcggtcaatcaaatgattgcaggagctaaagacacgcttgaaaagtatgctaaaattgctgattctgtgaaaatcatggttgaaatccatcatattttagaagcgatgcgtaaacaacgtggagccattgatttcgacacggtagaggcaaaaatcattgtaaatgaaaaaggcttacctattgaaattagaaaacgcagtcgtggcattgctgaacgaatgattgaatcattcatgctcgaagccaatgaaacggtggccactcattttgaagcacatggcttgccatttatttatcggattcacgagcaaccaaaagcagatagattacaaagatttattgattttgcagcaacttttggaatgcaaattgaaggaacctcaaacggaattgatcaaaaagttttacaagccttcatgaaaaaaatcaaggggcaacctggtgaaatggtcttgtcaacaatgctattgcgtagtatgcaacaagctcgttattcagaaaataatgagggtcactttggtttagctgccgaaaattatactcactttacctcacctattcgtcgttatcctgatttgttggttcatcgtttgattcgtgaaattggtgcgggtaaaattccagcaaatcttttacaaaaatgggaagaaaaaatcccagaaattgcggagcactctagtcatcgcgaacgtcgagcggttgatgctgaacgtgaagttgaaaaaatgaaaaaagccgagttcatggaagaacatgtggacgaagagtttgaaggaattattgcttcagtcactcgttttggtatgtttattgaacttgaaaatacaatcgaaggattagttcatatttcaacgttgaagggtgattatttcacttatcatgagcgaatgttagctttgattggtgaaagaacaggattgacttttaaaattggtcaaccaattaaaatcaaagtcgtcaaagcggataagatgacaggcgaaattgactttgagtaccttccatcagaattagatttgattgataaatcggctaaagctaagaaaaagcctgaatctaaaggtcgcaaaaaatcaaatcaatcccttaaagttaaatctgtcgcaccaaaagctgctggtaaagctggcagtaaatcaaaagagggtagaagtactgatgaaaaacctgaatttgataagaaaaagaaaaattcagacaaaaaacctttttatagcaaagctgccaaaggtaaatttactgacaaaaaagagaatggcaaaaaatttactgatggaataaaaaaagcacacaaaagaccttaaattttgaaagaagaagaaatgaaaactttgaatttaaataaaacagcattagtcatcatcgatttgcaaaaaggaattgctggtcgtgaaggttttgctccttattctgcacaagatgtgttggccaaaaataaagagctcgtaacaagtttaaaaaatacagaagctttgattgtttttgttcatgttaaaaattatggtgaagaagctctaaaaccaaaaacggataatccccctcttgcacatgggcaaataccagcggacttctctgattttgtcatgccagaagcttacgataaagactatgacaatgttatccatgttgctaaacacaactggggggccttttatggaacagatttagatgtccaattgcgccgccgtggaattgaagaaattgttctgagcggaattgctacaacgattggttgtgatacaacggctcgtgaagctttccaacatggctatcaagtgattgccgtagaagatgcaatgactgattttaatggaagtttgcacaagggaattgtggacggaattttcactagacttggacgagtgcgttcaacacaagaagtagtaaaaatgattgaagaaagtaaataagtttaggccacccagtttactgacagagattttcggagtctttgtcagtaaatttcctaaaatatttagtgaataatatgaaaaattgtttgaaattaattggaaaaattattgtcagcattattttagtttttgctgtcatcatcggctcatacgttatttatgtctatgctcaatatcatcgtctgccaaatgatatcaagcaaagtatcaaaaatccgcaaactcaacaagttgaattgggaaaaacctataaaatgatgacatttaatattggttatggttcctacccaccttcttttaattttttcatggatggtggagatgatgtgcatgcttacagcaaatctgctgtcaagtctgcgattcaagaagatattagacttattaaaaaagaaaatcctgatttcggaaatattcaagaaattgattggcaaggagaccgaagtcagcaggtgaatgaacctcagttggtacgcgcaggtcttcctgattatagtagtgtattaacgcaaaactatgactctgcttatctattttatcccgtgacaaaaccaattggaaaagccaaatctggcattatgacttattctaaatatgaaattgaaaattcaaccagatataagttaccaatcgaaaccaactttaataaattttttgatttagaccgggcattttctgtcagccttttgcctatcaaaaattcggataaaaagtttgtaatttttaatactcacttatcagcatttatcacagaccaaaaaattcaaaagcaacaattagtgacactctttgatgcgatgaaaaagtatgtcaataaaggggattatgtgatttgtggagcagactataatcatgccctagctggtaaagctcatccagaattgacttggatgaaggagtttccaacggagaatttgactaaaggaatgcgagtagttgcaccaactaatgcaccaaccgtgcgctcacttgattttgcttatcatcaaaaaaatcccaaaaatacttttggaattattgacggatttcttatttcaaataatataaaagacttaaaaatacaaaccattgataatcaatttaaatcgtcagaccatcaaccagttctcatggacttttctttagaaaaataaaaagcgcttagcgctttttttgtttatctaaaaatgatacctagtaaaagagtgatagcaagtgaggcattaaatagcataagattgttaatctgtaaatggaaagtttctgatttactttgctttgccctgaatttttgaatattaggaataactctaactgaaatgattagcatgagtagtgaccaaatgggtaaaattttgagacaaatagcaagtagaatacagagcccggcaaaaagataaagtccagtaaatatttttaaactcagtggaatttttaaataataaggaagggtataacgctcgttacgaatgtcttggtctaaatcgcaaatattgtcagaaaacatgatattaaaattttgaacaaaacacatcaagccgactaaaagtattgggagaagaattttaaaatcccaagtccaagtcatgagccagtttttgtcaaagctaatgaaaaaatatcctttgtcataagaattaagatagaccgcaaggaaaaatccaaagaatccctcacaaagaccggctaaaagttcacctagaggaaagcgagagaaggcaaaaggaccataggtatagaaaatagcaatcaaaaaacaaaggccaccaatgggaagaacagcaagattagtcatgaaaagaacaactagtccaacaattacatcaacaactaagaaagacaagcatatttttaaagcaagtttaggattaattgatttggcaacgataatattccattttttatattcagggtcaagagctttttgataatccattaaattattccaagcagagacaaaaagattaatactagctaaaccgataaaaaagaaaaaggtgggccaaaagtggaagcttttaaaataccaaagagcaaaaagacagccagcaattggtgagagcaaagccgctggtaaagtttgaatacgtgtaaaattaaagaaagtttttaaagtcatgataagctgattatagcaaaataggggagataaaacataattcaaatgtactgacaaagctgtctaaaaaactttatttacttgacaagaaaattgactgaaaatttaaataaaaatgttataatagtataaaaatttgaatggagaaacaaaatgcgcgcagttgtaacagtagtcggagcagataaaatcggtattgtcgctggagtcacagcgacattatcagaattagaagcaaatatcattgagatttcacaaactttgatgagtggagcttttaccatgatgatggttgttgaaactagaaacagtgatttttcagcttttcaagctgaactttcaagaaaaggtgaagcacttggcgttaatattcatgttcaaaatgaagctatttttaacgcgatgcacaaattgtaattgactgacagaaaaaattagtcgacgaattacttttattattaagcatttttactgacagagattaaaaatatttctgtcagtaatattttaaccaaaactaaggaaatcaaataatggacatccaaaatatcaaagaaacaattgcgatgattgaagaacaaaatttcgatattcgcacaataacaatgggaatcagtcttcttgattgtattgatgctgatattgacaaagccgctgaaaaaatctatcaaaaaattgtcaataaagcaggtaaacttgtcgaagtcggcaatgagattgggcacgaactcggaattaagattgtgaacaaacgagtttcggtaacgccaatcgcaattattggtgcagcaacggctgctgatgattatactccgcttgccctggctatggaccgcgcagcaaaagaaataggtattgattttatcggtggctattcggcactggtgcaaaaaggatatcaaaaaggggatgagattttgattaaatctatgcctaaagccctagcagcaactgagcgcgtatgtgcatcagtaaatgtcggttcaactaagagcggaattaatatgacagcagttcgagatatgggtgaaactatcaaaattatgtccaaaggggacaaatggctcaatgctaaacttgtcgtttttgctaatgctgtagaagataatccctttatggcaggggcttttcatggtgtaggtgaagcggatacgattatcaatgttggggtttcagggccaggtgttgttaaacgtgccctcgaaaaagttcgtggcgaatcttttgatatcttagctgaaactatcaagaaaacagcatttaaaattacgagaattggtcaactggttggacaaatggcttctgaaagactgaatgttgaatttggaattgttgatttatcactcgcacctacaccggcaattggggattcagttgcgcgtgtcttggaagaaatgggcttagaaactgttggaactcatggaacaacagccgcacttgccatgcttaatgatgccgtgaaaaaaggcggagtcatggcagctgaacgtgttggaggactttcaggagcctttattccagtttcggaagacgaaggaatgatagcagccgtgaactctggagcgttaaatatcgaaaaattagaagcgatgacttgcgtttgctcagttgggctggacatgattgcgattcctgaagaaacaccagcctctaccattgcagctatgattgctgatgaagcggcgattggtgtcattaatcaaaaaacaactgctgttcgtattatcccaatgggtaaagaaggagagcaaattgaattcggaggtctctttggtgtggccccggtcatgcgtgtcaacaaggcatcatcagcagattttattgctcgtggtggacaaattccagcgccaattcactcatttaaaaactaaaattgacttcaacgtcaatttttaatattttaaaaaaatgaagagcgcttccaaaaatgatataatgatagaagtggaaaaacggaggttattatatggcttacaaagtaaattttaaagaagtagaaacggtcggactagaaagttctcctgtagcagaggctttagcaggtttacgggctaatgaagcacgatatttttggaataaatataaatttgaatatctgacttatccagctagtgaaaagcaggaagaagttgctttgtttgagcagattttacttgaagaacgcgatttgaaattttcggcaaaactgcttgaagtggctatttatgaaagtgatgaactctactggccagaattttattatgaagatggaatggttttaaatctgctttatgaaaaggtcggtcaggaaggcaagaaaccgaaacgtgcggtcggcattaaattttccgttgggatggaaatccctaaagaacttgaaggaaagtttaaatttgcgcgccaacgctcaaaattagcaggtgaagtgcgtggctcatttttcacagttaagcaagaatggctttaaatgtacaaatagaaaaaagatatcgtaaagcttttttattaaaatcaaatcattaaaaaggggagtagtgatggtaaatatttatttggttcgacatgggaagacaatgttcaatacaattggacgagcgcaaggttggtctgatacacctttgacagaagctggagaacaaggaattattgaacttggcttaggctttaaagaaaaaggaattaaatttgatcgggcatattcgtctgattctggccgaacaattcaaacaatgggctttatcttagctaattctgataacgaaggaattccttatacttacgataaaagaatccgagaatggtgttttggatcgtttgacggaggctatgatggcgaattgtttgatggagttttaccaagaatatttaccgaaactgggaataatcatactgatgaatttccgcctgatgaagtgattgctaatgcaatttttgaagttgatacggcaggctgggctgaaccatgggaaaaactttcaggtcgtatcatggatggttttacagacattgctaaagaatctgaatcaaaaggagccaaaaatattgttgttgtcagccatggtatgaccattggaacttttgtaaaattggctcaacccgaacttcctcgtccgcatggtcttgataatggttctgttactcatttgacttttgaagacggaaaattcactatcggaaaagttggggacatgtcttatcgagaaataggaagtgaaaagttagctaaaaaatgaaaaaaagaattacttttagtttaattgtgcttgttcttttaatcgtcggagctttgggatttatattaatcacaaacaataggtcgaattcaaccaatgaatcaacaaaaaaaacaagtatttcatcatctaaagaagtggcaaagaaaaaagacttaccagattcaaaaaggtctgactgggatttagttttagtcagccgagcatctcctaaacctgaaatgaacccaacattagccactgttaatgggattcaagttgaccaacggattgcaccagcagttcaacaatttttggctgcggcccaagaaatttcaccagcggagcatcttatttcaggttatcggtcagtttcataccaagaaggactctatcaatcttatgttcaagcagaaatgaatggtcaaggaacggtcaatagtacagggaatcctatttctgaggaagaagcaataaaagatgtacaaacttattctcaaccaccaggaagttcagagcatcaaactggtcttgcaattgatatgagtaatattgatagcctgaatgaaagccaatatgccaaacaagttgcggcgattgctcccaaatatggttttatgcttagctttccagatggtaaaaaagcagtcactggaattggttatgaagattggcatttccgctatgttggtttagaaaatgccaaatacatgactgagcaccaattgacgttggaagagtatcttaaattattaccagcttaaaggaaattaggaacatgttaaatcgaactagacttttactttatgtgaacgttgctctctttatttacagcctgtcagaaatgattaaaatccttcttgttcataataatttctttagtcaattttttaataatctctctagtaacctcaaatctttaacggataagatttcgtcagcaattacaagttggcaaagtattatctatttattgatttttgtcttattaatctttttgttattaaaattttggcgtgtgacttttattcttttagagattattatggcacttttaattattgactatgttttgctttttgttcaacatcaagttggatttgaaaatctttttattattgctgtaatggtagttacactaatgaatatctggcagacatccaaagattctaatcttttataacagaaattagcactctaataaaaagagtgctaatttttatgtcttttttcttgacaaggtataaacaaagggttataataaacttgttagcacttagaggtaaagagtgctaaaagaaaaaacttagagataaagaaaggagcagctatgattacagaacgtcaaagacaaattttaaatttgattgtttcactttatgctaaggaccatacaccaatcggttcaaaatcgctccttgatagtatccaagcctctagcgcaaccattcgaaatgatatgaaagctttggaaaggctgggtttgattcaaaaggaacatacctcaagtggacgcattccgagcgtttcgggctataagtattttgtggaaaatgtcatccagttagaagagttcagtcaaaatgacttgttcaaagtgatgaaagcttttgatggcgatttttatcgcttgtccgatttgtttaaaactgcggctaaaagcttatcagaactaacaggattgacgagttttgttcttaatgctccgcaacgtgaccaacaattagtctcatttgaaatggttatacttgataatcactcggtgctctcggtcattactttgggaactggtgaggtaagaacaaatcaatttattttaccaaaatcaatgacagaagcagatttagctgtttttagcaacttggttaaggaacgattagtcggtaaaaaagtgattgatattcactatacgttacgcactgaaattccacaaattgttcaacgctattttaaggtcacgagtgaagttttacaactctttgaatcaatctttgatgatttattcaaagaacatctgacagtcgctggtcgtaaaaatatttttgactatgcgacggataatcttgcagagctctataaactctttagtgatgatgagcgaatgcttcatgaaattcgcgagattacaaataatgatgaaatgagagctgttaaatttgataatgatgaaaaatttatgaaaaatttaacaattatctcgcaaaaatttgtcattccttatcgtggatttggtacattgacagttgtaggacctgtagaaatggattatcaaagaactttatcagttcttgatttagttgctaaagttctaacaatgaaattaagtgattattatcgttaccttgatggtaaccattatgaaattagtaaatgattaaaaagttatttaaaaaaggagggcctatgtccgaagaaactaaagaagaaatcaaaaacgaaaaagttgatgaagaagtgactgaggagttaacagaagaagcgcttgaagatatcgttgaagaagaaatcaatgaacttgatgaagcgcaaaagttagcaactaagtgggaaaataaattccttcgtgtttctgctgaaatgcaaaatgtgcaacgtcgcggaaatgaagaacgtttacaacttgtcaagtatcgctcgcaagatttagcaaaaaaaatcttgtcttcattagataatcttgaacgtgcacttgctgttgaaggtttgacagatgatgttaaaaaagggcttgaaatggtacaagaaagtttaatttcagcccttaaagaagaaggggttgaagaagtttcttatgaaagttttgaccataaccttcacatggctgttcaaactgttccagctgatgacgaacatccagctgacagcattgtgcaagtcttccaaaaaggctaccaacttcacgaacgtttactacgtcctgcaatggttgttgtagcacaataatttaataaaaaatattgaccgcaaagtctttaaactattcataagtaaaagaaataaaggagatttaaaatatgtctaaaattatcggtattgaccttggtacaactaactcagcagtcgcagttcttgaaggaactgaatcaaaaattattccaaatcctgaaggaaatcgcacaactccatcagtagttgcatttaaaaatggtgaaatcatcgttggtgatgctgcaaaacgtcaagcagtaacaaatccagaaacaatcatttctatcaaatcaaaaatgggaacatctgaaaaagtttctgcaaatggtaaagaatatacaccacaagaaatttcagcaatgattcttcaaaacttgaaagcaactgctgaaagctaccttggcgaaaaagttgaaaaagcagttatcactgttcctgcttacttcaatgacgctcaacgtcaagcaactaaagatgctggtaaaattgctggtcttgaagtagaacgtatcgttaacgaaccaactgccgcagctcttgcttatggtcttgataaaacagataaagatgaaaaaatccttgtctttgaccttggtggtgggacattcgacgtttcaatccttgaacttggcgatggtgtctttgatgttcttgcaactgctggtaacaacaaacttggtggtgatgactttgaccaaaaaatcattgactggatggttgccgaattcaagaaagaaaacggaattgaccttggccaagacaaaatggctttgcaacgtttgaaagatgctgctgaaaaagccaaaaaagacctttcaggtgtaacaacaactcaaatcagcttaccatttatcacagcaggagctgccggacctcttcacttggaaatggctttaactcgtgctaaatttgatgaattgacacatgaccttgttgaagcgacacgtcaaccagttcgtcaagccctttctgatgctggtttgtcaacttctgatattgatgaagtcctcttagttggtggttcaactcgtattcctgcagttgttgaacttgttcgtcatgaaacaaacaaagaaccaaataaatcagttaaccctgatgaagttgttgctatgggtgccgcgattcaaggtggtgtcatcactggtgacgttaaagacgttgtccttcttgatgttactccattgtcacttggtattgaaacaatgggtggagtcttcacaaaattgattgaccgtaacacaactatcccaacttctaaatcacaagtcttctcaactgccgctgataatcaaccagctgttgatattcacgtcctccaaggtgaacgtccaatggctgctgataacaaaactttgggtcgtttccaattgacagatatccctgcagcaccacgtggtatcccacaaatcgaagtaacatttgatattgataaaaatggtattgtttctgttaaagctaaagacctcggcacacaaaaagaacaaacaattgttatcaaatcaaactcaggtctttctgatgaagagattgataaaatgatcaaagatgctgaagcaaatgccgatgctgatgcaaaacgtaaagaagaagttgatacacgtaacgaagctgacgctttagttttccaaactgaaaaaactttgaaagaccttgaaggaaaagttgaagaagctgaagttaaaaaagccgaagacgctaaagaagaactcaaaaaagcgcttgaaggtgaagatattgatgatatcaaagctaaatcagaagcactttctgaaatcgctcaaaatcttgctgtaaaactttatgaacaagcaaatgcagctcaaggagaagcgggtgaagcaacagatgctcaagaaggaccaaaagatgctaatacatttgatggcgactttgaagaaagcaaataatattttaaaaaagtactgatcgtttcgtcagtacttttttatgtttaaaaggattcactgacaagctgtcagtggattttttgtttattttgacatagggacgaattgagtaatatgatataattggacaagattaggattaaattttaggagaaataatagatggaaagattagaaaaaagagggcaaggattagagaatttcaaaaaatacaattttgtattttatatcattattctttttattactatattagcaaccttccctttttatagaggaaattttcatgctggaaatgattttgcatttaattatgcaagggtgatgtcaacaattagtgcattaaaagatggacaagtaattccgcaatttgatccaaatgctttaagtggttttggatatgcctggaatgaattttatggtccacttccaacttattttatttctgtcattaaatttattgttaaatcatggtcactatcctttgcccttttttatagtttatgcctttttatatcaggtgttttaatttttaatttttcgagttttctattaaaagaccatactaatagtaaattatttggcttattggcagttgccctttttacattttcgaattcaacatatatcaatctttattattatgccaaccctagccaacctcttgctcttttagttgtaatcctcttgttttggggaatgaccaaaatgtttaataaacggagctttgctgcctttttaatggtagcttttggggcagcaggcttacctctttcacatacagtgaccacgatttgtactcttccctttgtattattatatcttctctttttgctaataaaaaaagggaatttgaaagaaaaaataaaaatcattggtctgggatttctgtcagtgatttcggcaattgggctgtcagcatttttcttatttcctttattggagaatttgacatctggaatctataacgtttctaattcagatttttctcgtagttttggttggaataatattgcttattttcaagggaaatgggagccactttataaaattgaattttcatattataaatttccttctcttctatttgtttttattgtactatttatttttattttttctctgataaatttcaagaaaactaatgcaaagtatagcttgattttttcctgtttttcattagtcttggttttgatgcaacttccgatatttccttggaaactattttctgtttttacgattgttcaagatccagcaaggttttcaactctttttggactattttctgctctcagcctcgtattaatattgcccatcttattggacaaaatttcaggaaaaacttcttattatctgacaatcagtttattagtcattttttcaatactagggtttactgaatttagaaatcgaatccaaaaaggttctcaaccattatttgcttctgctcaaagtttattaaataaaactccctttaattatatggaaaacccggattctattgccattggtgaatatttaccccaagttattggaagccataatcaaccttatgaaaatacgattcaacaattttataaagataagaatgtctatggaatgcgcaatcaagcgatgacatatttgagtcaaagaggaaaactcccagaggggcttgcaaaaagcattcagatatcagactatagtaaaaaaggctcacatgtcacttttacagcgactactggttcaaaaagtgctggtgttgaaataccagaaatttattacaaaggatttatcgcctttacgaaagaggaaaataaaaaaataaagctcacaagccaaatttctaaaaatggatttctagaaataaaagtccccgcaaagttttcggggaaaatttattcctgctttgcaatgagttcagcaacaaaatatggcggacttttatcacttttgacatttgttagcctgctgataattcttagcactaaaactttcagaaaaagtaaattatccaaagataaataataagaaaatggacaaaatggacaaggtgtccaagaaacgtttcagattcttgcaatcgttttactcttgtactatgatgaaattagtaagagattggaggagaattaaaaaagaaaggctaaaattttagccgaaatatgttgtttagaattcgaggaggttaattattatgcgttatacaaatggaaattatgaagctttcgttcacccaagaaaaccagaaaatgttgatggaaaatcagcttatatcattggggcaggtcttgctggccttgcaacagcagtatttttaattcgtgacggtcaaatgtctggtgaccgtattcatattttagaagaattacctttgtcaggtggctccttagacggttcatttattccacatgatggctttgttgtacgtggtggtcgtgaaatggaaaatcattttgaatgtctttgggatttattccgctcagttccatctctagaagtagacaatgcgtctgttttagacgaattttatcgtattgaccgtgatgaccctaattcatctaattgtcggattattcataatcgtggtgaacgagtggatgatgatgggaaatttatattaagtccgaaggcccgagaagaaattgtcaaattatttatgacaaaagaagaattacttgttggcaaaaccattgaagattgttttactgacgaatttttcgaatcaaatttctggctttactggtgctcaatgtttgcttttgaaaaatggcattcagccattgaaatgcgtcgttatatcatgagatttattcatcatattaaaggattgcctgatttttcagctctaaaattcacgaaatataatcaatatgaatcccttgttaaaccattactttcatatctgaaagaacatggcgtcgattttaaatatggtgctcaagtcgaaaatgttgaagttgatttttcaaatgataaaaaagtcgctaagtccattatttatgctgacaaaaaaacaatagaactgacagaaaatgacttggttttcgttacaaatggttcaattactgaaagttcaacacaaggttcgccaacacatgctgcaccaaaaacaaatgaattaggtggctcttggaaactttggcaaaatttggctaaacagtcagaagaattcggacatccagatgttttttgtaaggatattcctaaagaagcttgggttgtgtcagcaactgttacttggaaaaatttgaaaatccaaccttattttgaaaaattaacacatcgtcaattacgttcaggaaaagtagtgacaggtggtatcattactgtaaaagattcaaattggttactttcatttacaacacaccgccaacctcactttaaggaacaaaatgacgaagaatcagtcacttgggtctatggtcttctttcaaatacaccggggaattatatcaaaaaacctattgaagattgtacaggtgaagaaattactcaagaattactctatcatttagggatgccagaagacgagattgaagcatttgtgaaagaaaataccaatacaattccagtttatatgcctttcattacttcatatttcatgctacgtgaacccggtgaccgcccacttgttgtacctgaacaatcagtaaatttagcttttttaggtaattttgctgaaacagcccgcgataccgtttttactacagaatattcagtaagaacagccatggaagctgtatatcaattattgaatgttgatcgaggaattcccgaagtttatgcttcagcttatgatctgcgaaatttggctggttcagtctactatctatcagataaacaaaaattagaagatttggatttgtcattcatcaagaaacaagctttgaaagttggtctcaaaaaactcaaaggaacctatcttgaagagattttagaagaggctggattgatttaaaatttaaatggggtcaatagaaatagcgaagtctaatgcttcgctatttttgctacaattatttttatgattaaagaaaaattatataaggaacttgttgagattcgtcattaccttcatgctcaccctgaagtatcagaagaagaattcgaaactacaaagttcattcgtgaaaaattattagactgggaaatcgagatactagaaagtaacctaaaaacaggacttgttgccaagataggttctggaaaaccagtgattgcattgagagcagatattgatgccctaccaattttagaagaaacaggtcttgagtttgaatctaaaaataaaggagcaatgcatgcttgtggtcatgatttgcatatgacaagtctccttggtgcagctcaattattaaaaaaacaggagcaggagttaaaagggacaataaaacttatatttcaacctgctgaagaaatcggtgaaggggctaagcaagttttacaaaccggtctactatcagatgtacaagcttttttgggttatcataatatgccaactttaccaagcggactcattggattgcgcgaaggaggggtcatggctgcagtcgaacgattcgaaattattgttaaaggacaaggaaatcatgcagcgtatcctcaagaaggaagagaccctattttagccagctctgcaattgtccaaaatctccaacaaattgtatccagaaatatttcacctcaaaaaacggcggttgtctcaataacccatattgaatcgggcaatacttggaatgtcttacccaataattccagattagaagggacaataagaatgtttgagaatgaagtgcggactttgactaaaagaaggtttagcgaaattattgaagcaaccgcaaaagcttatgatgttcaagtagaaattaagtggcttatggaagcagaaccgacctttaacgattttgaactgacagaacaaatcaggaagataacagaacaatggtacgataaagtgatttatcctgaaccttcgagtgctggggaagattttgctaattatcaaaaacaagcaccaagtttctttgcatttattggttcaaatggaccagaggcttctggacttcactttcctgatatgcttgtccaagatgaagcattaaaagttgctgttgaatactacatacaatctgctcagcacttactcgaatatcttaaataaagccttatttttgaacggttttttatttttgaacttttttgaaagaaaatgatagttaatgattgattttgataggtaaaggtgttataataatttttgtaaacgaattcaggagatggaaatgttagcaaatgaaagaaaaaaaaggattgtttactatctaaaaataaataggagagcaacaatagaagaacttctcaccctgatggattgctctatttcaacacttaggcgtgatttgaatgaattggagaaagaaaagagtttaaggcgggtccatggtggagccgaacttacacaggatttatcagaagagttaagtatttctgaaaaaacgtccaaaaacattcaagaaaaagaagaaatcgcgcaaattgccttatcaaaaattaaagacggagatattgtctttctagatgctggaacaacaactggtcttttagcagaacttatcaatcaatcacatctttatctaacgattgtaactaactctgtcacgcatttagcaaaattgacagatggccgattgattgtttatttactcggtggtcgagtgaaaaaagtaacagatgcaatcattggaagtcaggccttggaacaactatctgcctatcaatttaatgtggcctttgtgggtgcgaacggttttgataccaagcatggcgcaatgacgccagacaatgaagaagcagcaattaaaggattagcggttaaacaaagtcagaatgcttatgttttggctgactcttccaaattaggccaaatgagtttcgtaaaatttgctaattctgaagaggttgaattaattaccgagaataattagagtatgttttttatgaataaaagtgaaaagttttcactaaatgttaatatttcaaacttacgtcttaaataaaaggagaactatgatttatacagtaacactcaatccagcgcttgactacttcatgaactatgagtctttatcactgggtgaggttaacagaacaggaaaaacacagatttcagcaggtggtaaaggaattatggaaagccgcatgctcagtcttctaggagccgagagtaaggctttgggatttctaggtggtttttctggtcaatatattaaagattttttaaatgagaatcaaattgattcagattttacagaaatagcagatttgactagaattaatgtgaaacttaagagtcaagaaaatgaaaccagcctagatgctactggaccgaaacttgaagaaaaagaaatcaagcattttcttgaaaaatttaatcatttaaccccaaatgatattgtcgtttttgcgggaacaattcctaaaactttaggtgaagatttctatgagcgtttgattgaaaaagtacaagagtgcggggcaacattcgttatggatgtcgatggtcaaaaactacttgattcgctcccagcacatcccttgcttatcaaaccaaatcgtgaagaattagaagcgatttttgggacaagctttgaaaataatgagcaaattataccttatggtaaaaaactattagacatgggtgctcaaaatgttattgtttcaatggctggagatggagcactcctctttacgaatgagaaagtttattttgctcaagggattaagggagaattaagaaattctattggagccggtgattcgactgttgcaggatttttggccgaatatagtcaatctaaagatccactcttagcattcagacaagcgattgcttgtggaacttcaaaggcattctcagatgatatgccaagccgagcatttttggaagatatttataaaaaagttaatatttcagaggtgaaatgatggaaattaaagatttattaaaaacagaggttatgattcttgacctccaagcaactagcaaagaagctgttattgatgaaatggtcaataaattagtttctgaaggttatgtcagtgattttgcaacttttaaagcaggaattatggcacgtgaagcgcaaacttcaactggacttggtgacgggattgccatgcctcacagtaaaaataccgctgttaatgaaccggttgttctatttgcaaaatcaaaaactggtgttgattacgcggcattagatggtcaacctgtcaatcttttctttatgattgcagccccagatggtgctaatgatactcacttagaagctttggcacaactttccacttatcttcttaaagacggtttccaagaccgtttgagaaaagttgaatacccacgcgaagtcattcaactcttttctgaaaaacaagaagaagttgcaactcttgaaaatgctgaacattacattgtagctgtaacagcatgtacaacaggaattgcccatacttacatggctgaagaagcacttaaaaaacaagccttggaaatgggtgttggtataaaggttgaaaccaatggtgcgcgtggaattgataataaattaacttcagctgatattcaaaaagctgatgctgttatcgtagctgcggacaaaaaagtcgaaatgaatcgttttgctggtaaagaaatggttcaagttccagttgcacacgccattcgagatacggaagaattaattaatcgtgcactttcaggaaatgcaccaatctatgaagcagatggaacggatgaagtaaaagaagaatcatctggtggcttaggtaaagctttctataaacacttaatgggtggtgtttctgcaatgcttccattcgttgtcggaggtgggattcttatcgctcttgctttcttgattgaccaagcgatgggagttcctcaaagtcaattggccaaccttggagtctatcatcctttagctgcttactttaaaaatgttgggggcgcggcttttgcctttatgttacctgttttagccggtttcattgcaaactcaatcgctgataagcctggtttagttgctggttttgtcgctggttcgatggcatcatctggtttggcctttggtcatttagaccctgctaaaatgattccgtcaggtttcttaggcgccttggttggtggtttccttgccggtggagtaattattcttcttcgtaaagtcttcgcaaaacttccacgttcacttgatgggattaaagctatcttgatttatccattagttggaacatttatcacaggtttcctaatgctctttgtcaatatcccaatggctgcaattaataccggactttctaactttttagcaagcttatcaggagcatctgcccttgttcttggtctagttgttggtggaatgatggctattgaccttggtggtccaatcaacaaagctgcttatatctttgcaactggtactttagcagcaacagtttcaactggtggttcagtaacaatggcagcagttatggctggtgggatggttccaccactcgcaactacagtagctgttatcttgttcaaaaataaatttaccaaagaagaacgtaatgctggtttgacaaacattgtgatggggctttcattcatcactgaagggtcaattccatttggcgcagccgacccagcacgcgcaattccatcatttatgattggagcagcagtagccggtggtttgactggtatggccaatattaaattgatggcaccacatggtggagtcttcgtacttgctttgactaataacccgttactttatctcttgttcatcttgattggagcaattgtttcaggcctattatttggagctttgaaaaaagctaaataaaatttaataaaatgaaagaagcggataatcttcgttcgttttaatctacttatgtatccgttttaacttaggctagcaaacgcttgaagcctttcttgttttttttattatttttttattttctaattaaattagtgctgaaaccttcataaatttcatagaatatcccttttcttttagattgtcttcctagattagtaatttttttgtagcagtcttttcgatttttaatgcttaaattttattttttatatagtagaaagttaaaattatgataatttactccttataaagctgatagtttcgttgatttagcatatatccacaaaatgggttgagcttgtcaaaaagctgtgattaatcttttttaatttttttgttttccacaggtattttgctcttaattttgctatttttatctctggggataagtctgaaaaacattactatcatttgctatttcctgtggataaaaaattttttacacattatccacaaatttgttaataactttttcagatggtggaaaactttcttttgttaatttcaacagactgtggaaaaatataaagtgaaatgatataatgagttatcaacaaactaaaaagtaaaggagtaatatggcatcccttaatgaaaatcaaaaattttgggcccgtgtaaccgagctggctaggcagagtatcggtaaacaagcttatgatttttttattgagcctgctcaattaatgtctgtcgagcaagatactgccaatatcttgcttgatagtggaatgaaaaaagattattggaaaaaacagtccgatttgatcacaacggcaggatttgaagtctttggtcggatgattgattatgaactttatgcgaatgatgaacttactgatattgaactacgtcgtttaaataatcaatcaccggttgatgaacctctttccgttgcgaagcctacttcccctttggttagtggacttaatgagaaatataattttgaaaactttgtccaaggtcctggtaaccgttggactttagccgctgcaattgctgttgctgataaacctggtgatacttacaatcccttgtttatctatggtggcgctggtttaggtaaaacccatttgatgcatgcaattgggaatcagattttaactgataatcctacagctcgaatcaaatatgtttcgtcagagaatttcgttaacgattatgttaatgcaacacgtaaaaatcagatggaaagttttgagaatacttatcgtaacttagacttacttctattagatgatgttcaatttttcagtgataaagaaggtacgaaaaacgaatttttcaatacttttaatgcactctacgataaaggctctcagattgttttgacttctgaccgcattcctcaagaattaaataacttggaagatcgtttggtttcacgcttctcttggggcttgactactgatattacagcccctgactatgaaacacggatggctattctactgataaaatcagaatcaagccatttagaatttcctagtgagactttatcttatatcgctggtcaaatcgactcaaacgttcgtgaacttgaaggagctcttaatcgagtagaatttgtggctcgtgctaatgggatttcaatagttgatattgagacagcgagtcaggctcttcgttccttaaaaaatgcaactcaacaatctctatcaaatctgactataaaaaaaatacaagatgaagttgcaaattattatcatatttcattttccgaccttgtcggacctaaacgccctaaagagattgcttttcctagacaaattgcaatgtatcttgtcagagaacttttaggtacgagccttccagcaattggaactgcttttggaggtcgtgaccatacaacagtaatgtatgcttataagcaaatttcagataaaatgaaaaatgatatggatgtccaaaaagatattgatagcattaagcgtaaattttagaactgtggaaaacttacggacttataaaagccttattctttaattatccacaggggaaaaccttacgcctctaagaggatttgtcttatacagattatccacaggacctactactattactattatatttataaaaagaaattataaaggaatatcatgattaaattttcaattaataaaactgcctttcaaaatgctttgaaaattaccaaacaagcaattggttctaaagttacaattcctgctttaacaaaattaaaaattgaagttgaagaaaaaggaattaccttgattggttcaaatggtcaaatttcaatcaaaaactttttgccagctgataataaagatgcaagtatgcttatttcaggaactggttctgtcttattagaagctgctttctttgaaaatgtagtaagtcaacttcctgaagttactttggaatttattgaaaaagaacaaaaacaagttttgttgacttctggtaaatcagaaattactttaaaaggtttagattctgaaatttatccgcatttacaagaaatctctgaaggttcttctttaaaaatgaaagtgaaagttttgaaagaaattttcacagagactgtttttgctgtaagtactcaagaaaatcgtccaattttcacaggggttcacttagaaactttgtcaacgggtgaattaaaagctgtagcaactgactcacatcgaatgagccaacgtttattgcctttagaagatacagacttaaaatttgatgtaattttaccaagtaaatcaattaatagttttaaaaatgttttcacaaatgatgaagaagagattgaaattttcatcagtggaagccaaatgcttttccaaaatgaaacaattagttattatagtcgtttgattgagggttcttatcctgatactaatcgtttgattccaaatgaagccgattatactttagatttggtttttgatgctgcgcaattgcgtcatacaatggatcgtgcacgtttattgacagtaatgacaaccaacggaacagtaaaattgactgtttcaggtgattctgtcgtaaccacagcaaactctcctgaagtaggttctgttcatgaagaactgacagccttatcaaaagaaggtaatgatttatctatcagtttcaatcctgagtatttgattgatgctttgaaagtgattaaagcaccagaagtacgaattcgtttcatttctaacgttcgtccgttcactttgcaaccacggaatgaagaatctggatttgttcaattgattacaccagtacgtacaaattaattttactgacagctcttttgtcagcttagatttactgacgaaaatatctgtcagtaaatttagattttgttataatggacttaacgaaagttaggtctattttttatggaaattttatatactgaaattacacaagatttgacggagggattattagaaattgctcttgaagaacttgaaaaaaatcggaaagtttattacattgtgccttcttcaatgtcatttgagaaggagaaagaaatattagaacgattagcaaaaggtagtgatacagcagtttttgatttacttgttacgcggtttaaacaactgccttattactttgacaagcgtgaaaaagcaacaatgaaaacagagttaggcacggtggggctttcgatgctttttcggcgtattttgagaagttttaaaaaagatgaaattccgctttatttttcattgcaggattcagccggatttttagagatgctgattcaattgagagcagaattgctgacagccaatctgtcagtagaaaatttgccagataatcctaagaatcaagaattgaaaaaaattctaacaacatttgaagctgaattatctgtggaatatgcgaattactcagaatttggagattttacaaatcgacttgctgatggagaatttgatcagcagcttaaagatgtaacaattatcattgatggttatactcgattttctgcggaagaagagttatttattgaaagtattcaagagaaagttgcccgctttgttgttggaacttatagtgatgaaaattcactgacagctggttcggagacaatttacgtgggaacgagtcagatgattactcgctttcgaaataaatatccagtagaattaagaaaaatagcttcttcatctgtcaacgaagtttacagtaagttgacaagaatgcttgatttagattctcgttttgttattactgatgaaaaaattgaattaaaagcagaagatgaaaagtattttagaatctgggaagctgaaaatcaaaaagttgaaatcgaacgagtggctaaggaaattagacaaaaaatcagccaaggggcttttttcaaagattttactgttttagttggtgatccagcagcttatgagattactttgaaagaaatttttgatctctatgagattccatttttctatgctcaagaagaatccatgagccagcatcctttagtgatcttttttgaaagtctatttgccatcaaaaaaaataattatcgaacggatgatgttgtcaatcttttaaaaagtaaagtttacacagatgtcaaccttgatgaagaagttattgattactttgaatactatgttcaaaagtataaaatttcaggtcgcaagaaatttacagaagaatttaatgaaagtgaattttctcaaattgaattagttaatgaaatgcgggaaaaactacttggaagtgaatctcctttacaagtatttttagggaataatcgacaaaaaacaggaaaaaaatgggtttctgatttacaagctttacttgaaaatggaaatgtaatggcaaatatgaatgcctatttttccgctgccgaattacaaaatgaacatcaaatggctgataaacatgaacaagtctggcaaatgttaatttcaacgctgaatgagttcttcgctgttttttctgatgagaaattgaaaagtgtagagtttttagatatcttattggctggtttgaaaaatgcaaaatatcgtcaaattccagcaaatgttgatgttgttaatgttaaagactatgaacttgttgaacccaaaacaaataagtatatttatgctattggtttaagtcaaacgaatttccctcgaataaagaaaaattcgacgctcttatcagatgaagagcgattagaaattaatcagacaactgatgaaaatcaatttattgagcaacttaatgttgccaactatcaaaaaaatcagtttacagtcttgtctttgattaactcggcaaaagagagtttagttttgtcaatgccacagattatgaccaatgaacagggagaattttctccagtttttcaattatttttaaaagatgctgatgaaaaaatccttcaaaaaattcaaggagtgaatctttttgaaagtctagaacacattggaaatagccgttcggtcattgccatgattggacaaattgaacgtgaattagttgaatctgaggaaaccaatgaggataagcgagttttttggtctagtatttttcgaatattagtgaaatcaaatgctgattttcaaaaaatattactcgatttagctaaagatattgacactgtaaatttggcaccagacacacttgaacaaatttatggtgataaaatttatgcttctgtcagttcttttgaacgtttttacaattgtgaatatcagtactttttagagaatacactaagtctggaaacttttgaaaatattgatattaattctaaaattgttgggaattttttccatgaagtttttgaaaaagtcatgaaagagactgacttatcagcagaaaattttgatgaaaagttgacacttgttttacaagaagttgacaaaaactattcacgctattttacacaagatgcaacggcaagatttacttggagtaatttagaagagattgtcaggcaaacggcgactgttttgaaagcaactgtatctactgatgaactaaaaactttactgacagaaagtagttttggtttatctaaaagtgagttaggaaatttttcagttgatgatatttatttacgaggaagaattgaccgtcttgaccaactttctacagattacttaggagtgattgactataaatcaagtgctcattcatttaaattgcaagaggcttatgatggactaagtttacaatttatgacctatttagatgtgataaaacaagcttttcctaatcaaaaaatctggggtgcactttatttacaatttaaaaatcaaccgattaacctatcagaaattaatcagttgtcggaaattgctaacattttgaaagaatcaatgcgttatgatggattagtattagaagatgcagctgagcaaataaaaggtattgaaaatattgctttaaaaaatactaatagttataatgaagaagaatttgagcaacttttaaaattaaatgaggaacattaccgggcagctggtcagcgattgaaaaatggaaaaattgcaatcaatccaataatgaaacgctccgaagggattgatcagtcaggtaatgtccgcggctgtcgatattgtcctcttaaatcgatttgtcgatttgaagcaaatattcatatgaatgagcacagccgtgaaatcggacaaaaatcccaagcagaaatcctagcagaattaaaaggagaagggcgagatgagtgaagtaaaattaactccggaacaaaatgaagccattcatagttcaggtaaaaatatattagtctcagctagtgctgggtccggaaaaacttttgttatggctcaaagaattgttgaaaaagtcaaacaaggtattgaaattgatcgactttttatttcaactttcactaaaaaagcggctagtgagttgcgaatgcgacttgaaagagatttgaaaaaagcgcgtcaagaaagttctgatgatgaggaagctcacagattgacacttgctttacataatctttcaaacgcagatattggaacaatggatagttttactcaaaaattgacaaaagctaattttaaccgtgtaaatattgatccaaattttcgaatattggctgaccaaacagaaagcgacttgattagacaagaagtttttgaacaattggttgagtcttatttatcagctgatgaaagcttaaatatttcaaaagataaatttgaaaaattgataaaaaatttctctaaggacaggaatattcttgggtttcagaaggtagtttacaccatttatcgttttgcgtcagcaactgaaaatccaataagttggttagaaaatcaatttttaaaaggttttgagacttataaatcactgacagacttatcggaagattttacagtgaatgtaaaagaaaatttactgacattttttgagctgctagaaaattcactgaccaatggtgtgattgctaaaaaaggagctggtcgtgataaggcaaatctaattttagataataaaaatgaacttttagaagcaataagtaaaaaagattttgtaactttcacagccttatttttatcaatagatactgatattcgcgtcggttcttcaaaagatgaaacactttctgccttaaaaaaagatttttcagctcaaaaacaagatttagtaggttcaaaatcaaaacccggagaacttcggaagtttgttgataaaatcaaacatggccaattaatagaaaaatatcaaaaacaagcttttgaaattgccagtgatttacaaaaattcattattgagttttataaaacttatctagagcgtaagaaaaatgaaaatgcctttgagtattctgatattgctcattttgccattgaaattttagaagaaaatccagatattcgtgaaaatttacgcgagcattatgatgaaatcatgattgatgagtatcaggatactagccatacacaagaacgaatgctcgaacttctttctaatggccataatctttttatggtaggggatattaaacagtcgatttatggtttccgcctagctgacccaggtctatttttagaaaaatataaaagttatgatcaagcagaaaatcctaatcaactgattcgcttgaaagaaaattttcgctcacggggtgaggttttaaatttcacaaatgacatctttaaacacctaatggatgaaaaattaggtgaaatgacttatggaaaagaagaggccttagttcaggggaatatttctgattatccagtggaagcggagaaagatttttatccagagcttcttttgtataaagagaatacaagcgaggaagaaatagaagactcggaagtaaaaatttcggatggagaaatcaaaggggcagcacaagaaataaagaaactgattgaatctggagttgaaccaaaagatatcgcaattttagtccgttctaaatctaataataataagattgaggatattctactcagttatgatatcccagttattcttgacgaaggacgagttgattttttgaaatcaatggaagttttaatcatgctcgatgttttgagagcaattgataatccactctatgatctatctttggttgcgatgctgaggtctcctttgtttggttttaatgaagatgaattgactcgcatcagtgttcaaggaagccgtgaccttcgtttttgggataaaattctcttgtcattaaaaaaagaaggaaaaaatcctgaacttataaatctgtcattagaacaaaaattgaaagcattcaatcaaaagtttacagagtggcgtaaacttgtcaaccaaattccaattcatcgcttactttggaaaatttatacagaaacctattattttgattatgtaggagctttgaaaaatggggaaatgcggcaggcaaatttacaagctctctctgttcgagcagaatcttatgaaagttccggttacaaaggcttatttaaatttgtaagacttatcaataaatttatggaacaaaataatgacctagcttctgtcaatattaaacttcctcaaaatgctgttcgtgtcatgacttttcataaatctaagggacttgaatttgattatgttttcttgatgaacttacagtctcgtttcaatgatcgtgacctgaaagaagatgtcattttaagccgcgagcatggtttgggtatgaaatatattgcagatttgaaagcagaacctgatgtcattacagattttccttatgctctggtaaaaatggaaacatttccctacatggtaaataaagacttaaaacaaagagccgcactttcagaggaaatgcgggtgctttatgtagcttttactcgtgcaaagaaaaaactctatcttgtcggaaaaattaaggatacagataaaaaagcaggacttgaactttatgatactgctactttggatggaaaaattctatctgataagttccgcaactcaagtcgtggttttcaacactggatattggctcttcaaaatgctacaaaacttccaatgaaactcaatgtttacacaaaagacgaattagaaacagagaaacttgaatttacaagtcaacctgatttcaaaaaattggtcgaagaatcagaaaaatttgataatatcatgtcattttctgatgaaattaaagaagcacagaaaatcatgaattatcagtatcctcatcaagctgctacagaactttcaagcattcaaacgcccagtcaggtaaaaaaacgcagctacgagaagcagttacaggtaggtgaagttcaaccagtcagtgagtttgttcgagtaaaaaacttggatttttctgattttggatctaagaaaattactgctgcagaaattggttcagcaacacacagctttatgcaatatgctgatttttctcaagccgatttatttagttttcaagcaactcttgatgagatgggatttgatgaaaaaataaaaaatcaaattgatatcactaaaattctaactttatttgatactgaatttggaaaatttttatcagagaatgtggataaaacagtcaaagaagctcctttttcaatgttgagaacagatgaatttgcaaaagaacaatatattgttcgaggaatttgtgatggttttgtgaaacttgctgacaagattatcttatttgattataaaacggacagatttacaaatgtgtcagcaatttccgaaataaaagagcgttataaagaccaaatgaatctttacagtgaggcccttcaaaaagcatatcatgtcaaccaaattgacaagtacctgattttattaggaggacccagaaaagtttttgttgaaaaactagatgactagaaagataaaaagtagctgttagggaggaaaaacaatgctagattacaaaataggctcaattgtcgaaatgaaaaaacctcatgcctgtacagtcaaagcaactggaaaaaaagccaatgcttgggaaattacaaggcttggggctgatatcaaaattaaatgtacaaactgcaaccatgaagtgatgatgagtcgttttaacttcaataaaaaaataaaaaaagtgctcaagtgagcactttttaattataaactgatttgagattaaacttgagatatttaaggagccaaaaatatagtaattttgtgaatcgccaaataaatggactaacaagaaccatcagtgaacaagcgataatcgcaattacccagtaaggccaattaaaacctgttgcccctgttacgtttccaaaggtaatatgagggttatgagtaaggacagcaaatatcatgataaatggggcaaggaataaggctaggacaatcgcataaaaagctaaaaggattagagcagtagcaataatcaaccaaaccccaaggacaaagttgaaaaatagcaaaccaaagccagcaaaaagattgatatgtttttttcgtttttgaggttcgattccttttgcaaaagccaataaatctgaatcatataattctgctaaggcaattaacgtttcaagatttggttcagttttgttagattcccaacgggaaatcgcttgacgactaaagtatagttcttttgcgacttcctcttgagtgaggtttttagaaagacgagctttctgtagattttctccgagcattttatctcctttaaacacgactattttaatttagtgatttgtttctgatttaattatcaactaaagcgaagctaaaagcaagaacagaagtggaattttagggtaacattttgtggcaatcctttaaactaaagggattctacaataacatttcttgtttacaactactatgtaaacttgtaaacgtagtgattatctggtattttctgagccattattgtctttttgagcgatttacagtataattagtactaattaatcttaattttggagaatataaaacatggctttaacagcaggtatcgttggtttaccaaacgttgggaaatcaacactttttaatgcaattacaaaagcaggcgcagaagctgcaaactatcctttcgcaacaattgacccaaatgtcgggatggtagaggtaccagatgagcgtttgaataagttaacagagttgattaaacctaaaaaaactgttccaacaacttttgaatttactgatattgcagggattgtaaaaggagcttctcgaggagaaggtttgggaaataaattcctggctaatattcgtgaagtagatgcaattattcacgttgttcgagcttttgatgatgaaaatgttatgcgtgaaaataatcgtgaagatgcctttattgacccaatggctgatattgaaacgattaacctagaattaattttggccgatttagaatcagtcaataaacgttatgcgcgtgtagaaaaaattgctcgcacagcaaaagataaagatgcggtcgcagaatttaatgttttgaaaaaactcaaacctgttcttgaagacggaaaatcagcgcgaacaattgactttgatgaagatgaaacaaaggctcttaaaagtttattcttgttgacaagtaaaccagttctttatgtggccaatgtttcagaagatgaagttggcgaacctgataacattgagtatgtgaaacaaattcgtgattttgcggcgactgaaaatgctgaagttgctgtaatctctgctcgtgttgaggaagaaatctcagagttggaagatgatgaaaaagcagaatttttggaagcaattggtttaaaagaatctggtgttgatatgttgactcgtgcagcttatcaccttcttggtctggcgacttactttacagctggagaaaaagaagtgcgtgcatggaccttcaaacgtggaatgaaagctccacaaatggcaggaattatccatacagactttgaaaaaggctttatccgtgcagtgaccatgtcttatgatgatttgcttaaatacggctcagagaaagcggtacgtgaagcaggtcgtttgcgtgaagaaggaaaagaatatgttggtcaagatggcgacattatggaattccgtttcaacgtgtaaaccttgtaaatgaaatgatgaaatgcaccgaattggtgcatttttgcaacctaaaaatgcttgagtcaaacaaaaaaatgcgatagtcttaaagcatgaaaggaaggcaacatggaaatatccgaaataatcaaagaaaatcgtaaactcaaaaatctcagtcaggaagagttagcaaaggaactacacatctctcgtcaatctatctcaaaatgggagacaggaaaatcacttcccaccacagaccaacttatcttactcagtgaaattttcgattgttctttggacacgttgctcaaaggtgacaaaaaaatggaagaaaaagtaaaacatgaaattgatgacaaacggaccttaaagttaatttataaggttggttggggttttattgttcccttactttttattttgaaatttgttttacatttgttttgataataattaacgactcgatagaaatattgggtctttttgttcgctataaaataccgtacctcgcttaatattacaataattgaaaaaacaaaactttttattgacatgaaggttacgtaagagtataactataagaaaacggaaacattttctgttaagaaggaggtgtaataatgtaaatagaagtttacacgcgctcaaattagcgcaaaaaaaaatgatgaataaaattattatcccatcaatttgattaagtgaatataacaaataaagatgaagttaatttgaaaaattttctattcaaatagtcaggctttatatcggctatataacccaaatgcaaaagttggttcacacttttatacaacgagtctggcagaaaagaatagtcttgtaaaatcaggatggaaatatgaaggagtggcatggtatggtcttagctaaaaataaaaaaataatgatttcaacaatttcgttagtaattttgagccttgtttgtttcaaagaaaatctacctgctcaggcatcaacaaagtcattagatacaggtgaaagttttactgaagtttacaataaggacaatggtttttatttaaatagccctttttatgatatttcaaaggtttcaaaaagtttttatgttggggaaagtgggactattaatcaagttaaagttttgccgatttataatatgacgccaaaaagttctgtgaatttttatcaaaatacagcaactaataatcttattggggcaaccttaccctcgctattcacgggagcaatagctttaacacaagctggtcaatatactgctcaaaaagctggaacagctacagttgcattgacttatatgctgtctagtgatttcaaaaaagaattacttagtaaatatccggatgcttggacaaatattgcacctgctagctatggttctcctgactttatgtatgcaaaatatagcaatcaaactttctatgtaacaatcaaggaacataccgtcccactctatcgcatgtataatcctaactcaggggaacatttttatactgaaaattcctttgagcgtgattcattggtgaaggcaggctggaactatgaaggagtcgcagaagaatctccaataaagacagtctataatcaagcagtttatcgtgtttataatccgaatgctggggaccatttttatactgaaaataaagcagaagtagctcatctggtttctctaggttggcgtgccgagggtatagctttttattcaagtacatcgaatgaaactcctatttatcgtctctataatcccaatgcgacagtaggaacacatttttatactcaaagttcagttgaacgtgactctcttgtgagagcaggttggcactatgaaggaacggcttggtatggtggataattactgtagagtgattgctatagatagagcaaacgtaaaagactcaatagaaatattgagtcttttttttgctcctctaggtaaataaacatgttataataaacttaattgctgatttttatgaatcggccttttggcttttattagataaaataaggaaaagaaaataagagaaaatgacaaaaatgattgttggcttgggaaatccaggcgataaatatgaaaaaacgaagcataacatgggctttagggcacttgatttactggcaaatgagctaaatgtagattttaaagaggaaaaaccttttatgtcgcttgtcgcgtcaacatttgtgaatggtgaaaaattgtttctcgtgaaacctttgactttcatgaatgaatctggtcgtgcggtggcaccacttttgaaatattataatatagatgaggcagatttaacggtcatgcatgatgatttggattcaccagttgggcgcgtgcgtctaagacaaaaaggttcatcaggtggtcaaaatgggataaaatcagtcattacacatgtgggaagtcaaacttttaaccgtgtaaaaattgggattggccgtccaaaacatgggatgacagttgtgaatcatgtactctctggttttgacaatgaagataaggaaatcgctcaagatggaattttcaaagctgttgatgcaatgaaattctatcttgaaaatggtgattttcaaaagacaatgaataaatttaactaaatgaatattattgaattttttgaccaaaattggcaactacaaaaatggcaacaaggttttttaaagcgtgagcgaactttactgacaggattgtcaggaacagcaaagagcttagtgatggcaaatgcttatgaaaatgttgctgagaaatacattattgttactgacagccagtttcatgcgaatgaactttatgatgaactgtcaactttgcttggtgaagaaaaagtttttcaatttttttctgatgataacatctacgcagagttcgcacttgcatctaaagatcgagttgcttatcgacttgaggcacttaatttcctacttgacgaaaagtcaacaggatttttggttgtgccatttttggcattacggagctatttaccaagtcccgaaaactttttagaaaattatcttttactgacctctggagatgaatatgacttatcaaatttagttaatttattatcaaatgctggttatgaaaagacacaacgcgtgatgacgccgggtgaattttcaatgcgaggagatatcgttgatatttatcctttggacgcggaaaatccagtccgtttagagttttttggtgatgaagttgatacgattcgttcatttgatgtagagagtcaacgttcactgacaagtcttgagcgtttggaaatctatccggctagtgattttattttgactgacaatgagtttgataagggtgcaaaatcactgacagaaatgacaaatttgctgacagacccgtcagcaaaatcatatatggaagaagtgatttcggcagctcaaaatcactattatcacaaagacttacgaaaatttgccgagtatttttatgataaaaaaacttcacttttaaattattttccaaaaaatgttcaaatatttattgatgattttcaaaaagtaaatgaaattaataataagttagaaatggaattagcagatttcattttatctgaaaaagcaatggaaagaggttttgaagggcagacttatttgctagatacaatggcaaaagttagaaattataagcctgctaccttcttttcaaattttcaaaaaggacttggaaatctcagatttgaacaactttataatttcaaacaacattcaatgcaacaatttttcggtcaattagaacttttttacactgaagttgaacgatttattaagcaagagtttacagttgttttagctgtatcatcagaaaagctccgtaaatcactccatgaattagatttaagtttacaagaggttgacagagaatctattcaagtgggtaaagtcaatctgattgatttgcagctgtccaatggttttaattttcttgatgaaaaattagtcgtcatgactgagcatgaaatatttggcaaaatgcgtaagaaaaaggcacgcaagctaaatattacaaatgctgaaagactcaaagattacaatgaactcgcggttggtgattttgttgtccataaaaatcatgggattgggaaatatttaggtttacaaacgcttgaagtcggaggaatgcatcgtgactatctgaccattcaatatcaaaatggggatacaatttctgttccagttgaccacttagatttactcagtaagtatacagctggtgaaggaaaaagccctaaaatcaacaaattgaatgatgggcgctggcgtaaaaccatgtcttctgttagtaaacaagtggaagatatttcggatgatttgattaagctttatgctgaacgtcaggcgaaaaaaggttttgccttctcaccagacgatgcaagtcaagaagaatttgattctggtttttcatatgttgaaacggaagaccaaatccgttcaatcaatgaaattaagcatgatatggaacttgaacgcccaatggatcgtttgttagtcggtgacgttggttttggtaagacagaagttgcgatgcgagcagctttcaaagctataaatgatgggaaacaagttgcagtccttgtgccaacaacagtccttgctgaacagcatttcaataattttaccgaacgttttattaactttggagtgaatgttgaggttctcagtcgttttcaaaccaaaacacaacaaactgaaattctagctaaattgaaaaaaggacgagttgatttaattattggaacccaccgtttgctttctaaagatgttgaattttttgatttaggtttgatgattattgatgaagaacaacgttttggagttaagcataaagagcgtctgaaagaattgaaaactcaagttgatgttttgacattgacagcaacacctattcctaggacactccatatgtcaatgcttggaattcgtgatttgtcagttattgaaacaccaccaaccaaccgttatcctgttcaaacctatgtcatggaaacaaactacggtgtggttcgtgatgccattttgagagaaatctctcgtggtggacaggtttattatgtttacaatagagttgacactattgagcaaaaggtttcacaattagaagaattaatccccgaagctagaattggctttatacatggtcaaatgaccgaggtacagctggaaaatactttacttgcctttattgctggcgattatgatgtacttgttgcaacaacaatcattgaaacaggtgttgatattccaaattctaatacacttttcatcgaaaatgcggatatgatgggcttgtcacaactttatcaactgcgcggtcgtgtgggacgttcaaatcgggtggcttatgcttactttatgtatcgacctgaaaagatattatcagaagtttcggaaaaacgtttagaagcaattataggctttactgaattaggttcaggtttcaagattgctatgcgtgatttgtctatccgtggggctggtaatttacttgggagtgaacaatcaggatttattgattctgtcggttttgatttgtattcacaactcttagaagaggctattcataccaaacttggcacaagtaagcaaaaacggacctcaaatgtggaaatttctttggaattggatgcctttattcctgcctattacatctctgatgaacgtcaaaaaattgaaatttataaacgaattcgtcagattgatagtcgtgagatttatgaagaactacaagaagaattggttgaccgttttggagaatatccagatgaagtcgcttatcttctcgaaattggtttattgaaacattttgctgacaatgctctagtcgaaaaaattgagaaatctcgatttgaaataactgtcactttagaaaaagtagctaatacaacctatgatccacaagattattttaaggctttggccaaaacaagcatgaaagcttctgtcggtgaaaaatatggcaaaatgactttccgcttgaaaatagaaaatagaaattccgttgtgcttttgagtgagataatgaattttgtagaagaattatcaacaataagagatagttatgataaagttcgctaattatttttcctttttataattatgatattgggataatcagtcattttttcccaaatctgaagcatttgtcattaattttagattatctggtgaggcttgctggccttattgagaacaattctttttccctttcacttataacaggagatattagagtaaacctgccgaaagtttaaaacttaagggctaaaaatagtaaataaaatgaactgataaatctgtcagtaaaataataaagttctgtcattactgatagagctttattattataaataaaggcattttcaaacaaaatgaaatatgttataatctatccatgagattagataagtttttaaaagtttcgcgcttgattaaacgtcgtccagttgcgaaagaagttgccgacaaaggtcggattaaaattaatggaaagttagcgaaatcttcgtccgatgtaaaattcaatgatacgattgaaatccgttttggaaataaaatcgttgaagttcgagtgactgaattaaaagaatttacacgtaaagaggatgctgataaaatgtatgaactcatcagtgaaacacggataacagaagaaatagaatgattatcatcacaaagtggattggagggtgtcatggcaaaacaagtgattcaactaaataataaatatagtcaaaatcagaaaaaaagaaatctaacagtagtaccaaaaagaaaacatttgggacttattttgattgtggcaatcttacttttcagtctaacaagtatgagtttgataaaatcatatgaaactttgcataagcaagtcgctttagaacaaaatgcaaagaaacaatatgaaagtctttctaaagaagtaacaataaaaaaagaagaaatcaataaactgcaagaccctaactatctgcaaaaatttgctcgtagtgatgggcaagaatattctcaaagtgacgaaaaagttttcactaccgacagtcctttaattggaaataacgggtcaaattaatgattggacaagttgaaaatattacaagatttggactttttgtaaaaatttctgctgatgaacttactgacgaaatcaaaaaaagtactgacaaaactgtcagtaaaaatagtgggcttttgcgttggtcacagtttccaaagaatcatccaaaagttcaaattggtgatttgattggtgttgaagttttcaaggtacatgaagatggaaaaatcgatttaaactaccaagaaaaaaatttcaaaaatgtctatgctgaatttttggaaagtagtcagcaaagaattacagagcttgaacaaaaaaatcgcgaattaaactaaataactttcttacttttagaaagttatttagtttcttctttgattattctattgactaaaaatagcacctattttatgaaaaattctaggaattaaaaagataaagattacaacagaaattattctatggaatgaataagatgttgggcaaggttttaatcatgcaaaaacaaagaataaaaattaatagcggggtagccttggtgatgcttttgatgatcattccgggcttttttgctttcccgcaatcaagatattttgctgacaaagcggtcagcaaacctaaaaatattgtcgtagcagataaagttacagaaaaagaaacttgggactcaattcctccaagagccgtggctcttcaagacctagaactctatgaagatgaacaattgacaaaatctgtaggaaagctttccgctaaaacgcagttagatatttcagaaattgctgggaaagcttttaaactcaaggatggaaaatatattttagctgacaagaaaaatattatctcagatgtcactatttctcgggaaaatacaaatagaactatctatactaataaaagtgtcaacgtattttacaatccagtaaccacttacgataaccaagtaatgacaaggctgaatgggacacatcaaattttggcggacaaaattgctaaaactaactggggaacttattatgaaatttcattggagagtggtcaaaaaggttgggtttcagaagatgatatttccttagaaaatcctaaaatacagcaagttcaaaccctactaaataaaaaatataatgataaaaaatattcaatttatgtaaaagaacttaatgacaagtttacagctggtgtaaatcaaaatcaagaaatgtattcagcaagtctttctaaaattccaattctttattggactcagaaaaggctcaatgaaggattggcttctcttgatgacaaacttttgtatacaccagccattaatactttttatggaagttacaaaccagaagggacaggaaacttgccaaagacagcagacaataaatattatagtctgcaagacatcataaatagaacggcaaaactttcagataatgtaggaagtaacatgcttgcttactatgaaatccaagaatttaatccaaattatcaaaaagaaatcaacaaaattgctggacaagaatggaatccaaaagaacgaaatgcttctgctcagatggttggtaaaatgctagaagcgctttataatgagggaggagcttcatttaatgctctatttgatactgattttgatgatgtaaaaatcaaagcagctattcctaaaaatgttccagtagcacataaaataggtggtgcggatacagataatcacgatgcagccattatctttacaagtgagccctaccttttggtcattgaaacaaatggtggaagtgatgatgaaataaagaatatttcacaagatgtttatggagttatgaaatgacaccagctcaacttaaatttctaaaaatagtaactaaagaaaaatactttgcggaaaattcgaaaattttactggctttatcaggcggtaaagactcaatgaccctctttaattggctctatgagcttagagcaaagctccatatagaattgggaatagctcacattaatcatggcttacgacccgaatcagactttgaagaacaatccttacgtaaaatggccagtgacctagagattccaatttttgttgacaggtttacaggagagtttacagagcaaaaagctcgggagtttcgctaccacttttttgaaaaaataatgatagctgaaaattatgatgttcttctgactgcacaccatcaaggcgatgtcgttgaaactgtattaatgcgtcaaattactgggcgtcctttgagaagtttacagggaattgctgactgccaaccctttgctaagagacaattaattcgtccattactcaaatttacaaaagaagagcttgatgcggcggtcttttatgaagattcgaccaatcaaggagtagattattttagaaatagaatacgtaatcagcttattcctgaattaacaaaagaaaatccgcaattttctcaggcaatcagtgatttaagctcagaaataaaaatggccttaacagtgattaatcaaagaatttcggaacttgaaattattgatgaaaaaatctcttatcacaaatttatttctcaaacaaaagaattacagcacttcattttacaagcattttttgctcagtacccagaaataaaagtaagtaagaaaaaatttgaagaaatcttacatattatcagacgtccacaacaatattctgctcaattgaataaagattttcagttcgtgaagaccaaagatcacttttatattgaaaaaaggaagttaatcacagcttcactcgaaattttaagtgaaaatcctaacgatacaagttttatggaagtatacttacctttagaaggacaattagaaattcgtaagcgacaacctggtgatcaaatattgattaatggtcaccataaaaaattacgaaagttttttattgacaatcatgttcccttacaagctcgtgagaaccctctcatctttgtcgaaaaaaaactttacgcaatcgtcggagtcgcatgctctgatttgagtaaagcgctcaaaaatgataaaattagaagaatattatgggtcaaacccagtataggagaggaaatcaacgatgctcgaaaaaaatcttgataaggccattgaaaaagtactagtttcagaagaagaaattattgaaaaatccaaagaacttggagaaatattaacaaaagaatacgaagggaaaaatcctttagttttagggattcttcgtgggtcagttcctttcttagctgaactaatcaaacatattgattgtcatcttgaaactgattttatgaccgtatcaagctatcacggaggaacaaaatcttctggtgaagtaaaattgattttagacgttgatacagcggttaaaggtcgtgaaatcttgattgttgaagatattatcgacacaggtcgcactttaaaatatctaaaagaacttttggaacatcgtggagcaaatgtaaaaattgttacgcttcttgataaaccagaaggaagaattgttgaaattaaaccagattattcaggatttaccattccaaatgaatttgttgttggctttggtttggactacgaagaaaactaccgtaacctcccatatgttggggttttgaagcctgaggtttatagtaaataattcattgatttaagtaggttaaaaattttctcagactaaagtatgaaaaaatctctgaccaatacttactattagcattccaaaaggaaatatgctataactaggtatagctgttattgattagcttgtatcctttattaccagtgatactaagaagtaaattcttggcttttctaataataaataaacaaaagataaggaaaatatgaataacaacaaacaaccaagacaaggaaattttgtaaaaaatatcttaatgtgggttatattggctattgttgttgttgtcggtttcaatttcttcttcagtagtaatcaatcaggagtggataaaattagctattcacaattgatgactaaacttgatgataataatattgaaaacgtcacaatgcaaccatcagatagcttaattactgtaacaggtgagtataaaaaacctgtaaaggtaaaaggaacaaacaatttcccacttttaggtaatactacaagtgaagttaaaaacttccaagcttatattattccaactgacagtgttgtcaaagatatccaaaatgcagctaaaagtaatgatgtaaaacttagtgtcgttcaagcgtcatcaagtggtatgtgggttcaaattctctcatatatcatcccaatgattttatttgttggtatcttctggctcatgatgggtggaatgggcgctcgtggcggaggcggcggtggaaatccgatgtccttcggtaaatctcgtgctaaacaacaagatggtaaaacatcaaaagttcgttttgctgatgttgccggttctgaagaggaaaaacaagagcttgttgaagttgttgacttccttaaaaatccgaaaaaatatcacgatttaggtgctcgtatcccagcaggtgttctccttgaaggccctccgggtacagggaaaactttgcttgctaaggctgttgctggtgaagcaggagttcctttctatagtatctcaggttctgatttcgttgaaatgtttgtcggagtcggggcttcacgtgttcgtgatttattcgaaaatgcgaagaaaactgctccatcaatcattttcatcgatgaaattgatgctgttggtcgccaacgtggtgcaggtttaggtgggggtaatgatgaacgtgaacaaaccctcaaccaattgcttgttgaaatggatggattccaagacgatggaaactcagtaatcgttatcgctgcaactaaccgttcagatgtgcttgacccagcgcttttacgtccaggtcgttttgaccgtaaagtcttggtcggagcaccagatgttaaaggtcgtgaagctgtccttaaagttcatgctaaaaacaaacctttagcaagtgatgttgatttacacactgttgctacacaaactcctggttatgtcggagctgatttggaaaatgttttgaatgaagctgctcttgttgctgcacgtcaaaataaaaaagaaatcaatgctgctgatattgatgaaggaatggaccgtgcaatggctggtcctgctaagaaagatcgtattcaatcaatgcgtgagcgtgaaatcgtggcttatcacgaagcaggtcatgctattgttggtctcgttcttgaaaatggatctactgttcgtaaagttaccgttgtccctcgtggacgtatcggtggttacatgctagctcttccagatgaagaaatcatgcaaccaactaatcttcatcttcaagaccaacttgccagccttatgggtggacgacttggtgaagaaattgtctttggtgtagctactccaggtgcatcaaatgacattgaaaaagcaacacacattgctcgttcaatggtaactgaatatgggatgtctaagaaacttggtatggtatcttatgaaggagaccatcaagtatttatcggccgtgactatggtcagactaagacttactcagaagctactgctgttatgattgatgatgaagtgcgtcgtattcttggtgaagcttatgaccgtgctaaagaagcaattgaaacacatcgtgaacaacataaagcaattgcgcaagctctgcttaaatacgaaacgctcgatgcgaaacaaatcatgtcgctctttacaacaggtaaaatgcctgatgaagcagctgcattagaagtaccagaaccaaaaacatttgaagaatctctcaaagatgcaaatgcgaatgttgatgatttttcaaacattaatatctataatggtgaagaaaaaacagattctaaaccagaagaaaataaggaaaaatcagaagatgaaacagccaattaaggctgtttttcttttttttatgctttagaataattcatttagtttattcttgacaaaaaatattattttgatataattaaatagttgtcgtttgagacgactgactttcttattatgaattaaatatattattttgaaaagttaacacagtttattcttgacaaaaaaatataaaagtgtataatagaaaagtactgtttgagacagcacaacaatatatggtccgttggtcaaggggttaagacaccgccttttcacggcggtaacacgggttcgaatcccgtacggactatatctggaggattacccaagtccggctgaagggaacggtcttgaaaaccgtcaggcgtgtaaaagcgtgcgtgggttcgaatcccacatcctcctttttaattatcgcgggatggagcagctaggtagctcgtcgggctcataacccgaaggtcataggttcaaatcctattcccgcaattaaaggctcggtagctcagttggtagagcaatggattgaagctccatgtgtcggcggttcgattccgtctcgcgccattccttatttagcggatgtagtttaatggtagaaccccagccttccaagctggctacgcgagttcgattctcgtcatccgcttaacttaatattttgggagtttagctcagttggttagagcactgtgttgataacgcaggggtcccaggttcgaatcctggaattcccatatttggtattaattgcataggagatatacctgttcccatgtcgaacacagaagtcaagtcctattgcgctggaagtacttgggggttgccccctgggagataaagacgatgccaagtttacattgcggattagctcagttggtagtagcgcatgactgttaatcatgatgtcgtcagttcgagtctgacatccgcagtaactaagtcacctaagggtgactttttttattttataaatttcattaataaatcttggcacgtccttttgtgtcaggatttttatttacagtcttattggtagcggttacaatataattatattagttactatgtaaaggagtctgaaatgactgatactgtaagcttaaaagtacgagttcaaaaacttggtactgcattatctaatatggtaatgcccaatattcctgttttaattgcctggggggtgttgacgatgttcttcattcctgatggttttacacctaataaaacttttgcagcgatggttagtcccatgcttgcttttcttattcccttaatgattggttataccggtgggaaaaatatttatgagcaccgtggaggagtagttggtgcgattgcaacctttggttcaataattgcgacagctagtatttctgtaggtggtctgaatgctaaaggaaatgttcctatgattttaggagcgatgatattaggaccttttggcgcttggttaataaaaaaatttgatgaatatattcaaccacatattaaagcgggccttgaaatgcttataaataacttttcagcaggcttagtgggatttggtttatctctttttgctgttaaagtggttggcccacttgtggcttggctaacagatgtgatgggacatggcgtagactttttaatctctaaccatttaattcctcttgctaatctttttattgagccagcaaaaattttatttttaaataatgcaatcaatcagggaatcttatcacctttaggaattcaacaggtttctgaaaatgggaaatcgcttctatttttattggaagctaatcccggtccagggcttggaattctgattgcctttatgctttttggtaagggttcagctaaagcaacagcacctggtgcgattttaattcaatttgttggtggaatccatgaaatttactttccttatgtcatgatgaaacctgctctcttttttgccgtcatggctggcggggtgtctggaactttaacaaataacttattaggttctggtcttgcagctcctgcttcacctggttcgattattgcaatcacgggaatggcatctggtaaatcagtgggaggctttgcaaatgttctttgcgtctgggcagggattgctgtagcagcaattgtctcttttcttgtagcagccttcattttaaaacgagataaatcgatgattgatgattctgcttttgaaaatgccaaagtaggagtagctactgataaggctgtcagtaagggacaagactctgtcagcaatattgttactgacagagtcgatttttctgcgattaaacacatcatttttgcttgtgatgcgggaatgggttcatcggccatgggtgcttctattttgagaaataaagtcaaaaaagctggtttggggcaagatgttacgaatgtcgccattgctaacttaaaagccggttttgacacaattgtcgtcacacaagaggaacttgcgccacgagctgcgacaatggctcctgatgctcatagatattcagtggctaatttccttaactcacctcgttacgatgaaattatcagtaatctaatgaatactgacgaagctgtcagtgaacctatcattgctgacgacttggtcagtagagaagagatagatttgaatcaaattgatgaagttgttttcgctcatgatggtttacacattggttcaagtactatgggcaaagaaaccttacaggcaatttttagcagacatgatgtcaagattcctatttctgatgttgaatttattggattaggcgcatttaatgctaaaaacatcatgattgttacaaaagaagaattcacgacagtagcaaaacagaaagctccaaatgctcaacatctttccgttgagtctttgattactactccagaatacatcaatatggtaaatcgaatgaacaaataaaaaatcgattgattagctgattagtgaataagtagaaatcaaaacaaaaaggaatatttatgtttttaacaagtcgtgagcaaaaattaatccatacatttttgaaacgtggaacgcttacgataccagaaatgatggaaataacaggaacaagtcgcagaaccctttatcgcgatttaaataacttacaaaaatctttaccagaagagataagtttacaaacttctgaggaaggatattttataaaaggagatataaagcaactttctcaagctcatgaactagtagaatatacgatgactgagcgcttgtacggcgagatacttttattgattgaaaataaagcatccattttttcattaactgattattttggtattagtcagccaacggtcacgaatgatttgagacaattagaacagaccttacttgaaaatgaaatttcattaataagggagcggggcctaaagattgagggattagaagagaatattcggtcagtatttgtggctgcaatatataattctgcatcgcttcaagaattgattagtaatcaactttcagacaataaacttttaagtatcttggacttagataaatttaagcaagcttatgatgcttttgaatccctaatcttgccagaagatatgacagataaagtgagagtgctgatggaactctttcttgtaacaactctaatccggatagacgagggacatttcatcacaagtgagagtcttagtagtccaagcaaaggagcgctgaactttgttaataaattactgacagctctgtcagtaacaaaatttgttgtatctgaaattacttatcttgcttcggtctatgaaattttatattttggatttggccgagaattattatttatggaaaaatttgatacagatttctcctataaaattcgtcagattattgatcgagtttccacaaaacttgagattgaatttggaaaagacgaccgattatatggtttgctttacgctcatctcaaagaatcagagatgttacccattctttttcctaaaaaagaaaatgattttatcaaaaaaattaagaaagataatccagaaatttataaagccgtcaatgaatcattgaagttgatttttgataaaaatttttcagaaatggaaatcacttttgtaacccttcattttgtttcaaccttggaaagaagtgaccttgttttaccattgcgttcagcactcgtaagtaatcttggacggatttcatgtgaatttgtcatgagtaatttaaggaaaaattttccattcttaaaaaaaatagacctcattcaaaattctgtgaaagttgtcaaatcccaatatgatgttatttttactactgagaaggagtttgattatctttatatcaatccaatgttagatcaaaaaaatctggatgatactcgtcatcaattaagacatattcaacaaaaatcgcgaacgctaactattgattcaaaagagcaaagaaactttttaaatcttaatgacttatttacgactggtaatgaaattttaagcacttttgaaattaagacactttcaaaccagccaaatttgagcgatactgtaaaacaaatcgctaaaactgtaaacgaagatgatggagaattagcagaactaatagaagaaagatttcgggagacacatctggcaattcctgaaaccaatattgctctttttcatgcagttcattcatcgatttcaagtccactatgcaagatttatgagctaagtcaggaaattgaggggatggcaatggaccatcaaatgataaaaattaatcgtgttttactacttttggtacctccagaagtaccagaatatgtttcatatttactcggaaaactttcaagttcgattattgaaaataagctttatacaagaatatatgattccggtaactatgaaattgttagtgagttgctaagggaaataatcatagaagctgttaaacagtatggtgattaggtttacgacgtgtgtaaacctagtaaactaagaaaggtgaagaaaaatggaaatccaaaaagatcttattaaaatcaatcaaaatttttcaaataaggaagaagcaattaattattgtggaaaattgttggttgatggaggatacgtcaactcaaattatgtttcagcgatgcttgatagagataaagaattatcggtttatatgggtaattttattgcgattcctcatgggacggattcagcaaaaaaagaagttttaaaaacaggagtcataattgtccaagttcctcgaggagtaaattttggaacagaagaaaatccgaaactagcaacgatgctttttggaatcgcaggaatagaagatgagcatcttgacctcattcaaaaaatttcaattttttgtgctgacgttgacaatgttgtaaagatggctgatgctcaatcagttgaggagattgcaaaatactttgaaaattaatcaataaaatcaaaaaaatggcacaacttttggtgccattttttatatttaccaccacaatgtaaaagcttacaattgcttatttaaagggattttagaagattctatttgaactttttactatctaaataaaggagcagtaagtaagatgaaaaaagcagtacattttggtgcaggaaatattggtcgtggttttattggggaaattctaagtaaaaatggctttgagatttacttcgttgacacgaataaggcgataattgatgaacttaatactcgtcattcttatgaaattggtatcgcaagtagtagtcctgaaaaaatttttgtttcaggactatttgggattaacaatggtgaaaatcctgaggatgtaattgaggcaattgctcaagctgatatagtaacgacagcaattggaccaaatattttgccttatattgctgagctcgttgccaaaggtattcaaaaacgtaaagaagagaataagcaagtccaaatagatattattgcttgtgaaaatatgattgggggctcagagtttttagaaaagaaggtggctgaatatttatcagactctgataaagtttaccttgcaaactacatagggtttcccaatgctgccgttgaccgcattgtacctggtcaaaagcatgaagatcttctttatgttgaagtagagcccttttgtgagtgggtgattgacgagagtcagataaaaaataaaagttttaaacttgaaggcgttcattatgccaataatcttgaacctttcatagagcgtaaacttttctctgtaaactcaggacacgctacagtcgcttattctagcgcatataaaggttataaaacaattttggaaggtttacagcacaaagagattttaagtgctttaaagggtgtacagaaagaaacacgcgctttacttttagccaaatggccccaatattttacggaagaagatttgatgagctatcatcaaatgattatctctcgctttgctaatccaaaaattattgatgaggtgacgcgggttgcacgaacacctattcgaaagttaggttatgacgaacgctttattcgccctattcgtgaattaaatgaacgtggtctctcttatcaaaatcatttagatattgttggaaaaatttttgcttaccaggatgaaaatgatagtcagtcagttcaacttcaagaaaagcttagcacaatggatcttcaaaggcttattgaagaagtcactggcctatcaaataaaaaaataattttggaaatcgaactagtgattaagaaatataaaaatgacagcaagtagacagagaatattttatcgatggattttctgacttgaaatttaaccgctttctcttgaaaaaaaagataaaaagtgttattatagaaccatagaaaaagcactggaatgtgcgagctctttcatttttttgaccgactatatttgtattgcataggggttcatgagacattcggtagcgtaatacctcgaacgaaagtaggggaagctgatgcgaagcgagaacacccacctagcgttttagcgggttcaatacacggaggagcacacggcattcaatcagtgtttttttgtgtactcgtaaaacctcaaaaacctgtaaaaattttttaataggttctttgaaaaaatgatgtccaccaaatctcagtaaatttatataataaaaaatagtaattttcgtcagataagaggctgtatatcactgatatgcggctttttttggttcttgtaataaaataattttgctcttcctatgggtgagagattttgatttcagaaaagatatcgcagttatttttataactgtatttctgaaaaaatcgctataaaaaaacgggaaaagagactttaaccgtttttttttacttttaaataggatgaaatcaattttctcagttttgtccccttctatacaaaaattgaaaaaacaagcatgaaagttaatagaatttatgaacaatataatcaataatttcttgattttctgttagttggtcatgctgtgcattacttccactaactattttttcactatagctgtcgatttcttttttatatattttactacttgaaagtgaactagtcagaggaacaacgccatcactgttatctttataatttccggcaattgaaatcattttcaagttatgtgggattttttctcttttatttaccatccattttaacatatctgtttcagttaatgatgctctatctggataaggatttgcttttggatcgaggtaattatatggtgttcctagtgtaataaggtttttcatttgtgaggttggcttttgcgcttctttttccaagaaaatcgtccaaactaatcctccattagaatgtcctaatgcattataagctttgaaggaatagagttgatgggcctttttcattgctatttcagtccattctgcttgtttgtctactcctttttcggaactatctgagaaactaattacaataaaaggattattagattttttagtcaacgaagatgtatattgtgtagtaccatcggtcttaacattaattttcaggacatctctttttccgactttcttcatcaatttattcatgaagctatcaaatcgatccccgtttgctccagttccaggaattagtatgaaaggaacttggttttgagccgttttttgttcagatttgtattttatagagccataagatagtatcagtgataaaacaagcactagtatcatcgtaataatgattatttttttgtgttttattttttctacctctattcatttataatattaatatcatacaattttttgatgtaagcttctaattttaagattacatttaattatttttcacaaattacttcaagagccttaaaattttatgaaatctattgtatacatacttgtattatacggctttttaaaaaggatgtctaattgtgtgataatatctaaaaatttcgtaaggtagcttagtgtatcagctattaatttgaatttccttagactcatcattccaatattaacttgattatttatgcaagtttttcttggaagtagtaaaatattaggatataatcaaagtatgagaaaaacagatagaggtactcttgcttatggtgccgaggtgagaagcgagaaaaataataggtaatctgaacttatcactttatcagaaatagtaaattttgctgacggctgtaaagaagcctaacaaacgtttaaagacttgaaagataacaaaaatgagagtgataaatgaactaagaagaattgaagactcttctataaataatgattgagaaccccaaaaagaggttatagaagctttgaaaggctaggcggttaattgtgagcagttggatacctgacttaggttcacatcttatatatttttaagtattttgaaaaaaggagaataaaatgggattaattttaaaacgggaggaaattgtttcatttctaaaagaaaaagcagtctttgatggaacagaaaaaattatttgggcaaatataagttcagcacagggggcctatgtggtagttgtattcaataaatcgggaattttaacattaccaatcactccaatggggaaaatagaaggagatataatcattattcctcaagaagagatacaatcggtcacttttaagaaaggtttacttgcttataaaatggttgtgactactaaagataacgaagttcctgattttagagtcaataaaacaatgatagggtatggtgcgcagaaaaaagaactaggctcacttttagaaaaatataaataaacttacagactacttgtttggaaatcacaaaacgaattacagcttttggacctactatgattttcatcaccgaaccctcttttggaaaacggttaatgtttgtcataacaggataaaaattattaatctcagtaaaaatcaaatttaagaaatgagtttatttgaaagtgttagaaaaaattaaattaacaaccggagtgataaataaatttattatcatttatatgtttattggtggtatattgggcggggtgttgggttatttttttgtaaaatttattttgaagttttaagaattcgttacccagtcctagaatttaggaatacaaaataaaaagcgcttgggcgcgtgaaaatgaaaaattaggtgttcccagtcactaaaaactgggagggagtattttatgaaaaaaattatattgtctagttttgctgttttttctatcctattactttcggcatgctcaactaatcaagcacttaagcccgaaagttctagttcgaaaatatcgcagaatgataacagcaaatatgattcagtcatttcagatttaaagtcagaacttgcagataaaagcgaatataaatgggtgtttaaaattgaacacaatatcactaatgctgatatttctaagggagttatgattaatatagctcctgaaaaatatgatgattcaaaagaattgaaaaatacttatattgattagggttgggggacaagcaatctaaaaataaaattattttacttcaaaagttagtctcaaaggctgcaaaaaaactccctgatgataattctgaaattacgttaggctttaaaagtgaacaagaaagaaagggagttgttcccattgcccgctcggtaaaatctatggatgcagttcctatacatgaataattcaggctttagatataaactaataaggaaatgagctatgaaatttttaattttaatcgatagaatttattcaaaaataatgatattcttcttactgttgtccataccctttactgcattttcaatatatctttacttgaacttaccgaatatcatacctgtccaatttggactaaggtttgagcctagtaactggggaaacaaagcaactatatttatatttccattaatttttttgattctaccaacttttatgtcaagaaaatcaatatcttcacaagaaaaattattaacaaggagtgcatcagcggaaataattactatagttatactgactttcttgctaattatgatgataggagtttactatctttatttcaggatgttataatataattcactaaataaattttatgccaatatctgtcagtgcttaacaagtatattagcaggtataccccaaagtcaagctgattaaaacccgattttacaaaagagaaagaatttatatcatgagaaaaggtgacatcatcatattatctgatggacagaaagctactgttatatttggtgatgaatcaaattatcaatatagttgtatcgtaaaattagaagatgggcaattaatggttgttgaagaaaaaaatatttctctgccttcgttaaattaattccagtcttaaaagtcatctaaaacaatcagtcaaaagttgataaagaattagggcttgacaagttctaaaataattgatagaataatagagttgaaaagcagaagcacccgcttctcgccttagaggttatagccctgggcaaacaaatggaattattcaaaaacgaatgttttcatgagcggggcgagattgtcgttccgcttttgtttttctttaaaaaagaagttgggctaaattttagccaactttcacatcatattagaaggagaacgaacatagctaaacaagacaatagaaaacctatgatgaacggtgcaatccgtgctcgtgaggttcgtctcattggcgctgagggtgaacaattaggtgtcacaccaacgtctgaggcgctaatgcaagctgaaaatcttaacatggacttggttttaatttcaaatcaagaaccacctgttgccaaaatcatggattatacaaaattcatgtttgagcaaaagaaaaaacaaaaagaagcaaagaaaaaacaagcagttgtttctgtaaaagaagtccgtttgtcaccagttattgaccaaaacgactttgatacaaagcttcgccaagccatcaagttccttgaaaaaggcgataaagttaaggtttcaatccgatttaaaggtcggatgattactcaccaagatgtgggtcgtcaagtaatggacaagttcgcggaagcaacaaaagaagttgctgtcgttgaacaaagagccaaaatggatggacgtcaaatgttcttgcaacttgctcctataaaaaaataggtctgtacaagataagctcgtctcgaaagggtaacctttcaagcctttattctttagactagtgctttaagaataaagaaagcagaattcatcttctgctaactgatataaattaaggagaattacaatgccaaaacaaaaaactcaccgcgcatctgctaaacgtttcaaacgtacaggtaacggcggacttaaacgcttccgcgcttacacttctcaccgtttccacggtaaatctgtaaaacaacgtcgtcaacttcgtaaagcttctatggtttctaaaggtgacttcaaacgtatccgtcgcatggttgcgactatgaaataagcaaagcttatttcaaggagcaatctctataggagcgtaagcgactaaagggactatggaataacccatctgattttagagagttctctaaacagttgattataaaattcttgttccaactcaaataaaaaaataaacttgtcttcaaagacaaaaatgaaatctactaagaattaaaggagaacacacatggcacgtgttaaaggtagcgttgcaactcgcaaacgccgtaaacgtattttaaagctcgctaaaggttactacggagctaaacatagactcttcaagactgctaaagagcaagtcatgaattcatactactacgcattccgcgatcgtcgtcaaaagaaacgcgacttccgtaaattatggattgcacgtatcaatgcagctgctcgtatgaatggtctttcatacagcaaattgatgcacggtttgaaattagctgacatcgaagtgaaccgtaaaatgcttgctgacatcgcaatcgctgatgctgctgcatttactgcacttgctgaagaagcaaaaaaagctttggctaaataattaacttaaaaactctgctagttttctagcagagtttttttattttatatcaaattctatctgagaagatagtttttttatttggaatatgctaaattattgcaaaattcaataaaaaggattataataccgtaaatcatctttttgaaataaaagtaacgtgaaagcaataaattatgtaatgtacgaaaaaagatacgatttggaggttactgtggaaaataataatattttagtggctaaacaagtaagcgttgcttttcggattgctggaaaattgcaaaaagcaatttatgatattgatttaacggttaaacacggcgaggttttggcaattgttggggaatcaggctctggaaagtctacttttgcaacagcagtcatgggtttacataatcccaaccaaactcaaatcaaaggttccattttattagatggtgaagaagtggttggcaaaactggagattcaatgtcaaaacttcgaggaactaaggtagggatgatttttcaaaatcctttaactgctttgaatccgttgatgaaaattggtcaacaagtcatggaaatgctagcagtacatgaagtttatccagaaagccaatatgaaagtaggactttccagctcttagaacaggttgggattccaaattctaagcgtgttgccaatcaattcccacatcagctatcaggaggaatgcgacagcgggtgatgattgcgatagcaatagccaatgacccagatttgattattgctgatgaaccaacaacagctttagatgttacgattcaagctcaaattttagatttgatattagatgtacaaaagaagaaaaatgcaggagttatcttgattacccatgatttgggagtagtggcagaagtcgctgatacggtggccgtcatgtatgcgggacaattagttgaaaaagcatctgtcgaagaactattcaacaatcctaaacacccttacacaaggtcacttttacgctcaaacccttcggccgaaactgtttcagatgacttgtatgtgataccgggaaatgttccttcgttatctgaaatcgaatatgataaagatttatttcttgcacgtgtaccttggatgaaagaagaggctaaaaagataatttcaaatgagatgactgaaatttctccaaatcatttggttcgaggaagtgcttgggaaaactttgatttcccaaatcaaaccgttaaaggaggtgagaggtgagcgaaattcttagtctaaaagacttaaaagtttattacccgattcgttcaggtttctttaatagggtaacagataatgtaacggcagttgatggagtagatttgaccattcatgagggagagacggttggactggttggtgagtctggttcaggaaagacaacgattggaaaaacaatcgtcggactagagcaaatgacctcagggaaattgatttacaaggggcaagatgtcagcaagaagaaaataagaaatcagttcaagtataacaaagatgtacaaatgatttttcaggatgccttttctagccttaatcctcgtaaaaatatttatgatattattgctgaaccgattagaaattttgaaaaattggatccaaattcagaaaataaaaggatacttgaattattggatattgtgggcttacccaaacaaactttaagtcaatatccctttcaattttcaggagggcaacaacaacggattggaatagctcgggcagttgcgaccaatcctaaattaattgtggccgatgagcctgtctctgctcttgatttgtctgttcaggctcaggttctaaactttatgaaactcattcaaaaagatttgggaatcgcttttttgttcatttctcatgatttgggagttgtgcgacatatgacggataatattgcggtcatgcacaatgggcgaattgtagaaaaaggaacgcgaaaggatatttttgaacaggccgagcatatttacacaaaacgtttattatccgctattccttctatcgatgtctcaagaagaagggaaaataggtcgaaacgattagaagtggaacaagaatttgaaactaaaaaatcaattttttatgataaggagggacgcgctctgcccttacaagaattaagtaaaacacactgggcagctttaccaaaaaggggggaaatgtggaaagtaattattagacgtgttttattgatgattccgcaactatttatcctgagtattcttgttttcttctttgctaaattgataccaggtgaccctttctctggtttaattgggccacatacagatccacacgaaattgaagctttaaggcgtgcagctggcctgtacgacccttggtgggaacaatatctcagatggttgggacatgcgattcatggaaatttggggatgtcttataatctcaaagagcctgtcactactgtcattggtcaacgagcggttaatactttttggatgtcgcttctttctgtgattttgacctatttatttgctgtgccaatgtctatcgttgcagcccgtcatgagggaaaatggcaagaccgtttatggttgacatataactcgattacttttggtattccacattatgttttctatttggtcatgatttttatctttggttatagtttaggctggtttccaacggatggaacagttagtccaaatgctgttggttttgtcgccgtcttttttagtcgaatctatcacatgattcttccggcttttagcttggcagtttttggaacagtcgcgatattcacttatttccgttcagggattttggatgaagaaacgcaggattatgtgcgaacggcgcgagctaaaggagtgaaggaaagagtgattttcactcgacatatcttgagaaacgcttcactaccgattgcggcaaactttggttttgtaattacgggacttttaggaggggcgatatttgcagaaacgattttcggctatcctggtttgggtcaactttttattacctcaatcactggtcgagattattcaatgattacggctctgatttttttaaatggttttctgggtttattaggggcccttttgtcagatattatcatggcaattgttgaccctcgaattcggattcagtaaggagtgaaaatgtcagaaaaaaaacaaaaaaattctctatcattgattcactcaatcaaagaagaactcaaacatgataaactggcattgatttcaacaattttcctcttagttgtctttttgacagtttatatctactcgatgtttctcaagcaagcaaattatgttgatgtcaatatcatggaccagtatctggcgcctttgaccaatggtcatttgctgggaacggataatgggggacgcgatatcatcatgatgctaatgattagtgcgcggaattcctttaatatcgcctttgcagtgactttgattaccttagttgtcgggaatgttttaggggtgattacggggtattacgggggaaggtttgatttaatcttcatgcgtttcaccgatttttggatgattttaccatcaatgatgattattatcgtttttgtaactattattccgcgatttaatgcttggtccttgatttggattattagtatctttagttggataggaacaacacgtctgattcgggcaaaaacattgacagaggttaatcgagactatgttcgggcttctaagacttcgggaacttcaaatttaaaaattatgttccgagaaatctggcctaacttatcgactttggttatcgctgagtctactttagtcttttccggaaatattgggctagaaacaggactttctttcttgggattcggacttcctgcagggactccttctttggggacgatgattagtgaggcaacgaacccagaaacgatgactgacaaaccttggacttgggttccagcaacggtagtcatcttgattgtggtccttgcaattattttcatcggtaatgcactaagacgcgttgctgaccaaagacaagcagtaagataaaataataatatcagaatataaaaaatagtttgacaaaaataaaattagtgatataatctaaacattatagttaaactagaaataaaacttaatttttcgggagaaaattaacatgaaaaaattgaatataactttattggcaacgactgcagttttagcaactgcactcttgagtgcttgtggctccaaccaaagctcaagtacaagcgctacaaaattaaaagccggaagttttgatgtggcttacaaaaatccggacaaggctatcaaaggtgggaatctaaaagtcgcctatcaaaatgactccccaatgaaagccgaatggctggctggacttgagaatgatgctacttttgctgcgatggctagtccagcaggtggattagatggaattttctttacaaatagtgcttttaaatttatcaatggtggtcctgcgaatatcagccttgatgattctgcaaaaacagcaacaattaccttgcgtaaagatttgaagtggtcggatggctcgcaagttacggctaaagactatgaatttacttatgaaacaatcgctaatcctgcttatggctctgaccgttggaccgattctttagccaatatcgttggtttgagtgattatcatacaggtaaagcaaaaacaatctcaggcattactttcccagatggtgaaaatggtaagattgtcaagattcaatttaaagaaatgacaccaggaatgactcaatcagggaatggctatttccttgaaacagtgactccttatcaatacttgaaagacgtggcgcctaaagacttggcttcaagtacaaaaacgacaaccaaaccattagtcacaggtcctttcaaaccagcaaatgttgttgctggcgaatcaatcaaatatgtaccaaatccatattattggggcgaaaaaccaaaattacactctatcacctatgaaacagtttcaacaaataaatcagttgctgctctctcatctggtaaatattacttcatcaattctatggtcgctagtcagtacaaacaagtgaagaacttgaagggctataaagttcttggtcaacaagcactctatatctcactgatgtactacagtcttggacattatgacacaaaaaattcaatcaatgttcaagaccgtaagacaccattgcaagaccaaagtgttcgtcaggctgttgcttatgctcgtaatgttgcagaggttgacaataagttctctaacggacttgcaacccctgcaaatggtttaattccacctatctttaaacagtttacaagttcatcagtcaaaggttatgaaaaacaaaatcttgacaaggccaataaacttttggatgcagatggttggaaactcaataagtctacaggctaccgtgaaaaagacggaaaagaattatcgcttgtctatgcagcgcgtcaaggagatgctaatcaagaaaccatcgctcaaaactatatccaacaatggaagaagattggtgtaaaaatgagtctttacaatggtaaattgatggaatttaattcttgggttgatcatatgacgactcctccaggagcaaatgattgggatattaccgatggggcttggtcactttcgtcagaaccatctcaacaagatttattctcagcagcagccccttataatattggtcactttaacgacccacaaattacgaatgatttgaatgatattgattcaactaagtcagaaagtgcaacttatcgtaaagccgcttttgttaaatatcaaaatgatatgaataaaaaagcttatgttgttccaaccaacttttcattaaattacacaccagttaataaacgtgtggtcggaatgacacttgactatggggatatgaacctttggtcagaaattggagtctcttctaataagatggctaccaaataattttaattaactatgtttacaagtttttttgtaaaaataccctcactttagttcgcaatctaaagtcaaagaaattcaagtctatgatttgaatttcttttgttttataaaaataaaaaaatcactgacaaaattctgtcagtgattttatttgttgaaggtgtaaattttttattggcggacaacgagtacgtcacaaggcgcattcttgataatgtagtccgccacggatccgataaagatacgctcaatgtaagaaagaccagtagctccaagaacgattagactaatttcttcttctttaggaagggtttgtccgagcattacttttggagaaccaaactcaacacgagttttaacctttttgacaccagctttttttgcttcatcagcaaagtcattaatgagattttcagcacctttgtgtgtatcatcagcaacaactgaatcataagctgagatagattggaaggcacgaaggtcaatgacgttagcgataacgagttcagcatcgttacgaagtgctgttgcgactgctttgtcaaaggctttagtagcttctaccgaaccatcaataccaacaaggattttcttatagttatctaacataggcgactccttcataagtttttatctatattttaattttactcttattttgtcaatttgtaaaaagaaaactgttaaaaaaaggtttatggtataattgataaagtgaatttcttcaaaacaatattcaaaaaatactgacaaagattcaaaattatctctaaatggacttaagtcaatctggagtttctgtcagtaaaatttgtgagtggttattgaagaaaactgtaagaaataggtgaaaaatatgactcgatatgctgtggtggatctggaagcgaccgatgctcatagtagtgaaaataaaattatacagattgggattgcgcttgttgaaggtggaaaaatcgttgaaacttattccacagaagtaaatccgcatgaacctttgcttccaaggattagtgagttaactggtttgtcagataagcaattaaaaagtgcccccgatttttcagaagttgcctcagaggtgagaaaactgctgacggatagtgtttttgttgctcataatgctcggtttgattatggacttttagaaaaaagttttcttaatgctggtttagaatttaatgaaatgttacgcgttgacacagttgatttggcgcgtgttttctatccaacttttgaaaaatatgggttagaagcgctaagcgaaaaattagacttagctcatgaccatccgcatgctgcggtttctgatgcttatgcaacggcagaattattaataagaatagaagaaaaaatccaaaaactaccaagaagtgttttagaagaattgctcagacattcagataatttgctttttgaaagtaaaagcttcttacaagaacagttagataaaacaaaaattcgaccagctgcttttaaagtggttcataatattgcgacacgtaagtttaaatcttctgtcagtaaaaaaaattcagtggcgaatctgtcagcaaatttttcggaaaacatcagtaagttaggtttagcttctcgctcaaagcaagaaaaattagctcatttaatggaaacagagcttacacatttacaagcaagttttattgaggctccgacaggacttgggaaaacttatggttacttattacccctagtagcagcaggtcaacgaattgttgtttcaacagcaacaaaagttctccaaaagcaattggtgaatgatgttgctccaaaacttgcagaaacatttggtcttaaaatggccaatattgtaggaaccaaaaactacatttccttgagaaaattttctgaactcttattaaataatacagatggcaaaaattttgaaattttcaagatgaagattttaatttggctgacagaaacaaaaacgggcgaattggatgaaatttcaaaagtcatgacaaatgatgattattttgatggcattcgccacgatggctatgtcaacactaaacattttcattatgaacaagatttttggttgagagctcaaaaagaagctgaacaagctgaaattaaagtagtgaatcatgcttatctgattgaacgtttagcagattatccagaaacttttttggaaaatcgagtgcttgtcgtcgatgaggctcaacaactatttccaatcatggaaaatgctggtcagaaaagtataaaaattacggatgaactcttaaaaattgactctgaatcaagtgaaaatccgcaactgactaaacgtcttcaagaaagtcttgtttttcagctcaataaaaaagaacttgacttaagtaaaataaaaatagacgctgatgaactcgggctgacagaactatcagcacttttggaagctgataatcagatagtttggcgtgaaaatgacatactttatagtagcgaccaagatttttataattttgagcgtctgattcccaaagaaactaaattgttcgtgttgggagcgacactttctctatctaaagataaaccctcttttccagaattacttggttttaaagattatcgatttttcaaaattgaaggtagtcaagccaccaatcaagaattattgacaatggcagatgctcctaatatcaaaaatgtaagtttgattgattacgcagactatacagctgataccattgcagaacttgccaagttgaatctcccaattgttgttttatttacttcaaaaatgtcattaacttttgttgctgaaaaactatccgctgaaggatttgatattttagcacaagatataaatggaagtccagctcaaatcaagaaaaaatttgataagggcgaaggaaaaattttattaggactcggctctttttgggagggtgttgattttgataagcaaaaccaagtgattctggttataccaagattgccctttgcgacacctgatgatattttaactaaaaaatatgctaaaaaatttgaaaatcctttttatgacttcaacgttcccatggcgactttaaaaatgcgtcaagcaattggtcgagtgaatcggcgaaaaaatcagtactcaagtattgttgtattagataaacgtcttggtggaaaatcctatgccaaaagaatgcggaaaaatctctcagaagctttacctgtaaaaatgctgagtttacttgacacaatcagcgaaatcaagaattttttgatataataaaacatgtttaagcaaaaacttaaaatgggagattggacaaattatttttggccaatcataagagatttttactaataaatagcttgaaatatctttgaaaaagatttgctcaaattttgaaagaagaaaaaaatgaaaaagcggaaaatgactcgacattcgcaaattataatcggaattttagtgataattttagccatttatttgtctatcggccttttcttttggaaaagtctgaatccctatcattctgtgcgagtgcaagcgataaatattgctaaagacaaaacagatttagtcaaagcgacgggatttgatattgcgtctacagatactgtgacttattcaattgtcgggctcaataaagcgaaccaagaagttggaattttaattccaaaaaaatctggtaaaatcaaagaggtacaattatctgagggggtttcacctgcaagcttaacgactaaagataccaaatcagttgttttagcgctttacaaaggaaaaccagcctgggaagtaaataatagcaatggatttaaagtttatgactttgagtcaggaaaagagttgatatgaaaaaatgttctgattttgtattaaaaatggatgagtctgtgacccttgcggcggccaatcgtgccaaagcattaaaagcacaaggacgagatattatcgacttgacccttggtcaaccagactttccaactcctaaaaaaattggtcaagcggccatcgaagcgataaataatggacaagctagtttttatacacaagctggtggacttccagaacttaaaaaagccgttcaacattattggacacgtttttatgcttatgaaattcaaacaaacgaaatattaattacggctggggcaaagtttgccctctacgcttactttatggcaactgttgatcctttagatgaggtaatcataccagcaccttattgggtttcttatgtcgaccaagtaaaaatggctggtggaaatccagtaattgtagaagccaagcaagaaaataactttaaagttacggttgagcaattagaaaaagcaagaacaagcaaaactaagattttattactaaattcgccttcaaatccaacaggaatgatttattctaaagaagaattaacagccattggcgagtgggcagttgccaatgatttattgattttggccgatgatatctatcatcgtttggtttataatggagctgaatttacagcaatttcaagcctgtctgatgaaatcagaaacagaacgacagtgattaatggtgtttctaaaacatttgcaatgactggttggcgaattggtttagccgtaggtgctccagaaattattgctgcaatgactaaaattgccagtcaaaccacttcaaatccgaccgctgttgctcaatatgctgccatagaggcatttgaagaaaatgataaaagttttgagaaaatgcatgctgcatttgaagaacgcttaaataaaatttatcttcaactttcagaagttcctggttttgaacttgtgaaaccaaatggtgctttctatttgttcccgaaagtgaccaaggctatggcgatgaaaggctatacggatgtgactgattttacgacagccattcttgaagaagctggggtagctctagttacaggagcaggttttggttctccagaaaatgttcgtttgagttatgcaacaagtcttgaaactctggaagctgcagtaacaagattaaaggattggatgaatgattgataaaaaagaagcaaaatcagcttataaactctctaaaaaaataggggcagttgttgcttataaaaatttagaaacaaatgaacgctatattgatatagcaccagacttagcaggtgtaaaaaatcggtttgaatttgctaaaaagactgggattggtttgccttatgccattgaaaaagcagcaaaaacggctgattttgaattggaagttcttgaagaactagaaaaagatgaacttcaaacgacgaaagaattcaaagaagatttaaaaaccttaaaagaaatctggcttgaaaagtcataaaagtatgatttaaaaaatataaaataaaaatttagaaggatttatttatgaaagacttaatttcaatcatcgacgtcaaagaccacgttggtgaaacagtaaaaatcggcgcttgggtcgctgacaaatcaggcaaagggaaacttcaatttcttcaacttcgcgatggaacagcatttttccaagctgttgttttcaaaccaaatatgattgaaaaatttggtgaagaagaaggaacagctaaatttgatgaaatcaaacatttatcacaagaaacttcagtttatgtgactggtgtggtcaaagaagattcacgttcaaaatttggttatgaacttgatgtgacagagttggaagtgattggtcactcacacgattatccaattacaccaaaagaacatggagttgaattcctccttgataaccgtcatttatggttgcgctcaaaacgtcaaatggcaatgatgcaagtgcgtaatgcaattatctatgcaagctatgatttctttgcgaaaaacggctttattaagtttgatagcccaattctttcaggaaatgctgcagaaaacacaacagaactctttgaaacagattattttggtaattctgctttcttgtcacaatcaggacaactttatcttgaagctggagcaatggctcttggacgtgttttcgactttggaccagtattccgtgctgaaaaatcaaaaactcgtcgtcatttgacagaattttggatgatggatgcagaatatccatttgttactcatgatgactctttggatattcaagaagcttatgtgaaagctttgattcaaggcgttttggataatgcggcttatgctcttgaaacacttgaacgtgatacaagcatgttgcaaaagtatattgatacacctttcaaacgtgtgtcttatgatgatgcgatagatttgttgcaagcccatgaaaatgatgatgacacagactatgaacacgtagaacatggtgatgactttggctcaccacatgaaacatggatttcaaattactatggtgttccaacctttatcgtcaactatcctgcaagtttcaaagctttctacatgaaaccagttcctggtaatccagaacgtgtcttgtgtgctgatttgttggcaccagaaggttatggtgaaattattggtggttcagaacgtgaaacagattatgatttgttacttaagaaaattgctgatttcggtttagatcctaaagattatgattggtatttagaacttcgcaaatttggttcagttcctcatgctggtttcggacttggtctggaacgtatggtcacttttgtggctggaacagaacacattcgtgaagccattccattcccacgtatgattaaccgtatccaaccttaaaaaataaaagcctctaaattagaggcttttttattacttattattcagaatctgaggatgagcttgcagcatcaatgtcattttgtgtgattaagagattaaaaatctctgaattatctggattcaagtagatgtaacgttctttgaaattgggataaatggaggtgaatctgttgaactcagccgctgttcccaaagccaattgattaatcatttcctctttagaaactgtaggggttactttatttttataaatataggtataaacaattgtttcaggagcttctgcagtaactttgatatctgagtaggtatctttgaaagaagctttcgttgtttccatatttttttgtgtagcttctacagtcatttgaaagctagaactaatattttcttgattattttcaactttttttgaagaagatgttgaacttgaagaggagatagccgttgatgaaacagatgaactggctttggctttactgtctgattttttagagcaagctcctaacgagagaagagcaagtgcaagagttgtactaattaaaatttttttcataatactaggagtataacatgtttagtttcatttaagcaagcgaaaaatgtaattttgatttcaaaaaatacatttttattttataatttacgatatcttttacttttaagtcagtaaatcggaagcaaatgaaaattttttcattaaattttgataatgatagcctttgcaagactgtgatataattagacttatgaaaagtaaagaagagcagcgaatgagttggtcagaagatgaatatgaagcgatggttgacatagcaacaagacaattggctgaacggatggccaagcgggcattgattactcatgaactgtatgattataattatcttgattcgcagtttgtggcggattttattgctgaatttgtcatcagcggctatgcttcctatttgattaaacctgaaaatcttgatgaagaggccattttgcttttatttgtgaatatggcttatgaaaatatgcgaggattgccagatgaagtgggacaataccatcggctttttcgccaactttgtgacctttattatgaacaaggttgcttgcgaaatgctttagtcgatgaagtagactatcaagaaatggttttagcaattttagcggatatttttatggaagtaaaattgcgaaaaaagctttgaaatagggtttgtaaaatttaagggggagaaaatggacttagatgcttatcaaaaagcaattgtcaaatttgatttaaataaaaatattgagtctcaggataaaattgattttgcttttttggacaaaattttagggctgtctggcgaggcaggagaagttgctgacaaagtaaaaaaagtgattcgggaccaagagggaaagctgtcagtaaatgataaaaaggcaatttcttacgagctaggcgacttattgtggtatctggcgacaagtgcacgttatttaggaatatccttagaacaagttgcaagcgaaaacattgaaaaattagaaagtcgtttaaatcgtggaaaaatttcaggatcaggtgatgaaagatgaaaatattaattgtagcaggcttgcctgattttattcccgacgaaacttttgataaatatattggagtggatcgtggctcgctttttttagtggaaaaagggattcagttaacgcttgcgattggtgattttgattctgtcagtaaaactgaacttgataaaatttctgtcagtactgacaagttgattaaattacctgctgaaaaagatttgacagatttagaagcagctttagattttatattaaaagattttccagatgctgagctgacaatagctggtgctttaggcggacgtttggatcacttactgaccaatgcctacctagcaacacgcccaaaatatcaaagtcttgctcccaaaatatatttagttgaccaacaaaatttggtgacctatttactaccaggtcagcatttactcaaaagaataccaacttacaaatatattggttttgtacaggtcgatacaaaagatagtctggctattgtgggagccaagtatcctttgaaagccgaagataattttagtttaatctatgcaagtaatgagtttataagtgagcagatgcaagtttcatttgaaagtggcgtggttattgtgatttattcaggagatttgcggaaaaaataagtatcatcagatttaaggagagaaaaaagtatgattattggagtcattggggcaacatcaaatatcgcaagcaaagcttatttacctgtttatgcaaaaatgcaggaagaataccgttttattttatattctcgtcagtgggataaagccgaaaaagttcgtaagcagtataaatttgaatacgcaacagaagatttatcagcgcttgaaacggttgatttagttattatccaagctgcgacaagccaacattttgaattggccaaaagatatctgacagcaggggttccggtattaatggataaaccgatttccgaaaatcttgctgaggtaaaaaaattacaaaagttagcaaggcaaaaaaaatgttttatttgttgttgcctttaatcgtagatttgcaccacaaactgctaaattaaaagccttaacagaaaaaaatatggtgagagtaagcaaaaatttagcgaattctgcgagtgacaaaatcactttttcgatgtatgatatttttattcatccgcttgacaccttgatttatttgctagatgatgaaattttagaagtgaattattcacttaaaaagaataaaaatgggctcttaacacgagcgattgttatgttagaaaccgcgacgactagcgggattgcaacgatgaatttagaagcaggagcttttacagaagaatttatagtggaaagtcccaatgcaactctccgtttatcagagctgacagaacttgaaaaaatgacaggaattgaccgccaaaaatttggaattagtgattggaaaagtgccacttataatcgaggatttgatgaaataatttcagcaatgactcaggcagttgaaaaatttgatggtcaaaatcgagaagagttactgacagaacttaaacaaaaaaatattttaaaatcgcatgaaatcattgcccaaatgttgagctgagaaaatactgacagaatttcaaaaatttctgtcagtatttttttttgattgcccccttgcattattgtcaataaaaaagtataattataaaaaaattaagaaaaggagtccgcatgaaaacacaacaatcaacagtcttttatttttggcgcagatagtttgtgtttatgcaattggcgtagatacaacttttgagtatactcaagtttctgcgccgggattcaaagaagaccggatagtaaaaactatctggtctttcttttttaatttttttaacctttctttcaactctaaagtaaaattaatcgtaaagaccgactccaagcagggttttgctaggtgactggaaggtaacttataaaagaaagctttgctttcacacattagaaaagaggaattttatggaaaattctacaggcttgaagtcttctttaaagactcgtcacattgttatgctctcacttgggggagcgattggatcaggactatttttaggttctggtaaagtcatcgcacaagcagggccaagtgtgctgctctcctacgtcttagctgggctgaccctttatgtcgtcatgtatggtgttggaaaaatggtcattcatcaagatgaccataaagctgggatggctggagttgttgctccttttattggagatcattgggcgcattttgcagactgggtttactgggcaacttggatggcggtcctcatcgcagaagaagcgggagtttcaactttccttgctatgctaattcctggcgtcccactttgggtttttgctttggttgttgcggttcttggaacggcaattaatctctggtcagtcaaagcttttgccgaaatggaatattggttggcctttatcaaggtcgctgttatcctacttttgattgctttgggtatttatttattggttatcaatgatgctcatcttggttttgttgccgatagtgctcaaaaagtaactacgaaaagtacagcaccaagttttgctccaaatggtttttcaggatttttaacttcactattagtcgttattttctcatttggtggttctgaattggcagccattacagttgctgaaacagaaaatccaaaagtggctattccgagagctattcgaggcgttttaattcggattattagtttttatgttattccaatctttttattcttgcatttattgccatggagcgaagtgtcaaatccagacgccgctagtccatttgcgacaatttttgctcgagttggaattcctcacgcagataaaattgtacttgtaattattgttattgctattttctcagccgtgaattcggcaatttatgctacttcacgttcactttattctcgaattcaaggttcaagcacttatgtgggtaaaaaattaggtaaattatcaaaaaatcaggtgccaacgaatgcgattttagtttcttcatttgttctatttatcggagttcttttatcagctgttttgggtgatggtttctggcaatttgtcgccggttcaatctcatttaccatttcaatcgtatggattctcttattagttgctgctttagttttgtattttaaacataaagaagtcacaaattggtttgttaaattggcaacacttgtagtacttatcgctttaagcctcgtgtttatcatgcaaattatcacaaatccttggacattgtccgtctttgccttggttatttgccttttgtcttactttagttaccgcaagaaaaaagcataatagaaaaaacattcattttataatgaatgtttttatttttgcttggctaaaagatactctaaaaatttttctttaatcaaattatttttgataagtttcaatttttgctgacgaacaagtttatgtttaaaccaccattcacaagacatggcatcatttttattatcaaaattgacagaagcaagtaacttaactggaagcctcgtttttgtgtatttagctccttttccggagttgtgagtggcgagtcttttttctaaatcagtggtgtagccacagtaaagcgtttggtcagcgcactgtaaaacataggtgaaatgggtgttcataaaattatcctaaaatttctaaaatgctaaatgtctatagattgattatagcatttcatgtagccaaagttaagagctagctttctattcatggtataataatagtatgattacttcacttacgattctttcaagtctggcaattattgtgactgcaatcattgcttttgcggaatatcaggctggaaaaagacgtcattcaaccactcattctattgaaatgcttcataagcaaaaagatgattttattaagtggttttatgattatcttcacatttcacaagtcttgatgcgagtgaccattcagcttaatatggaccgtttggaacaacgtcattttgagaacacaaatgattcaagtaatcagcgtcgcattattcgtattaatgagaatacaatgtcaagagatcgaaatgctgcggatttaaattatcagatgatgcttttaaatctagtgattgatgaccgtaagccttattttgagaatactcaaataaaaattcgttcgaattttgaaacattgatgcatgacatcaatgagtttacaagaaaaattcatgtagaatatgataaaaaaatgaaagaaactgatgatgcaggctgtcgttctattatgaatgaagctcgcaatttggctagaaatacgatggaaattatcgaaaaatctaatcatgaaatgggtgaacaagttaaacatgatattcagtcactagaagatgaagtagaacattattttaaaaaataaagcaaacaggaatgtacaagacaaatagtaatacatggtgcgtgctagacaggactagtgaactctctcttagtgagaatggacatctgcaataaaagaaacgtgctaacctgtagagtaaaaacaaaataaaaaggaagtaatatgccacaagataaaatagtaatacacggtgcgcgtgagcacaatttaaaaaatattgatgttgagattccaagagataaattagttgtagtcacaggtgtttcaggttctggtaaatcatcactggcctttgaaactttatatgcggaagggcaacgccgttatgttgaatccctgtcagcctatgccagacagtttttgggaaatatggataaaccagatgttgactcaatagatggtttgtcaccagcgatttccattgaccaaaaaacaacctcaaaaaatccgcgttcaacggtcggaacagtcacagaaattaatgattatttgcgtttgctctatgctcgtgttggaacgccttactgtgtgaatggtcatggtaaaatttcggcacaatctgtcgaagagattgttgaacaaattcttgaactcccagaaaaaacacgtttgcaaatccttgctcctgtcgtgcggactaaaaagggaacgcacgttaagatgtttgaacgtatccaaaaagatggttatgtgcgcgtccgcgttgatggtgaagtttatgatatttcagaagttccagagcttgataaaaataaaaaacataccattgaaattgttattgaccggattgtcgtgaaagaaggtattcgctcacgtctttttgactcggtagaagccgcgcttcatcaggccgaaggttatgttattgttgataaaatggatggctctgagctgctttttagtgaattttacgcttgtcctgtttgtggatttactgttccagaattagaaccacgccttttttcatttaatgcaccttttggttcatgtccagattgtgatggactaggagtcaaattggaaccagacgtcgatttactaattcctgacaccagtaaaacactgcgtgaaggggcgattatctactggtatggaaaagcctcaacttactacccagcacttttagaacaagctatggagcaatttggcattgatttagacacgccttgggaaaaattatcagaaaaagagcagcaaatcgtcctttatggaaatggcgataaactttttcattttctccacgaaggggattttggattacgtgaccaagatatgacttttgttggggtcattcctaatctttggcgccgttatcgctcgggaatgagtgagtctgccagagaaatggcacgttcttacatgactgaattgacttgtacgacttgtcatggttatcgtttgaatgaccaagctttatctgtcaaagtcggcgaaaaaaatattgctgaattttcaattctttcaatcggcgatacgcttgattatgtgaagagtttggtgctttctgaaaataatgaaatgattgccaaacccattttgaaagaaatcaaagaccgtttggctttcttgaaaaatgttggcttggattatttgactttgtctcgttcgagtggcactttgtcaggtggcgaatctcaacgtattcgcttggcgacacagattggttctaatttgtctggtgttttgtatattttggatgagccatcaatcggtttgcatcaaagagataatgatcgtttgattgaatctttgcaaaaaatgcgtgatttagggaatactttgattgttgttgaacatgatgaagacacgatgatggcagccgattggctgattgatgtcggtcctggcgcgggtgatttaggtggtgagattattgcttctggcacaccaaaacaagtcatgaaaaataagaaatcactgacagggcaatatttgtcaggaaaaagagccattccagttcctgtaaaacgtcgggccattgataagaaaaagatggtcaagattacaggtgcaagcgaaaataatttgaaaaatcttgatgctgagttcccaatgggcgtcatgactgctgtgactggtgtttctggttcgggtaaatcaactttggtcaatagtatcttgaaaaaatcattggctcaaaaattgaatcataattcagaaaaaccgggtaaacataaaaaaattacaggtcatgaaggaattgagcgtttgattgatattgaccaaagtccaattggtcgtacaccgcgctcaaatccagcaacatataccagtgtttttgatgatattcgtgatttatttgccaataccaatgaggcaaaaattcgtggatataaaaaaggacgtttttcattcaatgtcaaaggtggacgttgtgaagcctgttctggtgatggaatcatcaagattgaaatgcactttttgccagatgtttatgtgccttgtgaagtttgccacggtagacgttataattcggaaactttggaagttcattataaagggaaaaatatttcggaagtgcttgatatgcgcgtgtctgacgggctcgaattcttccgtcatattccaaaaatcgagcggaaattgcaaaccattgtcgatgttggtttgggctatgtgacccttggtcaaccagcaacaaccttgtcaggtggagaagcacagcgtatgaaattggcttctgagttgcaaaaacgctcaaatggtaaagctttttatatcttggatgagccaacaactggtttgcacagcgaagatattgcgacattgattcaggttttagaccgtttggttgaacaaggaaatacgattgtggtcattgagcacaatttggacgtcattaaaacggcagattatatcattgatttaggaccagaaggtggagctggcggcggaataattcttgccaagggtacgcctgaggaagtagccaaagttactgacagctatactggtcagtatcttaaagcaaaattagaaaaagcaaaaggatgagaatactaagaaatttttgtcagtaaatataatcaaacaagcgtaatctatatatttagattacgcttttaaggaaagaaaatggataaattaaaagaaatttttgaagccatcaaagcagatccgcaaaatataaattacacaaaggaaggaattgaaccactttattctgttcataaagaagccaaaatttgtatcataggacaagcaccgggcattagagcgcaggaatcacgcctcttttggaacgatccatcaggagaacgcttgcgtgactggctaggaattgaccgagaaacattttatcaatcgaataaaatttcaattttacctttagatttctattttccaggaaaaggaaaatcaggggatttgccccctcgaaaaggctttgccgaaaaatggcatgaacagcttttgcaacaaatgccagaaattgaattttttgttttggttggatcttatacgataaaatactatttaaatctaaaatcgtcagcaaaaacaacagaagtgattcgtgattttgaaaaatatctgccaaaatattttccacttattcaccctagtccaagaaataacatttggctagccaaaaatccttggtttgagcctcaacttgtaccagaacttcaaaaaagaattgcacaattaatgaaataaattataaatacataaacagtaataaaaaagttactaacagggttgttagtaacttttttatatgactgcctctttaatccgtggataatttttcctgattatggttagaatttatgattgaatattttatgcaaccttaaagatttttttaaattctttttctgctaattcatataagcaataatttagatgataatggtctaaaaaatgataaatattaacagattcaagcacattaaagtagctaatataatcaacaatatagtcatgaatttcagaatattctttgctaatgattgagtaagctaattcaaatggggcatccgttgtatcaacaaatacattaaaatattcataagtccctccattagcttcaaatatttcccagagaagaagaagtgcttcatgatttgctctcacttcttgaggatttattgcgtcaaaatattctccacgatgattatctttattaaggatatgaatgagttcatgagctatttcaaaaggagaggcctccttaaagttataaatcattaactttttatcaacattaactgctgcggggattggcaaaatatccacagcaaaaatctcaaatccacatttttcaatttctctgaggagatattctaaaagctcctgtctgcccatagaaaacccattatcttctaaacgtttttttcatactcacaacggaattgcggttgatacaaatgatgcttacatgagcactcgactcccacatcatttttaccgaattgttggttcaggctcagtaaatactgacaacaaacctcagatggttactttaaatcttgacggacagtttggcaatgcgaccgctaaacggctacaagaatactttgatacagccggaaaagacggagtaattagccatcagtacaaacagacctttaatcaaaatatttatgcagcgcaatttgattcatcactgacaggttcaaacgtggtcaaagcattgcaaagattcttaggcattgaacaagacggactatttggccaagctacaattaaagctttgcaaaaacatcttggaacaacacaagatggaatgattagttcggtttctgactctgtgaaagaacttcaaagagctttgaattggaataagatataaaataaaagcctgactttagtcaggtttttattatttgttaattaagaaaatataaactattggtcactaaaatcagttctttccatctgaatatgctgaatccctgcttcttcaaaaatttgtccaacttcattaaaatggaatttactatacaaacctcgtgcagaaagttgcgcatgaagttctaatttatttagcttagtttctttggcaaattcaatcaggcggtcaatcaaaattgctgcataaccatttcctcgggcttcttttaaaattgccattcgttgaaccaatgctgttttttcatccaaatcagtaagtaagcgaacagcccccttggcaactccttcatcataaaggacaaaatgaacagcagaagcttcctcaagggcattactaacctcaagttcataaggaaccccttgttctttgacaaaaacttgattgcgaattcgtaaagcatcaaaataaatatcggacatcgtgtcacgagtcactctaatttccataagttctcctaaagattagtttacataaaagccttgggtttattataaagctttctatagatacttgcaagtgttggaattactacatctgatagtttaggattatattgtatgtgatgcatagagcctagttttaagaagaataaaatattttacaaaatttctgattaaaatccttgacatatcccatctttagatataaaatatccatagattaaataaatctacggattgcaatgagaaatgatgaatattgttttattaggcggaaatggctatataggaagacatcttacagaaatgtggataaataagaataatgatattaaaatatacacaatttcaagaagtggtaaaaataagtttgagcatcctaatgtgatcaacatcaaagcagatgtaaatgattttgaaaaattgaaaaagctcttaccacaagaggttgactttattataaatttaattggggcaccagaaaaagatgaacttaaatcaagagagataaatgatcaaccagcagaagtaatgctgaaaattgctcaaataaaaaaagttaaggccatgggcatgataggaggaaaacttggacctaaatattttttgaatacaaaagcgaaattaattaatatgttgagagaatctgagatacctgtagttgttgtcgaacctactttagtttatggaggagataggagagatagactatcaaaattggttcccttattcaatattttgggagttttttctaaaaatataaaacctatcagagtagaaaaagttgtaaaagaaatgattgagggattggaaaataaatgaaactgtccaaacatttagaggaagccgtttacgttttactaattttagcgactcaaaaagaccaacaagccttgaaaagtaaaacgctcagcaaattattggaagtttccgactcctctctaaaaaaagtattaaggcaattagtggtaaataatttaatagagtctactgcaagtaaggatggtggctttaagcttaaaaaaagaataaatgaaatttcgttaaaggacgtaatggctgcagtagagggggaagaattcattagtgctgaccttagtcatattgggcagcgcatctttccaaataaagcacacacacttgagagtgagagtctagtgattgaaactttaactaaagctcaaaatctttatgcactagaattagagaaattaaagcttagtgatttattgttagccgaagcgatggataataagactttagactggctaaaaagagaatgaggtctctttttagccgtagcaaaacaccttgtaggtgttttttatatttatagactttataaaagccagtagattttatctatgcttttttagaggaaacttttggatgtgaaaggcgctaaaagaacaatatttagatgacttattttttgtttgaaggctaacctagcgcggtaaatcagtttatggtattatagatagtattagggagataagcctagagttctttcaataaaactcactttgacttaaaataatgatttattttgagaaagataaaaataaattaaataaaggaaatctatgttcaaaaaaagtaaattattcttctggacagttgaaatattagccgttactttactaatttttctattggctcagattcaatttgtattccagcccataaagacgttactgacgctcttatttgttccatttattattgcaggttttttatattatgtcttcaatccggttgttacttttatggaagaaaagctaaaaataaaaaaagtatttggcattttcattgttcttatactcattttaggaatgattatttttgcagttgcatcagtcattccaagtttaattacacagctgacaagtttgattaatgccactgggaaagcttatcctcagattcgaacatggatagaaggacttcaacataatccaagattctcgcatatttatgaacaacttgatattaagagccttgttgaaagactaaatctttcttatactgatattttgcataatcttttaaacagtattacgataagtgttggaagtattgtaagtattatcacgagcattatcatggtaatgattttagttccaattcttctttactacatgctcaaagatggtgaaaaaattattccattcttgaaagaaaatgtactgacagaagataaacttaatatctttgaacttttggaaaatatgaatcatacgatttctcgttatatttctggagttgcgcttgatgctttattggtcttcattgtcgttttcgtcggttatatggttttgggaattccgtatgctttcctttttgcactctttgcgggtgttactaaccttattccttatgcgggaccatatatcggggttttaccaatggttgtaacggttgcttttaatcgtccaattacagccctaattgcggtaatctatgttctcgtcttacaacaacttgatggcaatttggtttatcctaaaattgttggttctgccgttaaagtgcatccagttacagttatgattttgatgttaatttcaggaagcctatacggaattcttggaatgattattgctgttccggcctattgtttggtcaaagaaattgtaagatttgccaatagtctttataataaccataaagccgaacaaagaaaaattatttcaaaatgagaacaaaaatatgatataataattctatctaaaatgttaactcttattttcttaaattcgagctaactaagttttaagtgttaaaataaacactataatatctttttcaaggagcactaatgtcaaaccctgatcccgagagtgtatcgatactcttgcagattcttttactaatttttttaacagctttaaatgccttcttctcagccagtgagatggccatggtcagtctcagccggacaaaagtagagcaaaaggccagcgaaggtgataagaaatatatcaaccttgttaatattcttaatcaaccaagtaatttcctctcgacaattcagattgggattactctgattaacatcttagcgggggctagtttggccgaagctttgtcatctcgcctagcaccattattaggtggaacggcactggctaaaactttatctcaaattattgttttagctattttgacttatgtttcactcgtatttggtgaactttatcctaaacgaattgcccaaaacctcaaagaaaaaatggccctacgggtcgcaccaccaatccaatttttaggaaaagtgatgaaaccttttgtttggtttttagcaagttcaaccaacgttttgagtcgtttgacaccaatgaaatttgatgatttggatgaaagtatgactcgtgatgaaattgagtatttacttaataccaatgatgaagcacttgatgataatgaacgtgagatgattactggtgtatttagtttggatgaattggtggcgcgtgaaattatggttccaagaactgacgccttcatgatcgatattaatgacgactcacgtgaaaatattacagctattctgaacgaaacttattcacgagttccagtttatgatgatgacaaagataatattctagggattctacatgtcaaaaaacttttgagatatagttttgagcatggttttgatgatattgacctacgggaaattcttcaagaaccattgtttgtccctgaaacaatcttcgttgacgatttgatgcgtcaaatgcgcaaaacccaaaatcaaatggcagtattgctaaatgaatatggtggcgttgaaggtgtagtaacattggaagatttactagaagaaatcgtcggtgaaattgatgacgaaacagatattgccgaagaagaagttttcaaaattggcgaaaacctctatgtcgtgcaagggaaaatgactctaaacgacttcaatgaagaatttgatactcatcttgaaagtaatgacgtagataccattgcgggttacttcttggcaacgactgggaaaattccggccaaaggacaacaaattgtttgcaaagttgataatgaggaagatcatttttcactgacaagtttagaagtttctggaaaacgtgtggttaaacttcgtgttgaatttgacgttgaaccagaagaaacagaaatttaaaaaaatactgacagaatttctgtcagtatttttatttaatcaaaaagctttaattagttaaacccttacatttattgactgaccgagcttaatttactaagagaaagttactgacagaaccgttagtaggatattttactgacagaatttaatttgataaaatcagcgaattgcggtatgatagtggtgtgaaatagtgtttgaaattggagaaaatgatgtcagaaaatatagatgaactaaaaaaagtgaccggactgattcattcaactgaatcatttggttctgttgatgggcctggtgtacgatttattatctttatgcaaggttgtcggatgcgttgtaagtattgtcataaccctgatacttgggctttgaaatcggataaagccacaaaacggactgtagaagatgtcatggatgaggcgcttcgctttaggggattctggggagaaaaagggggaattactgtttctggtggtgaagcacttcttcaaattgacttcgttttggctctttttaaatatgcaaaatctcttggtattcatacaacgcttgatacagcagctcaaccttatttgactgacaaatatgtgactggaaaaattgatgaattattagattatactgatttggtcttgttggacatcaaagaaattaatccagaacgtcataaagaactgacagctaacaaaaatgacaatattttggcttttgcccaatatttatcagaccgtggcaatgccatgtggtttcgtcatgttcttgtccctggtgaaagtgattttgacgaagatttggtacaattgggtgaatttgttaagactttgaaaaatgttttgaaatttgaaattttaccctaccatacaatgggtgaatttaaatggcgtgaattaggttggaaatatccacttgaagaggttaaaccgccaacgaaagaccgtgttcataatgctaaagaaatcatgaatacagagtcttatcaagactatttagaacgaataaaataaaaaataaaatggatttgaaaatatttcaaatccattttttgttataaccgaacaaataagcagaaagagacttaaatgaaaatgaaagtgtgcttaatcagtcaatttttgatataatttaagagatgataagctcactctattttatagaaaaatgaaagaagagtgagagataaaaatttttaaattgaggtaaaaaaatgtctgataaaatacttgtttttggtcaccaaaaacctgatactgacgctattggttcatcatacggtttctcatacttgagcaatcaccgtccaaatggtgcccttaatactgaggttgttgctcttgggactcccaatgaagaaacacaatttgtcttggattactttggagtacaagctccacgcgttgtaaaatcagccaaagaagaaggtgtggatacagtaattttaactgaccacaatgaattccaacaatcaatttctgatattgaagacctaacaatttatggtgtggttgaccatcatcgtgtagctaactttaatacagcagcacctttatttatgactgttgaacctgttggttctgcatcatcaattgtttaccgtaaattccttgaagctaatgttgaagttcctaaagaggttgcaggacttttactttcaggtttgatttctgacactttgctcttgaaatcaccaacgactcacgtaacagaccataaggtagctaaagagcttgctgaaattgctggtgtaaatcttgaagaatacggtcttgcaatgcttaaagctggaacaaatttgtcaactaaatcagcagaagaattgattgatattgatgctaaaacttttgaattgaatggttcaagcgtacgtattgcacaagttaatacagttgatattccagaagttttggaacgtctttcagatattaaagtagcaattaaagcttcaatgaacgcaaatggatatgatgattttgtctttatgattacggatattgttaactcaaactctgaaatcattgcattgggcgcacacccagaaaaatcagaagcggccttcaattttacacttaatgatgaccatgctttccttgcgggagctgtttcacgtaaaaagcaagttgttccacaattgactgaaagctttaataaataatgactattaaaatctataatgaaaatcggctgacaggtcagcccttttttaaagatttgatagaatatttagcagaacatgatgaagtcatgctaagacagattcataaagattttgctgacgtaaaaaatatggaccggcagattgattcattcattgctgctggcctaatcttacgttcggataagcgttattcacttggttttcatatttttaaagacagcgattttgactggaaaagaatagaggataaaaaggctgaaccgcagagaaatatctatgaacagccgatttttattgaagaaaattcacggattgagaagttattgcaagaaagcaattgctatcccagattaactaatcaaacgaatcaagttatattgaattttgtgacatctttttcttacaaggaatatccagaaaatacaaaagttacaccaacactcgccaattattttaataaagtagcgagtaatctccctttaacagcatttgaaaaagaaatttatcaaatgattggagatgtggaccctgagtatgcattaaaatatatgacgacttttctcttaaaattcatgcgtaaagacatcgtcaaaaataaaagtgatatttttgtcaatgtacttgaaaaatataattatattgaaaagatttctgaaaaagaatataaatgtcttttggagttttcagaacaagtgattccagagcaaaaatatgatgatgctaaatcttttattattgctcaaatccaacaaaccacagctattgagccttttatctcattgggagacaaataggcgattataataaattaaaggagaaccaatgaagtacgaaaaactgttaccacgttttcttgaatatgttaaagtaaacacacgttcagatgaaaacagcacaacaacaccttcaacacaagcgcttgtagaatttgcccacaaaatgggtgaagatatgaaagctcttgggctcaaagatgttcattatcttgaatcaaatggttatgttatcgggacaattcctgcaaacacagataaaaaagtgcgtaaaattggacttttagctcacttggataccgctgattttaatgcagaaggagttaacccacaaattttggaaaattatgatggggagtctgtgattcaacttggggatactgagtttacacttgatccaaaagattttccaaatcttaaaaactacaaagggcaaacattggttcatactgatggaacaactttgcttggctcagatgacaaatctggtgtcgctgaaatcatgactttggctgattatctcttgaacattaatcctgattttgaacatggcgaaattcgagttggatttggacctgatgaagaaattggtgtaggtgctgataagtttgacgttgctgactttgatgttgactttgcttacactgtagatggtggaccacttggagaacttcaatatgaaactttctcagcagctggtgcagtgattgaattccaaggtaaaaacgttcaccctggtacagcaaaaaatatgatggttaacgctttgcaattggcaattgactatcataatgcacttccagaatttgaccgtcctgaaaaaacagaaggtcgtgaaggattcttccatcttttgaaacttgatggtacaccagaagaagcaagagctcaatatattattcgtgaccatgaagaaggtaaattcaacgaacgtaaagctttgatgcaagagattgcagataaaatgaatgctgaacttggtcaaaaccgtgtaaaaccagttattaaagatcaatactacaatatggctcaaatcattgaaaaagatatgtcaattattgatattgccaaaaaagcaatggaaaatcttgatattgccccaattattgaaccaatccgtggtgggactgatggatctaaaatttcgtttatgggacttccaacaccaaacctttttgctggtggagaaaacatgcacggacgttttgaatttgtttctgtacaaacaatggaaaaagcagtagatactttgcttgaaattatccgtttgaacaatgaagtagcaaaataaaagaaaaaaatagagttattatttttaaggactcgataataaaagaacaagtcgcccaagaaggtttttattaaaaaatctacttgagcggcttgctttgcgcttagcatgtaattttcagactaatcgctacttttcgataactttctgctactgtctacaatattattctgtttctaaagattttactgacagatttataagtaaaatttagttaatcattcaacactttaaaaataaattggttgataaaattattaatcaatgtaaaaaggaaagattatgtcacaaaacacaaaaggtaaactctcactcgtaggtctctcgttgatgatctttacgactgtctttggctttgggaatatcccagttgccttctatcaaatgggctacggtgctattccttggtatattatcggagctctcctctttttcctcccctttgcctttatggtaacggaaatgggatcagcatttaaagatgaaaaaggaggaatctactcatggatgagtgaggcagttaatcctactttcgcctttattggaacattcatgtggtatgcatcttatgtcatttggatggtaagtgtcgcaaataaaattttgattccaatggtgaatttaatttttggtaattcaacacatacaccatcattactttaaatttcaattgcagccgttgtttggatggccgtcattacatttatggtatctaaaggggtcgaaacaattaaaaagttcacctctattgctgggattgccgttctttcgctcaatgttattttaattcttggcgcagttcttgtactagttgttaatggacatcctgcaacaccaattaaccttgctgcttttacgtcatctcctaatccaacttttgatggtagtatcgttgcttttatcgcctttcttgtctttgctgtatttgcctatggtggggtagaatcaatcgccggtttagtcgatcaaacacatgaaccagcgaaaaacttccctcgtggaattattacatcagcacttattattgcggtgggttactcagtagctattcttagcgttggattctttgttgattattcacaatggattccagcaataaaagatgggtcaatgaaccttggaactgttccttatatgcttttgcaaaatcttggtgaagcagttggtcatgcacttggactttctacttctggagcggatatgcttggtggaatttttgcccgttatattggtctttcaatgcttcttgcctatatgggtgcttactttaccttaacttacagcccaatcaaacagttgattactggtacaccagaaaaactttggcctggtaaattaggtaaacttgatgaagaaggtatgccaaaatttgcaatgtggattcaatttgcaattgttacttttattattgttttgaatttcttgacttcacaaggtggtgcaagtcaattcttcctcattttgacttatatggctaatgtttctatgaccttgccttatctcttcatcgttattgctttctggtacttcaagaaaaataaaaatattgctaaaccaattgagttctttaaatcaaacttcgttgttaatttcttgacaattttggtcttagtagtcgttggtggcgcgaacttcttcacaattattcaaccgattgtgaactatgttcaattaccagctgttgaccaaactgcaaaagcattatcagaaatgttgacctcatttatctcaatgattggtggaccacttatctttggtattattgcttacttcatgatgagaaactacaaaaagaaaaataattgaagtcaatgattttatatttcaaaaaagagtaagtcctttttaagctatactttatggtatggctttttattattcaatttcattagtccaacatattttacattattaatagtggttaaaaaaacaaaaaagcgatataatcaaaatgcaaacgattacgttaatttatcttggagttatttcatgaatatatataaaattgatcttttttctcaattttacactaaaatagattttttggaaaactttgcaacagaaccagttttggcaacaggcgatgaaaaattgtctcaggcactcgaaatgcttgaagcgctgaatttacctgacaagacagcgatttgccagattcactatgattttgccatggtacctgcgatgggatactatactgggctgatgtttcaggtttacgtagaaggcgtggcgcaagcggttatatctggtggacgctatgacaagttgctgaaacagttcggtaaaaccacgggctcaattggcttttgcgtgcatatggacaatgttatgaaaggattgaataatgattagaatagcaatgagcaatggctggaagcgaccaagggggagctttcaggttgcagatgaaggcttgcgtaagcatggttgtcaaaggcgaccaagagggagctttcaggttgcagatgaaggcttgcgtaagcatggttgtcaaaggcgaccaagagggagcttccaggttgcggatagaagcttgcgtaagcaagctatctgctcgccctttggcagataggagacagatatgattagaatagcaatgaccaaagggcgcattcaaaagcaggtcacgattttgctaggacaggcaggatttgatatgacggcggtgcgcgaaatggggcgtgagttggtggtaaccataccagatgatttggaaattatttttggaaaagccgatgatgtcataacttttttggagcatgggattgttgatatttgatttgtcggtaaagatacgcttgatgaaaatgattttgatgattattatgagttattagatttaaaagttggtcagtgcatctttgcccttgcttcctatccagattttttaaataaaaaatttcacaggcgtaagcgaattgcttctaaatacccaagaatcactaaaaattattttgctcaaaagcaagaggatattgagattatcaaattagaagggtctgttgagcttggtccagtcgttggtttagcagatgctattgttgatattgtcgaaactggaaatacactgtcagcaaatggcttagtcgtgattgaaaaaatcagtcaaatttcaacccgaatgattgttaataaagcaagtttcaaattcaaaaaagataaaatcatagaaatagtggagagattagaaaatgctcaaacaaattgattatcaaggaagtcttgaagaagttgcaaataaatttcaaggacgaaaagccgaagtttcagaagaagtaaataaaagtattcatgaaattgtcaaagctattcgtaaagagggtgattctgctatatttagctatgcaaaaaagtttgatggatataatgctgacaaaaataatttacttgtcacgcgcaaggaacgagaagagggcttagaaaaaattgatgaaaattactttagaattctgcgtcgtaccaaatcacaaattgaagaattccacaagcatcaattaggaaattcatggagcatttataaagaaaatggggttatcatgggtcaaattgcacgtcctttagaacgtgtcgccctttacgttccaggtggcacagcagcctatccttcaacagttattatgaacgcagtgcccgcacttttagcaggggttaaagaaattattatgattacaccagttaaggctgacggacaagtgaatacaaatattttagccgccgccgaagtttgtgggattgaaacaatctataaagtcggtggcgctcaagctgtggccgccgttgcttacgggacagagtctattcctaaagttgataagattgtcggacccggaaatatttttgtagccacggccaagaaaatttgttacggtatggttgatattgatatgattgcaggaccgtcagaagttttggtcattgctgacgaaaaagcaaatccaaaatatatcgctgctgatttaatggcgcaagccgaacatgataaacttgcgtcagcaattttagtgacaacttctgaaagtcttgttcaaaaagtagatgaagaattagaaaaacaagttcaaagtttagaacgtcgtgaaattattgaaagttctgtcagtaattatggtggtgccattgttgtcaaatctattgacgaagctttcgaggtttctaatcaattggctccagagcatttagaagttttgactactgaccctttagcccaacttccaaaaatcaaaaatgctggttcaatctttcttggagaatatacgccagaaccattgggcgactatatgtcaggaagtaatcatgtcttacctactggcggaacggccaagttttactctggcttaggcgtctacaattttgttaaatattcaacttatagttattatcctaaagaaattttggcggatttcaaagaagatgttgtaacttttgctaaatcagaaggaatgagtgctcatgccaattcaatttctgtgagatttgatgatgaaaaaaaggagaaataaatgcgtacagcaacgataactcgtgagacaaaagaaacccaaatctatctaacgcttgatttagatggctcaggaagaagcgaaatcgataccaatattggttttttagaccacatgttgatactccttgcttttcatagcgattttgatattaaactcactgctcatggcgaccatgaaaatttaggcatggaccctcatcatctcattgaagatgtggcaatttctcttggaaaatgtatcaatgaagctttaggagataaacttggaattcgtcgctatggcagttttacgattccaatggatgaagcactggttacctgtgatttagacattagtggacgcccttatttggtatttaatgccgatttatcaggaaatcaaaaacttggtggctatgataccgaaatgactgaagaatttttccgagcccttgcttttaatgctgggattactttacatattaatgaacattatgggaaaaacacgcatcatatcattgaaggaatctttaaatctatggcacgtgcccttaaacaagcgataagtattgatgagactaaagttggaaaaataccaagcagtaaaggagttttgcgagcgaattaaaagagttatacattaacatcgaggaattccctgaaaaacttcagaatacgctaaaagatgcaaaagtttatgatagcagttcgtctcctgaagcccaagtgttgttcattgataagaaagacggttattatttaaagatagcttcaaaaaaatcattagagcgagaagctgaaatgacagactattttaaaaagaaaaatttaggcttaggatatatttcttatttatcagaccagtcacaagattttctgctcaaagaaaaaatacaaggagacaattatctagcaaagcagtatctcaaaaatccaaaacaactatgtgatagccttgctgaaaatctacgattccttcatgaacagaattttgaagattgtccgattttagaccattctgaacgttatctgaaaaaagttgaaaataatgcaagactaaagaaatcaaatctagattttgtaactaactataatattcatacacccgaagaagcttatgattatatacaaaacaataaactattattaaaggatgatacgcttttacatggagattactgtctacctaatatcattttagataattggcaatttaaaggctttatcgatttggattgtgcaggtgttggtgaccgacatattgacctcttttggggagcatggacgctcaatttcaacattgggactgaccaatatcgtgatcgcttctttgatgcctatggtcgggataagattgatattgaccgattgaaattaattggctgttgtgaggtttttggatatttttaaatataaataggaatttatttccatttactattgaaaggagaagtatggcaaatattgttatcatcgactacaaccttggaaatcttcaaagtatccaagcagcctttttacgattgggacaagaaacagtaatttcgagagatttagaagaaattcgcagggcagatgcacttattcttccaggagtgggggcttttcctaccgcaatgaataacctgaaaaagtttaatttaattgatgttttaaaggagcgagctgatgccggaatacctatattagggatttgtctaggaatgcaagtgctgtttgaaaaaggaattgaaatagaagaatgccaagggttagggcttttaaaaggagaagccattccaataaaatcaagtgagaaaattccacacatgggttggaatcaattaaaactagtcaaaactaagccaataactgcttatttggctgatagtgatgaagtttattttgttcgctcctatcaagcgacttgtcctgatgatgaactcattgcctatacaacatacggagaagcgatgattcctgccattgtggggaaaaataacattatcggttgccaatttcaccctgaaaagagtggaaaaattggcggaaaaatactaagagcatttttggaggaaatttaatggaaattatcccagcgattgatttacaaaatggagaagctgtacgtctctacaagggggattatgataagaaaacggtctattctaaaaatccactagaaattgctcaaaaatttgaacaaatgggagcaaaatatttacatttagtcgacttagatggtgctaagctagggcaaaccagaaatttagagattgtgcgaaaaataaaagaccaaactaatttaaaaatagaaattggtggtggaattagaaatttagatacagttagcctttatcttgaacagattggcgtagaacgtgtgattttagggactgcagcagcagaaaaacctgattttcttaaagaactgttggttaaatatggtttgagcagaattgttgttggagtggatattagggagggttttgtctcaacgagtggttggttagaaaaaacaactcttccttatctatcatttttaaaagatttagagaaaataggtgttaaaaccgtcattgtcactgatatttccaaggacggtacgttaactggaccgaattttgaactttatgatgagatttcaaaagaaacttctttagatgtcattgtttctggtggggtaaaggatagttcggatattcaacgagcagcagattctgatttctatggaatcattgttggaaaagcttactatgaaggaaaaattaatcttgaaaaggagttcaatcatgctaacaaaaagaattatcccttgtcttgatattaaaaatggtaaggtcgttaagggaatcaattttgttggtctaaaagaaattggtgacccagtggagatagcaaaaatatatgaagaacaatgtgcagatgaaattgtttttcttgatataacggcttcttttgaagaacgtgaaattattggtgagttaatcggacgtgcagcacgtgagctttcaattccattaaccgttggtggaggaattcgttctattaacgattttagaagaattcttgctagtggagctgacaaagtgtccataaattcggcggcaatagaaaatcctgaacttatccatcaagcggctaatgaatttggcgttcaatgcgttgtggttgcgattgatgccaaggcgaatgaatcggggtctagctttgaagtttatatcaaaggtgggcgagaaaatacaggaattgatttagttgaatgggccaaaaaatgtgaaaaattaggtgcaggagagattttattgacctcaatggataaagatggtacaaaaacaggctatgatttaaaaatgttaaatgccgtttgctctgcagttaatattcccgttattgcaagtggtggttgtggttctatttcggatattattgaagtttttgaaaagacaaaaagtgatgcgtcccttgttgcttctttatttcattatggagaagcaacagtggataaagttaaagaagaactcataaaaaatcgtattccagcaagaataattaagaaggagattatatgaaaccagactttcaaaagcaggcgcttattcctgtcattgtacaagattatcaaacgaagcaagttttgatgatggcttatacaaacgaggaggcctatcagaaaatgcttgaaagtggcgaaacttggttttggtcacgttcaagacaaaaactttggcataaaggggaagaatcgggtcattttcaaaaagtaaaagggatgcgcttagattgtgaccaggatactttccttgtttttgttgagcagacaggtaatgcttgtcatacaggtgcctattcttgtttttatgacgaagtcattccttttgatgactcggatatttttgctgatttagaaaaacaaatcgctgacagaaaagcacatccagtagagaaatcatatacaaattatttgcttgaccaaggcattgacaaggttttaaagaaagttggtgaagaggccagtgaggtaattatcgctagtaaaaattcggataagactgaactcttgggtgaaattgatgatttgctttatcatttatttgtgctgataaatcaaactgatatttctcttgaagaagtgcggcaaaaagcgcgagagcgtcatcagattgaaggaaacaaaaagaaatttcacacaaggacggcagattaaatgaaaaaattagattatcatttgcattcttatttttcggctgacagcgaggaaaatcccagaaatcatgtcttagaagcgattgagcatggtttggaggaaatctgttttacagaacatcgtgatttttattttcctgagattgatttttcgttgaatgtagccaagtattttcgagaaatcaatagattacaagtagagtttaaagataaaattacaataaaaattggtctggaaatggggatagatttacggtttaaatcagaaattagtgaatttatcaattcagctccgtttgattttgtgattgcttctgtccatgaaattgatgatatagaagtctatgatggaacggatttttatctaaataaatctaaagaagaagctcaaaaagaatatcttttagcttgtttaggtattgttcaaaattttgagttatataattcttttggacacttggattatgttgccagatatggcgcatacgctgataaatcaataaattttgtggattttgaagtgatattgctagaaattttaagaaacttggcttcaaaaggtaaagccttagaagtgaatacgagattgtttagtgaatcgaaaactcagcaattttacagtgatttattgattaattttaaaaaattaggtggagaatttgttactttaggaacggatagtcatgtcgcaaagcatgattgggcggcaattgataatgcaagagaaataattaaaaaagctggttttaaagaattagcgactttcagcaagatgaaagtaaaataaaaaaagtctatttgcaaatagacttttttattttatgatgccaaatctttctcaagtagagcaaggcgttcttgaacttcttgatttgaaagctgatgagctttgatatagcggttatctggatgaactcgacattcatgtgaacaagcaccaagatatttagcttcattttctttggaagctaacatttgtctgttgcattctggatttccacaattaatataacgttcgcaaggacttccatcaaaccaatcacgtccaacgatgacgtgttctttttgattaatcggaactgcaattcgactatcaaagacatacatttgtccatcccaaaggtccccttggacttctgggtctttaccgtaagtagcaattccgccatgaagttgaccaacatctttaaatccttcacgaacaagccaacctgagaacttttcacagcgaattccacctgtacaataagttaaaacacgtttttccatgaattgttctttgttatctcgaatccactgtggaagttcgcggaaacttctaatttcagggcgaattgctcctcggaaatgaccaaggtcaaactcataatcatttcgtgcgtcaatgacaactgtattttcatcaagcatagcttcacgaaactctttgggatcaaggtaagcacctgtgagttccaagggattaacatcgtcttctaaactcaagttaaccaattctgggcgataacgaacatgcattttcttaaaggcattttgtttggcttcatcaattttaaaaattgttgacgtgaagcgagaatcatttttcatgagtgacatgtaagcattcgtttgttcaacagttcctgaaacagttccgttaattccttcgtcagcaactaagatacgtccttttaaacctagggccttacagtctgataggtgcttttgagcgaaagattctccatcttcgattgggacatattgataatataataaaactcgataatcttgagtcattttttctccttattctattggtacatcatgatccattataatttaatcattttagtcctatcaaaagcaacaaaattgcttgtctatttattaacaagcaactgatctatggtctttataaaagatatttaaaagaaattttaatctttttgttgttaaattcttgttaatacaaaaaaatgcattaaatattattattttattgacaatttaaaatattacgagtattataatgtaaattaacaaaaaagaggaacttgaaatgacatacacacaattttcattgttgttgatcaaggtggacctacattagcttttcggctaaaatatgtaggtcctatttgacaacagtcatttcgaggaccatgagacgtcctcaggggcgtcttttttgtttcttaataaaaaatagaggtaatattatgcgaaaaattgaattctttgacactagcctaagagatggcgaacaaacacctggcgtgattttttccatagccgagaaggtaactattgcaaaacaacttgaaaaatgggggatatctgtgattgaagctggctttcctgcagcgagtccggatagttttgaagctgtaaaacaaatttctaaagctttaaaggagacggcggtaacagcattagctcgttgcgttataactgacattgataaagcagtagaggcagtaagagaagctcaacatccacaaattcatgtttttattgccacttcacccattcacatgaaatataagctcaaaataagtcctgatgaagttctaaaaacgattgataaatgcgtaagacatgctcatgagcaggttgaagttgttgaattttcgccggaagatgcgacacgtactgaaccggaatttctcttgaaagccgttcaaaccgcagtagatgctggagcaacttacatcaatattcctgatactgttggttatacaactctggaagaatatggaaaaatatttaaaatgttgattgataatattaaagctgaccgtgaaattatttttagtccgcattgtcatgatgatttagggatggctgtagcaaattcattagcagcaattaaagctggagcaggtagagtagaaggtacggtcaatggaattggcgaacgggctggaaatgctgcgattgaagaaattgcagttgctttgcatattcgtaaggattattatcaggcgaaaagtcccttagttcttgcggaaacaatggcaacagcagaattaatttcgcaattttcaggaattgctattcctaaaaacaaggcggttgttggggcaaatgcattcgctcatgaatctggaattcatcaggatggtgttcttaaaaatgccgaaacttatgaaatcattagtccagaacttgttggaataaaacacaattcactaccactcgggaaactgtcaggtcggcatgcatttactgaaaaactgaccgaacttaatatttcatatgacgcaaaggaacttccaaacctgtttgaacgttttaaacgtctggctgacaagaaaaaggaaattactgacgctgatattcatgctttattcacgggcgaaacggtgaaaaatctggctggtttcattcttaataatgttcagattgatgggcataaagcactagtcgaactcaaaaaccaagatgctgaaatttatgtcagccagggagagggttctggttcagttgatgcgattttccaagccattgataaagtctttaatcatcaactaaaattaatttcttattctgttgatgctgtgactaatggaattgatgcacaagcaacaaccgttgtttctgtcgaaaatctcgctaccggtacaatttttaatgctaaaggggtcgattatgatgtcttaaaaggtagtgcgattgcttatatgaatgcgaatgtactggtacagaaagaaaactcacaaggaaaggttgaacaaatttcagctcatgatgggatttaaaagactatttttataaatatggcagataaaaaaatatgaagaggaaaattatttatcttctgattgtactgataataatttttttgggactaggaatttggaagtcttggaataaacctcaaactaatctgaactattctatttcaaaaattaaggcggcatacaaggaaacttggaaatacaatcattggcaggtaaactttcccaaagtatcaaaattagtaagttatcatacgaatgaaggctggtctggggatggcgaaaatcttgccattttccgattgactaatttttcaagtctggttggtttttcgtcaaacattttaacagaagataaacagacttttcttgacgccctcactgatctaaagctagctaaattagattatccaaactttagtcattccttactttacaaaatttataaacaaaatgagtataaaggagcttatttcgattatttttatatgattgcatacaagcaaagcgaatgtttatacgtcctacctattcatatttgataaaaaagagaaaagaggtaactgtcatgtggacagcttataaaaagttttggaaagatgcgttacatttagagaaaacagcaacgcgcgccgaattttggtggggcgtgcttggtctgttgctcacggaagcgatactgtgggggatatatctaggctacttcgcgcttgtcggacatggaaatatcaacgagggtattaatggtggaagtccgctcagtatttttccgatgatttggctcattatcatgggtatagccaattttgtaatactcatagctttcctatttctcatatttcggcggatgaatgacgcacgcctcagcaaagtctggcttttgtttctcatcgtaccagtatttatcttgtggttggcaatgctatttcagcaaatctggttggccacaccgcttatgcttgtgacgggattaggagttttagtcctcattgctctttgtcaaacgccgtcaaagccacaagacttggacgaagttattccgcttgtagcaggtgactccgtcatcacaataacacggcgctgggcttattcgggaagtgttcgtaaatttaaaatttttattgatggtaattttgtgggtggaatcaaggtcaatcaagccaaaacatttaagcttgctgcgggtaatcataatatcaaagccaagttagattattgtggaagcaataggctgacggtcgaggcaggcgagaagcctgtggcggttgaattacgtggtcgaaacttgtttcaatcttttattcacagcttatggcgggtcaatgaatatctgattttgcaagaaaaaaatgaaaaataaacaggtcagctttggacttggtttgatgttggactgtctctccttgtccaacgctattacgtctggcatttagcgggcaaggaatttccacaggaaattgagaaaaatcgaaaatttaataaaaaatagaaagaagaaaaatgactaaaaaaattgtaaccttatcaggcgatggtatcggccctgagattataaatgcgggactgcaagtcctgtctgcagtagctgagaaaatcggctttgactatgaattggacgcgaaagattttggaggcgcagcgattgacaaatttggtgtgccattacctgatgaaacgcttgaagcggcgcgcaatgcggatgcgattttacatgccgcgattggcgacccgaaatttgacggcgcggaaattcgccctgagcagggattactcaaaattcgtaaggagttaggcttgtttgccaatgtccgtcctttgaaaatttatgaaccattgaaacatttgtcgcccattaaaaatgtcgaaaatgtggattttgtgaccattcgtgagctgacaggcggggtgtatttcggcgagcatacgcttgaagctgacaaagcgcgggacatcaacgattacacacgtatcgagattgagcgtgtggttcgatttgcttttgaaacggcgcaaaaacgcccacgtaagcaggttacgagcgtggataaacaaaatgtccttgccacctcaaaactttggcgcaagacggtggacgaggtcgcgaaagactatcctgacgtgacttacgagcatcagttggttgactcttgcgccatgctcctgattaccaatccgcagaaatttgacgtgattgtaacggaaaatctctttggcgacattttgacggacgaggcgtcaagtttggcggggactctagggtgtagcgcgtcaagttcgcatggtgcggggacggcattttacgagcctatccacggctctgcgcctgacatcgcaggcaaaggcattgccaaccctgtcagcatgattttgtcggtcgccatgatgttgcgcgagagttttgagttggaaaatggtgcggtgctgattgagcgtgcggtcgaaaaaacgcttgctgacggtattttcacgcaagatttgggtggaagtgcgacgacggatgagatgacaaaggcgattttggagcggttgtaaaatgacagaagattggaatattgaagcaggcaatgacttagctgcgctgcgtgcgtcagggattgtacggcgaggcaataaaattttacttgaccatgtccttgacacgggcgaatattggttgcccggtggacacgtcaaaattggcgagacgacggaaaatgccttgaaacgagagttccaggaggagctgacggttgctatttcggacgttcatttgacgagcatcatcgaaaattttaggcattggcatggctatcggacgcatgtggttgagtttatttatgtggttgaggatagtctggacatttcggacacacccgttttgacggcggataatgacaatgtggaaaagcgctgggttgaggtttctgagctgtcaaatttgacagagcttttgacagatttgtcaaaaaatttacgacactttgtgagcagggatagatagaaaaagaattaggccaaatttgaccttgtaagaggatttgggatgatagatataaaaacaaaaaatttgatttttctaggcttgcttgcttattggctatttccagtcgctcttgcgctatttgtcgccatttctcaaatggactatacgccaggatttaattttggggattattttattggttcatttttgatgggactcattttcctccctctgccaatccttagctatatcattttattgtggctttgcacagcgatttgtatcatgacggtgtcaaatttaggaacaacaaaagcaaaaatctgggggcgagtacttttggttattgggattttgacggcggtcattagcctgtcgggagcaataatttttagcttagcattatcgcttgacggcattgcatttctaatcttacttctgccaattttctgctttagtcttgcttaccgcagaattacaaagattgatagtagtaaagttaagagaaagtgaaaaataaatcgcgtcaaatttgacataaataaaaaaataagaaagaagaacaaaaaatgacagcaaaaacaatttttgacaaactctgggaccgccatgtggtcgcaggaaatgagggggagccacagcttctctatattgacctccatgttatacatgaagtaacgagtccacaggcatttcaaggtctgcgtgatgcagggcggagcgttcgacgcagggatttaacttatggaacacttgatcataatgttccaacaaaagatatttttaatattcaagatttgatttctaaaaagcaaattgatacctttactaaaaatgtcaaggaatttggtataccggcagaagcgcatggcggcaaaggacaaggaattgttcacatggtcgcccctgaatctgggcgtacgcaacccggtaaaacaattgtctgtggtgatagtcatactgcgacaaatggggcttttggcgctattgcgttcggaattggaactagtgaagtagagcatgtccttgcgactcaaaccatctggcaagtcaaacctaaacgtatgaaaatcgaatttcaaggtcatccccaaaaaggagtttatagtaaagattttattctcgctctcattgccaaatatggggttgatgcaggtgtaggttatgcggttgagtatactgggaatgccattagtgatttaagcatggaagaacggatgacaatttgtaacatgtccattgaatttggggcaaaaatgggcctgatgaatcctgacgaaaaaacttatgattatgtcaaaggacgcgaatatgctcctgaaaactttgacgaagctgtcagtaaatgggaaaaacttgtcagtgattctgacgcggtttatgacaaggtcttaacccttgatgttagtcaattaaaacccatggtgacttggggaaccaatccgggcatgggcttagaatttggtgaagaatttcctaaaattaatgatgacttaaactacgaacgtgcttatcagtacatggatttgaaaccgggacaaaccgcttctgatattgacttgggttatattttcatcggttcttgtaccaatgcacggcttggcgatttagaagaagcagcaaaaattatcaaaggcaatcatattgctgacggactgacaggaattgttgtacccggcagtcgccctgtcaaaatcgctgacgaagaactgggtcttgataaaatcttcaagaacgcaggttttgaatggcgtgaacccagatgttcggcttgtctgggcatgaatcctgaccaaatcccagcttatgtccattgcgcatctacaagtaatcgaaactttgagggacgtcaaggacataatgccagaacgcatttatgctctcctgcaatggcggctgcggctgcaatcgccggtatatttgttgatgttagagaaattgtctaatgaatacgaaccaatttaatcaagcgatgaacacagacattcaagctttcattcaaaactttgcaccagcgatattggggattctcatcatcttctgggtcattagtcgtcagcttcgcgcacgcgtcgtgactgcgcgcatgacaatctatctcatactcatggcatttggggctatcgagattttccagtatgttgaaaagtcaggattgacgattggttttctgggcaatcttctgatttacagtctggttttgccacctatctttggctggttgagggtcttgacctatacttacttggtcaatgatgaccagcaggtcatgcgcaaaggaaatcttttgactgctcttttttggattatttatatggctttgcacttgggactagatcatttcacaaaagcgccaggcaatctctttttgctctttgacattggcttttctttattggtgcaacgctatctcgcctataacaaggcgcgtaagcattttccaaaagaaattgaaaataatctaaaaacaaaagcatgaatttacaattatttaaaaataaaaaataatagaaagataaaaatggaaaaattcacaatttacaaaggaacaagcgttccattgatgaacgacaatattgacactgaccaaattattcctaaacaatttttaaaagcgattgataaaaaaggttttgggaaaaacttattttatgaatggcgctatagcaaagattatgaggaaaatcccgattttgtgttaaataagccgcaatatcgcaaggccagcttgttaatttctggcgataattttggctcaggatcttccagagaacatgcggcttgggcattagcagattatggttttcgagccattattgcaggttcttactcagacattttttataataacagcttgaaaaatggacttttacccattgtccaacccaaagaggcgctaaaaagtctagcccaactttcaagccaagaagaaatcacaattgatttgcctcatcagttaattcaaacgagcacagaaaacttttatattgagattgaccccatttggaaagataaactgattaatggtttagatgatattgggattactttgcaatatgaacaagctattactgcctatgagcaaaaacatcaataaaagagagaaaaagatgacaattattagcttaaaaaatgtgaatcttactcgaaataaaacagaaattctcaaaaatatcacttggcaggttaatcaaggggaaaattgggtgattctgggtttaaacggttctggaaaatcaagtttgttgaaattaattttggccgaagaatggaaaagctcaggccaattaagagtattagggactgaatttggtaaaggagaaattccaaaacttagaaaacgaatcagtgtggttggctcatttatcgccgaacgattccattcaaatatcaaagccgaaaatctagtctatacaggtaaatttaattcaagtatgctctataaaccttatagagaccaagaactcgacgaagcccgtaatcttttgatgaaaattggagccgaagcacttattggtcgaacttacgggagcctctcacagggagaaaaacaagttttacttattgctagaagtctaattttaaagcctgaactattaatcttagatgaagcaaccaatggtttagatttatttgcaaaagaaaatttattaaagcaacttgaacaaattaataaattagaaaatgggccaacaatcatttatattactcatcatcctgatgaaatttctgatacttttacgcaccttttacttttaagagcaggagaagtcgttcaagcaggcaaaaaagatgacttattaaatgaaaaaatactgacagatttttatcaagaaaatattgaaattcaacgaattaagcataagtatttcattattccgatgaatttttaaaaagaaagcaaaagtattttatagactttattgaatattctgacaaattattgtattttcaattttttaatgataaaataactctataaaaatttacggggaggtcaaaaagataacatatggaattcaaatataacggaaaagttgaatcaatagagctcaataagtattcaaaaacattgacacaagacccaacacagccagcgaccaaagccatgcactatggcattggttttaaagatgaggacttcaaaaaagctcaggtcggaatcgtcagcatggattgggacggaaatccctgtaacatgcacttgggcacactcggtagtaaaatcaaaaattctgtcaatcaaactgacggactgattgggcttcaatttcacacgattggggtttctgacggaattgccaacggaaagcttggcatgagatattccttggtcagtcgtgaagttattgctgacagtattgaaaccaacgctggcgccgaatattacgatgcaattgtcgctgttcccggttgtgacaaaaatatgccaggctcaatcattggcatggctcggctcaatcgtccgtcaattatggtttatggtggaacgattgaacatggcgaatacaaaggcgaaaagttaaatattgtttcggcttttgaagcgcttggacaaaaaatcactggaaatatttccgaggaagattatcacggcgtcatttgtaatgccattccgggacagggtgcttgtgggggcatgtatacagcaaatacactggcttcggcaattgaaactttgggaatgagtttgccttattcggcttcaaatccagcggtcagtcaagaaaaagaagacgaatgtgatgaaattggtctggcaatcaaaaatttgctagaaaaagacatcaaaccaagcgatatcatgaccaaggaagcttttgaaaatgccataacgatcgtcatggttctcggtggttcaactaatgctgtgcttcatatcattgccatggctaatgccatcggtgtcgaaattacgcaagatgattttcaacgtatttccgatgtcacgcctgtgcttggcgacttcaagccaagtggcaagtacatgatggaagatttgcacaaaattggtggcgtgcctgctgttttgaaatatttgctcaaagagggcaagcttcatggcgactgtttgacagttactggtaaaactctagctgaaaatgttgaaacagcactggatttggactttgacagccaagacattattcgaccacttgaaaatcctatcaaagcaacaggtcatttgcaaattctctatggcaatcttgctgaaggtggttctgtggcaaaaatttctggaaaagaaggggaatttttcaaaggaacagctcgtgtctttgatggcgaacaacattttattgacggaattgagtcaggtcgtttgcacgcaggagatgtcgctgtcattcgtaatatcggtccagtcggaggcccaggaatgccagaaatgttaaaaccgacctcagccttgattggagcaggtcttggaaaatcttgtgctttgattactgacggacgtttctctggtggcacacatggctttgtggttggccacattgtccccgaagcggttgagggtggattgattggcttggtcgaagatgatgatattatcgagattgatgcggtcaataacagcattagtttgaaagctgctgacgatgagattgctagacgacgtgccaattatcaaaaacctgctcctaaagcaacgcgtggggttcttgctaaatttgctaaactcacgcgcccagccagtgaaggctgtgtgactgatttatagaaaggattgcatgaaaaaaataaagttagaaaaaccaacttctggctctcagctcgtccttgaaactctaaaaaatcttggagtagagattatatttggctaccccggtggagctatgctccctttatatgacgcgattcatagttttgaaggaattaaacacatcttagctcgtcatgagcaaggggcgactcatgaggctgaaggttacgccaaatcttctggtaaggttggtgttgtcgtggttacctctggaccgggcgcgacaaatgcagtaacgggaattgctgatgcttatcttgattccgttccattgctcatttttactggacaggtgggacgtcagtctatcggtaaggacgcttttcaagaagctgatactgtcggcattaccgcacccatcacaaaatataattatcaaatcagagatacggccgatatcccaagaatcgtgactgaagcttattatttggctcagacgggtcgtcccggaccggtagaaattgatttgcctaaggacgtttccacccttgaagtcactgaaatcaatgacccaactttgaatttgccccattacagtcctactgaaactgcaagcaatcatcagttagaaaaattactgacgaaactttctgtcagtaaacgtccagtcattattgcgggtggtggcattaattattcagattctgtcagtgaatttcgtgaatttgttgaaaaatatcgaattcctgtggtttcgactttactaggtttaggaactttaccgattgatcacgaattacaattgggtatggcaggaatgcatggttcttatgcagccaatatggctctggtcaaagctgattatattatcaactttggctcccgttttgatgatcgagttgtttccaatcccttaaaattcgctgagaatgcagtcgttgctcatattgatattgacgctgccgaacttggaaaaatcgtaaaaacagatattcccattcattcagatttgaaagatgcactgacgaaacttctggattttcctaaagttgatacagattttactgactgggttcaattggtcacagaaaataagaaaaaagtaccatttgcttacgaaacgccacaagatgaaattcgtccacaagaatctatcgaattaattggaaaatatactgacggaaattcaatcattgttactgacattggacagcaccagatgtgggcagcgcaatattatccttacaaaaacgctcgtcagctgattacgtctggtggaatgggaagcatgggctttggcatcccagcggcaattggtgccaagcttgccaatcctgataaaaatgtcatcgtttttgtcggagatggtggttttcaaatgaccaatcaagaactggctttacttaatggctatggcattgcaatcaaagtggtgttgattaataatcattcgctaggaatggttcgtcagtggcaagaatctttctatgaggagcgccgctcacaatccgtttttgatgccgaacccaaatttcaattattggctgaggcttacggaatcaaacacttgaagctagaaaatcccaagactttggctgaagatttgaaaatcattacaaaagatgaaccaatgcttatcgaaattgtcatttcaaaatctgaacatgttttgccaatgataccagcaggattacataatgacgagatgattggtctgacttttactgacgatagggaggtggacaatgcgtagaatgattattgcaaagcttcataatgtcacaggaattatgaatcgcttcacggccgttctcaaccgtaggcaggtaaatatcatctcaattaccgctggcgtgacggaaagtcaggatttaactcataccacttttgtcattgaagtagactatcttaatgaggtggaacaaattatcaaacagttaaatcgcttaatcgatgtgattgaggttgctgacattactgatttgcctcatgtagctcgtgaagtggttttaatcaaagtatcagctccaccaacgatacgtgcagaaatttttacaatgattgaaccttttagggtaaatgtcgttgatgtcaatcgtgagaatgtcaccattcaactcactggtgactcagcaaagattgaagcactcattgatgtggtcagtccttatggtattctcaacatggctcggacaggtagcgcaggttttgagcggggataaatttaaaaaaagttaacaaataaatagaaaatagaggaaacaaaaatggcagttacaatgtattatgaagaagatgtagaagtagccgcactcgcgggtaagaaaatcgcagtgattggatatggctcacaaggacacgctcatgcacaaaacttgcgtgattctggtcatgatgtgattattggcgttcgtcaggggaaatcttttgatagagcaaaagaagatggctttgaaacatttgaagtaggagaagcagtagctaaagctgatgtcattatggttctggcacctgatgaacttcaacaatctatttatgaagaggacataaaaccaaatttgaaatcaggttcagcacttggttttgcccatggtttcaatattcattttggctatattgaagttccagaagatgttgatgtcttcatggttgcgccaaaagcgccgggacatctcgttcggcggacttttaccgaaggtttcggaacgccagctttgttcgtttcgcatcaaaatgccactggtcatgcgcgtgaaatcgctatggactgggcgaaaggcattggttgtgcccgtgtgggaattatcgaaacaactttcaaagaagaaacagaagaagatttgtttggcgaacaagctgtgctttgtggtgctttgacagcacttgttgaagctggttttgaaacactgacagaagctggatatgctggtgaattggcttactttgaagtgctgcatgaaatgaaattgattgttgaccttatgtacgaaggtggtttcactaaaatgcgtcagtcaatctcaaatactgccgaatttggcgattatgtgactggaccacgcattattactgacgaagttaaaaagaatatgaaactcgtgttggctgacattcaatcaggaaaatttgcgcaagatttcgttgatgatttcaaagctggacgtccaaaattaactgcttatcgtgaagcagctaaaaatctggaaattgaaaaaatcggtgcagaactacgtaaagcaatgccatttacacaatctggtgattacgacgcctttaaaatttatcaataatttatctttttaacataataaagaaaacataaaactactttatggaggaataagataaatgataaatgccaaagaggtcgaagaagcctatgatttgttaaagccagttgtcaccaaaacccctttacaactagacccttatctttccaacaaatatcaagcaaatatttatttaaaagaagaaaacttacaaaaggttcgttcctttaagttgcgaggcgcctattattctatcagtaaattaagtgctgaccaacgctctaaaggtgtggtttgtgcctctgcgggtaatcatgcacaaggagtagcctttgcagccaatcaattgaatatttctgccacaattttcatgcctgtcaccacccctaatcaaaaagtttcacaagttaagttttttggtggtcatcatgtcatgattcggctgattggcgacacttttgatgagtcagcaaaagcagccaaagaattttcgaaagataacggaaaaccattcatagatccttttgatgatgaaaaggtaatcgctggacaagggacagtagctttggaaatatttgctcaaggtcaaaaacttggggttaactttgataaaatactcgtccagattggcggagggggcttaattgctggaatcactgcctacagtcacgaacactatcctgacactgaaatcgtgggagttgaagcaaaaggtgcaacaagtatgagagcagcttacttggcgggtcatccagtcactttagaacatattgataaatttgctgacggaattgctgtggcaactgttggccaaaaaacttatcaaatcattaatgacaaagtcaagcaattaattgctgttgacgaaggattgatttcacagaccattttggatttatattctaagttaggaattgtcgcagagcccgctggtgcaacctctgttgccgcacttgaactcgtcaaagatgagataaaaggcaaaaatatcgtctgtattattagtggtggaaataacgacatcagtcgaatgcaagaaattgaagaaaaagctttggtttatgagggcttaaaacattatttcgtcattaatttcccccaaagatcgggagctcttcggacttttgtcagtaatattttaggacccaatgatgacattacaagatttgaatatataaaaagggtggacaaaggtaaagggccttgtcttgttggtattttactcgaaaatcccaatgactacgacgctttgattaagcgaattgaacaatttgatagccgttatgtaaatttacatggaaatgaaagtttatatgaattattagtttaagatatagttcatactaaattgcttttattttcccattaatattttctagtctacgtttcttttaaatcactagaaatttgatataatttaattaataaattatttaaatttaatgagatagaaaagagaatatcatgtcagaaatcacacaactttttcaatataatacccttggggcattaatggccggactttatgaggggacaatgacgattggtgagctcttgaaacatggtgacttaggaattggaactttagattcaattgatggcgaattgattgttttagatggtaaagcttatcaagctaagggagataaaacgatcgtcgaattaactgacgatatcaaagttccttacgctgcagttgttcctcatcaggcagaagttgttttcaaacaaaaatttacagtaagcgataaagaattagaagaccgaattgaaagctattttgatggtcaaaacttattccgctcaatcaaaattactggtgaatttccaaaaatgcatgtacgaatgattccgcgtgctaaatcaggaacaaaatttgtagaagtttcacaaaaccaaccagaatataccgaagaaaatgtcaaaggaacaattgtcggaatttggactcctgaaatgttccatggtgtcagcgttgctggttatcatcttcattttattagtgaagatttcacttttggtggacatattcttgattttattattgataatgggactgttgaaattggagcaattgaccaattgaatcaatcattccctgttcaagatcgcaaatttttatttgccgaccttgacatcgaggctttgaaaaaagatattgacgtagctgaatgataattgcttaaatttctttagctacaaaggagaaatttaatgaacattattgcaacacgcaatgctcccgcagcgattggcccttacgttcaagggaaaatagtaaatggcttactttatgcctctggacaaattcctttgaatcctcttgatggagaaatcgtcggtgatacaatcgaacttcaaactgaacaagtgatgaaaaacattgccgcaattttgaaagaggctcattcaaattttgattccgttattaaaacaacttgttttttaaagaacatcgaagatttttccaagtttaacgcgatatattcaaaattctttaataaaaactttccagctcgctccgctgtaggagttgctggattgcccaaagaagttctcattgaaatcgaatttattgctgagattaagtcctaacgtaatagcatattaactataaaaattactgacaaaaaagctgtcagtaattttttttagttacaattatatatttttatcgtatagaaagatataagcaaatttaaaagtgactgactcatcctgtcagtaatattagaggtagatatgattacaaattttgatttatttcgttggaaaaaagcaggaatgaccaatcttggtgtaaataagctcttaaaatttttccgcaaatatgatataaaaataagcttacgacaaatgggacaagtggctcaagtcaaatcaatccctaactttatcgaacaatataaaaatcaggacgtaaagaaactcaggatagactataaaaaattttcctccttttccattcttgatgacctttatcccgagcgtctaagagaaatctacaacccacccgttttaattttttatcagggaaatattgatttattaaaaaatcctaaacttgcctttgttggaagccgcctagcaggtcaatcagggataaaagctgtccaaaaaattatcacagaattgaatcaatcctttacaatagtaagcgggcttgctaaagggattgacacagccagccatctgtcagcaattaaaactaaaacaccaacaattgctgttattggtacaggattggatattttctatccactagaaaatagtaaaatacaggaatatctagcaaaaaatcaattagttttaagtgaatattcattaggcgaaaaaccacttaaataccactttccagagcgcaatcgaattattgctggtctttcacggggagttgttgtcgtggaagcaaaattaagaagtggcagtttaatcacctgtgaaagggcactggaagaaggaagagatatctttgccatccctggaaatattgcagatggaacatctgatggctgtaatcatcttattcaacaaggagcaaaacttgtctatcaagctcaagatattttagaagaatatttgtacaattaaaaaatagctataagcccttaaatataaagctcttagcggtgttttattatctcaattaataacaagttttactataagaaaactaaatagcttgacatattgaagaaaagcatttattatgggagagtgaatttattgtaggaagtcagtaatttagaccaaacattagttcaatttccactttctaatcactaaatcctctatgaactgtataacattttatagatagtggatatttaaaaatagataaataggaatattaattatgccaacttcaactaaaactaaaactagtacaaagaaaaaaacaacacgaaagaaagtgactcctgggaaaaatctcgtaattgtcgaatcgcctgctaaagccaaaacaattgaaaaatatcttggacgaaactataaagttgttgcttctgtcggtcatattcgtgatttaaaaaaatcaacgatgtctgttgatatcgagaatgattatgaaccacaatatatcaatattcgaggtaaggcacctctaatcaactcactcaaaaaagaagccaaagctgccaaagctgtctatctcgcgagtgacccggaccgtgaaggagaagcaatttcatggcacttagctcacatcttgaatcttccactcgaagaaaaaaaccgtgtggtcttcaacgaaattactaaagacgccgtaaaaaacgcctttaaggaaccacgtcaaattgatgtagatttggttgatgcccaacaagcacgtcgcgttcttgaccgcctagttggatattcaatcagtccaattctttggaaaaaggtcaaaaaaggactttctgcaggtcgagttcaatcgattgctttaaaattaatcgttgaccgcgaaaatgaaattaatgcctttatcccagaagaatactggtcaattgatggggaattcaaaaaaggaaccaagaaatttaaagcttcattttggggaattgatggaaaaaaacatccattaaaaaataacgaagatgttattaaagtgatggagcgtttagacggtcctgatttcaatgtcgataaagttgaaaagaaagaacgtcgtagaaattcaccactcccttatacaacaagttcaatgcaacaagatgcagcaaataagcttaactttcgtacccgtaaaacaatgatggttgcccaacagctttatgaaggattgacactcggaagtcaaggacatcaaggtctgattacctatatgcgtaccgactcaacacgtatttctcctgtcgcacaaagtgcagctcatagctatattgcggaacaatttggcgaaaagtacagcaagcacggttcaaaagttaagaatgcctctggtgctcaagatgcccacgaagccattcgaccttcaaatgtctttaatacacctgagtccattgctaaatatttggacaaagaccaattaaaactctatacacttatttggaatcgttttgttgctagccaaatggttgcagccatttttgatactgtgaaagtgaacctttcacaaaatggtgtcatttttatcgccaatggttcacaggtcaaattcgacggttatcttagaatctacaacgactccgataaatcaaatatgcttccagaaatggaagaaaacgagacagtgaaaaaagcaaatgttaaaccagaacaacacttcacacaaccaccggctcgatattctgaagcaacactcattaaaacattagaagaaaacggtgtaggccgtccctcaacctatgctccaaccttagaaacaattcaaaaacgctattatgtaagattatcagcaaaacgatttgaacctacggaacttggagaaatcgttaacaagttgattgttgaatttttccctaacattgttaataccgaattcactgccgaaatggaaaaagatcttgatcaggttgaagaaggaaaacgccaatggattgaggttgttgaccaattctacaaaccttttgctaaagaacttgaaaatgctgaagaaggtatggagaagattcaaatcaaggatgaacccgctggttttgattgtgatgtgtgtggaagtccaatggtcattaaattaggacgtttcggtaagttttatgcttgtagtaacttcccagattgccgaaataccaaggctatcgtgaaagaaattggcgtaaaatgtccactttgtcatgaaggaaacatcattgaacgtaaaactaagaaaaatagaattttctatggttgtgaccgctatcctgaatgtgaatttacaagctgggacaaaccaattggacgtgattgtcctaaatctggtcattttctcgttgaaaagaaagttcgtggtggtggtaaacaagtcgtgtgttcaaatgacgagtgtgactatcaagaagaaaaacaaaaataaaaggcgcaatagcgcttttttattatattaatcaatggtaaaattcaataaaattagatataattgggactatgagaaaaacacatattaatgttatcggagcaggccttgccggctctgaagccgcttatcaaattgctaaacgcggtatcccagtaaaaatttacgaaatgcgcggtcttaaacagacccctcaacataaaacagacaaatttgctgaacttgtttgttcaaattctcttcgtggagccgcaataaccaacgcagttgggctcctcaaagaagaaatgagaagactcgactcagtaattattaaagctgctgaatacactcaagttcctgctggtggagctctagccgtggacagagaaggtttttctgattttgttactagagaagtatctaatcacccattagttgaggttattcgtgaagaaatcactgacattcctcaagatgaattgacgattattgcaaccggtcccttaacttctgacagcttagcaaataaaatccgtgaatttaatggcgctgatggtttttacttttatgatgcggcagctccaatcattgatgctaattcgataaactttgataaagtttataaaaaatcacgttatgacaagggtgaagccgattatattaactgtccaatgactaaagaagaatttcaagattttcaagaagccttgatttctgcagaagaagctcctctcaattcttttgaggatttaaaagtctttgaaggctgtatgcccattgaagaaatggctaaacgtggctataaaacaatgctgtttggtcccatgaaacctgttggactggaatacccagatgaatacaaaggtcctagagatggcgaatttagaacaccttatgcagttgttcaacttcgccaagataatgcctccgcctccttatataatattgtcggatttcaaactcacttaaagtggggagaacaaaaacgagtttttcaaatgattccaggactcgaaaatgctgaattcgttcgctacggtgtaatgcatcgaaattcttatatggattcccctaatcttcttaaacaaacatttcaatcacgtaaacaagaaaatctcttttttgctgggcaaatgacaggagtagaaggatatgttgaatcggctgcctctggcttagttgctgggatcaatgcggctaaactttttaatgatgaagaagtggtgattttccctaaaacaactgcaattggaagcctcccttactatattacccatactgatagcaaacatttccaaccgatgaatgtcacttttggaattgttgaggagttagatggcccacggattcgtgataagaaagaacgctatacaaaagttgctgaacgttcgttaaatactttaacagatatcatctcaaaagaaaatttagcataatatataaaaaaacgcttgaagcttatcaagcgcttttttatatattactttaaagactatctaaggcatttttttgctcttcattaatgatatgcgtatagaggtcggttacctgagttgaagcatgacctagctgattactcaccaacacctgcgaatttgtctgagcgtaaagccgagttgcaagagtatgtcttagtttgtgaggtgttaccctaactttaaaagcttgtgaatatttagcgactaacttttcaacactagacggatcgattcgactggctatatcacgataaagagtgacaaaaaatgcagtatctttggcagttgttttataacgttgactgcgcacctctaaatagcgctcaaaataagttttggcaaaaggagcaaaaggaacagcatcccttttacctcccttacgagtaacttcaacaatcatagtgttaagatttaaatctcttaaatcaacattaactgcctcagataaacgaataccagaagctaaaataagggcaataattgctaaatcccgttctttatttttgaaaaaactagagtgggctcgatttgataatgttttctcatattcactatcaatataatcaaggaaaccctgagtttcatctcctaaaaataattttcctttgatattttcagcacgagaagctaaagtttcagattttttctttgtttgtacttttttcataacattacgatagaagtaaggctcaccatcttcattttcaacctcctcagtaaggtatttataaagactagaaagagctgataaagtacgattaattgtcgtttggctaaccccatagcgagtagaatgggtatttaagcgtggcctttccctaagatagagaataaatgactccaaatctcgcttagttaagttttccagaacagagagtgaaacgtcagttattttatcaacatcagcaacccccgagtccaccaaccagctaaaaaagcgttcatattcttttaaatattcataaagtgtatttaaactataaggaatagtaagtttagattgataatattcaagaacataaggaggcataacatgctttagtttttcaatattttgtattaattgttcacgtttcatagattaagtataccagaagagatatccaattgtcaagaaaattacagtttttcggaaagatgttaattaaaacttataggagtgctgtgttatcctttttcttataaggttttataacacattgctctcctgcttttccttttaattatcttttcggaaaaatttttcaagaaagtttttttacatataaacgaaacagttaattaaaaaagagagattccgatctcccaacataaaaattcatcacatgaggtccgacatcaaagatttcgatttatatcctttgtggctccatttgctgtcaatgaccgtcttccatcgcctttacatagtctaatggtttgtagatgatccgggttccttccggtaacgattatatttgtcagttccattaatatgggaatacttgaatggtttactgattcccctctgtcatttgaatacgttatttgattatatcaaaaattgcttggtaaataaatttcagatagtttgtgaattttaaaacttatttaagcacccatatgttgaggaattccctgaaaatgtatcttaatttcttgctttattttaatcaatagtaattatatgataatctataaactaatatatccaaatcccttttagtaaatatactaatgaatcgataaaaaaataaataccaatacctaatacgaatagtgagattattattctagtgatattgcttaatttttttcttcggttatttttatctaaatacctacttactactttaatcaatttttcatagacattaaatattaatgatactactaaagtatataaaggaatctgacctaataacatccaaattgtcaaacacaatattgttaataatatattcccttcttttgcgcttagtgcaaccaccgcccaaaaagtcggatctgacatagcccaaaatccaaaaataaaacctgcaagtggcatacttcttttggcaaattgcataaattttgattctttcttgtcgtcttctctttctttatttcctttcagaaaagtcgttcttataaaccaagccacacatacaatggatatcaaaaaacctgtgaatacgtaagccatgtctggaatatgattcattatatttgtaaagtaatccaagccaatactggcaccgtatgaaaatattaatccaaaaatgaccgtagaaagtagggccattaaagcaaataaatatatttgttttttctttgttccctttgccaattcagccattataaggattgctcccattggatcaaatccgccgaatcctaacaaaattgatgatagtattagtttcatatctcattgcctccatgcatcattttctgtaataacaatctcttaaatttttttaaattcactaggtttgcatgtcttgctgcagcctatcgttaaaaagtatagaaagataacaaagtcagtccgtatcctaagctcttgttcaacacaagcatattctagcaaatagaaatgataattaccagtaatcaagcaaattataataagaagctaataaaactacgactttttgataagcataatcactaatcattggtctaaaccatggtgagtcaactttattggtgtttattttaattgctttctccgctccttttagtgccacatttttaccaaatgagcagtttagacaaatgaaaaagcccccaatgggctttttattgtttctgtagttgcaaaacttgagcattattaatttctttaaaaagtttattactagtttctttagaaatcatatcagattttgcttgatttagtacaaattggtattcaagttgaaatgcctcaatgagtaattcatttggaataattgtatcttcttgaatgtcattacggatacgatagtgtctgttttctaaaatgtgtttaacttcctcaatatcactaaaatcaatagttttattttctaagcgttctttttctaattcactcagtctttccattgtttcctggtaaagaatatcttctagcctacttaagtcatttcttaatagagtaaattcttccatctcgactgaatctgttcttctaccccgtcctctttttgaaaataatcgtcttattctcttgctagttgagtgcttactaatattttccagataaatcctaaaataatcaacaattgtgggtgaaaattgtgtttttatagtcggtgtatcaagaagtgtttcttgccaagttataatgtcatccattagcttactactcttgttatgatcaggaatttgtaatcctttttgtgattgcaactgtttagtgaggctactacgcactttactatcttcaatctcatgcgccatatgtaaaattgcataatcaaccatctcattacggacttggttgatatcgtcagaactttctacaccaagtgcgggtaataattttggaagaatgagtgtcggtacaatgagactcaaaagaattacaatagcagccattgtaataataatttctcggttctcattttaaaactcgaggcattatttgttttttattaaatgctgatgtattttcatccattgtccattcatcttctgcaccacctcgtatataaccaaatgctcctttattcccagcagattccatgctttctttcactttaccttcaagtgatttgatgtttacaatttcaatagccttgttttcagtacttgtttgataagtcatttgatatctcctattttcttaaagtttacatctgtagatgataaacatattatacatcttatttcaaaaaaatacacaaatacaggattttattttattattttttttaaagactaattttgaaatttgtaaatcatctctgaaatgataatttgctcccgttatgcttaatagtaatcacagttttagtttttatttaactaatatctgctttattcttgattcaaaagatgttacaggaaaacttggaaatcgctttttaaatttatcagaattaaagagattatcaacttcataccgtggaagtaactccaacaattctttggcatttttgttgaataagctgcctaccttaaatttccataatttaattatggagtaagataatttttcgttttctattttgtcagcaatattaatcatttctttgtaggtaaggctcctatcacaaggcaaatgccaggtttgtccgtatgcatcatcagtattaccaataagtgccattgcacggcttgcatcaggagtccaaattaaggttctgagagtgctatcactaataggaatttttaatttttgcttagctttgatattgctgaaaatcattgtattggtaatactttgggttttttctggtccgtagaattcaggtgctcgacagacaactgccttcaattcattggcttccatctctttaataatcttgtcagctaactgagctcttacaagtgattttttaccacttggactaaaaattgtattttcaaattgaatagctgaagttttaggatacatataagtattatcaaaaaaaactagcttacttcggtgaattttacaagcctcaataacattatctaaaatctttgaaaattgcttcatccacatttccgaatccataggtaatcctacggtaaaataaactatatcacttccagaaattgcattattcgtttcattaaaatctaataaatcagccgaaactaattcatcactatcatgtattttctgaggttttcgactaactaatcgaatttcttttgtatagtttttatataattcttttgcgagctcatggccaatttggccgttacttcctaaaattgtttgcattatatcagctcctttataagtattttagcaacagttcgtactgaaaatggattttgaccagttattatatttccatctttaagagcataatctttgtaaaaatgttttttagtccagattataatataaattcttcatttttgccgactcctctaaaggctcttactccccttgtttaatctcgtccgcaaggtcatagaaggctttacgaaaggcactgcggtagcgaagccagctcaaacttgcgacttcttgcgccgcaatcgagggataatctgcacgcgcattgttcatgatggcgatgagctccccttgtttatccatgtcctcaaggccgtattgatgttttttgataagtttgcccaagtctttaggcatgatgctattatctaagccccaagtacggataaagtttgtgatgagttggatattattatctctttgggctcgatccatcgcttcattcattttttcagtatccgttggtgcaggatagtgatcaaaaacataagctttcgtaaagatttgtgaaacaaaatgacggactttgtttttttctttttcgttatcactttttgcgatttctaaatcaatctcttgtcgtgtattggcagcatcatccatctgatcagcatggacttcatcggccattttagcaatcaactcaaccagatagtcgtagtttatttttacctcatggatatgaaccattgccaaatcaacttgagaaatatcaatttcttcatgcttcgcccgacgttctttcaggtctccagcaattacggtcgtaaggagaacttcctcatcttctgagattccaagtctttggtagaaggcttctgcctcttcataggcagagacaggtgtaccctcatcatctttggtatattgtttgagctgacttaaaagacgattatagtctttcaaaccttcaaaaacttcttcttgcgctttttcactcggcggtacttgcacaaatccttccgtcaatttacctaatttttcgatcactgctttaagctctgtttccacttcgctaaaagatttattcaaaataccagattctttgttttttcgtttgtaatcatccaagctaagttgttcatccgctgatgagcgattagaatagatggcaaaagcctcattcatttcaaattcattttgctcaggccaacgataattgattacattaccccaaggcttatccgttaagttgtgcatccgattcgtccgcgagtaggcctgaatcagatttccaccttttagtgttcggtcaatatagagggtattcaactctggtgcgtcaaagcctgtaaggagctgatcaatcacaatcaccaagtccaaataatttctaccatctgctgttttatttaaacgtctggcaagattatctgtatagccccgaacattcgtcatatcgaaatcttcaccaaagagttgattataatgtttgattgctcggtgtagattttcattcgttttaagctgattatttccgtttgtagtatctgccgaaaaactcacagctacttttaagcgttcttcctctggacgtttggcattttctcgcacaaaagcatcgaagtattccattgctcgtggtgtgctggctttatttcccccaacgtgcacagtaaataaggcattatatttgcggttgttagagcgctctttccaatgtttaaagatgtcttcaacgacaagattgacgtgttctgggctggtatcgtagacgctaccacgcaactgatcatcaatttcctctgcggtaggattttcgggcggcgtaatcgtttctttaaattcaacattaaaacctaacacattccgatcagctattgcttctttaatcgtataagcgtgtaaaatatccccaaagatctcacgtgtttctggaaatttcggtgttcctgtgtaacctacccaagctgagcttggaatagcagatcggatattttcaagcattccttcattacttacaccatcactcgtcgaacgatatgcttcatccacgatgaagagaatacgatctctcagaggtttaaaatcttctcttgtgacatagcgagacattttttgaatactggtaacaagaatgttcttatcactctttttcgtgagctggcggtgcaagtcagagatatttgcagtatcactcactatccctatcttcccttcaaaacctgccactgggtcgtaagcccgataagcatcagctgtctgattggttaaggcaatccggtcaacaaggaaaattaccttatcgacgtttgacaatcgactagcaagccaagctgttttaaaactcgtgatggtttttccgctccctgtggtatgccaaatgtagcctagttttccatcatcaaaattaaacttaaacttttgaactttgtctagcacacgttttgtggcataaacttggtaaggacgcattaccttaataccctctttgttcttggttccgtcaagtaccatataacgggtagacaaatcatgagccatcggaatcgagagcactttatccgcaaaagttttccatgagcggacaggttgcgcattcccctcattttgccaattgaaagcaaaggcacgattaaaattctctagcttggtatttgccatatatttaatttcatagggtgtcatggcaatcaagatttgtacggtagaaaaaatatcactatactgtttttcagcgatatattgttccatttggttgagcgactctctagtagagtggagcgcttttttcaactctatttggatgatcggtaagccattgatgagaagggtcacatcaaagcggcgatttggttttccatcaacaactttttttctttcaatttgattaacaacttgataagaagtcgtcccacccccgaccttagcttggtcaaatattgtcagaaaaacgtggcggccatcatccaaatcgacctcaacttctgaaacaccatttacgccatacaaaaattgacctgcttgataaggagaagaaattgcagtaatgactttttttacttggttaaattcagtgactgacaagggacgttcaagacgggcttggttattacgttcaataatagctttaaaattttcccaaagttgctcagtcgtcttaatttctggacgatattcccactgtttgacaccaccaatatgagccaaatagtctactacttcttgctcaaatgctaattcggatttatttttcatttttatttccatctttgattgccccttctaataaagaatatgagaattcttctaacgttcttgaaaactgacttaattcactttgcaaacgtaaagtttcgatataaatattcccaattttttgttgctcaacaattggcaataaaggaattttgatatttcctaacgcttttaaagggattttttgaatgacacccgttccttgcatttctttttctttttgtctttttacatctttaaagacattgaaaagatacaaaaaataatttttatccagttgatcatttttaaattcaaccttggtaaagttgattgataaaacttttcctttattctctttcccaacctttgcagccatctgtaaagaattattaattacgatatcttcctgttcagttacaaaagtcttagaagccatagtttctgtttttggccttgaaaaggaatctacatggttaaaatcatcctcaaaagaagcttgagtataataattaaaatcatttactttaaattgcttatctgcacgagattgattaatccctggcatgaacgtaacaagtgcgtttagtttttttatttccaatcatcaaacctcttttgattttttgtaataactgattatttcaacaaaccaagtttaacactcttaaaccaatttgtcaatcaataaaacgaaatattgttatatttcattttatataataaaaaaagtctcaaaatcacttgagactttttttcaattagacattaatccattctattgttctgtttctaaaggaatatccaaatcaaggcttgttgcttttctttgttcacgacgagcaatgaaaggtaagagcattccaagtaagattaaaacaattggtgtcaaaatatttgatgcgagttggaaccaccatgcagatggattagcagcatagtctaattttggaaccatccctaacacgcaggcgatgagtgtaaatagaaaacaccaagcaccagcaatcatggctagacgtttttgtttgataaatttatattcagattgaaaatgttttactgcccgatttaacataatgaaggcaaagaagacccaaagatagcgcattggcatcacgactgagttcaagttagtcaaccatttaaccaattcattcatatcaccgattccaagtaacggtaaaagaataatgatactaacaaggattcctgttaatgtataaccatttttaagcgttcctttgttcgtttttttacgcaaccatgctggaacatattctgggtcagcatcggcaagtaaaatacgtaatagcgcatcaatagagaaagccaaggcagcgatttgtcctacaccattagttaaagcgtagacaatcattaaaaagtttccgacaccaaagtgttgacccaagatttggaaggctgcataagcaccattagccatcaagtcatttggtaaattaccacttgagaaaatcattcccatagcaattgaacctaaaacggcacagataccaaccattccagcaagtaaaaacattcctcttggaaattcttttgctggatttttagtttggttaacataaggagaaattttttcagcaccaccgacagcaaagactagcattgaaatagttgtgaaataactaaagtcaaatttaggaatataagttttaatatttcccatgtcaggcgttgcaatatggaaatctttcgcgataaaaggtgctccaatcgccatgacaatgaaaagtaaactcataacaaacattgctgttcccgcaagtctaccaataactttcagagtatttaacccttttgtcgatagccataagaaagctaagaaaattgctaacgaaataagagcaacagcggtcatcgacatttgactgaccagattcccatttccttgaccaacccagccaaaagcaatcaagattgcttggggtttttgagccaaataaggaatatgaaccacccaataagtccacgcagcatagtaagctaagcgttttgtactggtattttcaacccaagaacttacgccgcccttactatctttgaaagttgaaccaagttgcccaacaatcaatgcatagggaataaaatacaaagctaaaatcaaaagccatgaagtaacaaccgtaattccttgttgggcaaagttgttgacaacatttcccttgccccaaaccatgttggaggcaataaatgcgacggtaaaccatctaatttttttgtgtccataaaactccttaaatttttttgaataaatcgcggacattgataatttattgtttagcgctttctttttagcgtcattaaaattataaaatattacagacccttctgtcaattttttactgtaatcaaaaaagatacttaaatttttaagtatcttttgaatattagctcaatttcaaagactatttaaagactatcaagtgcttttctgattggtgttttcccattgtgcatcgaaattacttgtccaattgaacgattggtcattactaattccttgatagtagctgccacatcttcgatagtattgctggcagaaacaccgtcgttgatatcaattaagccagttccttcttcttctatcaaagctccaggttggataatagtatagtccagagtcgtttctttagtaaggtataaatcggcaaaatgtttagcaatatagtaatctttcaaagcatcaaaaccagcaccaatccatttttctggttgaagagagaagatggtactcaataagataaatcgtttgactcctgctttttcagttgcctgcatcaattttacagccccatataagtcaaccttcaataaactttttccacctgaacctgaaacattaattacaaggtccagtccttgtaattgcttggacatttcctctggtgtccagtcaacatcaaaatgaactgcatttacattatcatattcaggaacttgctcaatttttcttgccccagcatagatttgatggcccgttgttgagagggatttaatcaagcttttacctacacgtcctgtacttccaacgataaatattttcattttctacctcttttctacttcttttattgtaaaaaaaaaccaccttgaaagtgattttaagatgttttattcttcgtccattgagaggacagagaggaaggcttcttgagggacttctactgaaccaatggctttcatccgttttttaccagctttttgtttttcaaggagttttcgcttacgggaaatatctccaccataacatttggccaatacatttttacgaagagctttaatgtctgaacgagcaacgattttgtttccaatggttgcttggattggaacttcaaattgttgacgtggaatgagttttttaagtttttcaacaattacttttccgcgttcaaaggcaaagtctttgtggacaatgaaacttaaggcatcgactttttcagcatttaagagaatatccatttttacaagatttgatggacgatagtcagaaatttcataatcaaagctggcataacctttagttgatgatttaagtttatcaaagaaatcaaaaacaatttcactcaatggaatatgataaatgatattgacacgatttgcatctaaataatccattgttagaaaaattccgcgttttcgttgggccaattccatcacaggaccaacaaaatcatttggcaccatgatttgagctttaacaaatggttcttcaatattttcaatgcgtgtaggatctgggaattccgatgggttagcgacttctaatgtttcaccatctgtagtattaatatgataaacaacggatggagcagtcataatcaaatcaataccaaattcacgttctaaacgctcttgaatgacatccatgtgcaagaggccaaggaaaccacaacggaatccaaaaccaagagcttgtgatgtttcaggctcaaaacgaagactagcgtcgtttaattgaagtttttcaagggcctcacggaggtcgttaaatttatttgattcaattgggtaaatcccagcgaacaccattgggttcatttccttataaccctctagggcttcggtcgctggatttgaagcgagtgtcactgtatccccaacacgtgtgtcagcaactgtcttgattgcggcagcaacataaccaacatctccagccatcaagaaatcacgggcaactgcttttggtgtgaaaatcccaacttctgtaacatcaaattctttgccgttactcatcagttgaatacgatctccaaccttgactgaaccgtcaatcacacgaatttgaagaataactcctcgataagcatcataaactgagtcaaaaattagagctttgagaggcgcgtcaacttcaccttgaggagctggaactttttcgacgatttgttcaagaatttcttcaattccaattccagctttagcagaggcaagaaccgcttcggaagcatctaaaccaatcacatcttcaatttcttggcgaaccatttctgggtcagcagctggtaagtcaattttattgatgactggtaaaatttcgaggtcattatccaaagcaagataaacgttagcgagggtttgagcttcgattccttgggcggcatcaacaactaaaattgccccttcacaggcagcaagacttcgtgagacttcataagtgaaatcgacgtgccctggcgtgtcaataaggtggaaaatataagtttcgccatctttagctttatagttcagttcgatagcatttaatttaatggtaatcccacgttcacgttcaaggtccattgagtctaaaagttgggcttgcatttcacgttttgagacagtttcagtttgctcgagaatacggtcagcaagggttgatttcccgtggtcaatatgggcgataatcgaaaaattacgaattttttccttacgcgcgttcatttcttgtaaattcattttgattcctttataagagttcttgtgacttaaaatttaattttgtccactgaacttccatttcgcttttttataactaaaaatcagttagaataattatagcatattttgcaataaaaaaccgctctttttatgtaaggagcagttccgtgatagctataataactttactttaaagcaaaatattctataaattacattttattaaaactaatagtttctctctgaataagagtaaaattatagaaacttgtcttatatgttagacaaaattattgaaataagtgctggtcaaaattttcatcctcatcaggaaattcttgttcaatttgggtaattttgccaagttcaatcgcaagattttcagtgatgaaattttggacatgagccgtaaatgttttatcctcactgacaaaatgcaaatgaaaaccaattccgaaaaggtcagtcagatgtttgggtgcccaaacaccaagcatcgtaccagagatattttcttttgtaaaataaggttggtcagccataatttcatcataaggacgagtgttattggcgggcttgctactgacggtcacttctttaaattgaccggtcatgacaatcgtataagcagtatttgccgttggaaaacgcttagtcagcgctgacagaaaatcttctgagttactgacagagttgtcagtaaatttaacgatgggttgatgttcaaccattgccacataaggcatcgtttcattttcttcaactaatctgacttgattttctgagtcaccgtgataggcgatgccatcaatgattgtcacctcgccatttgccgtatcaagcgtaccgataccgactttgccgtgtgttagtgcttctttgagggtaattgtacctttgtaaaagccgatagagagtgtcgtaaatgtattgtgttggaatattctgctattcataatgatattattttatcacttttttttgttagtagtatcaaatatgttttataaattttatagagcaaaaaatccctgtatttggtataatattgcttatgacaataaaaacttcatttgcaaagtttgctggtaattcatcgcgctttgtcttggaaaaatttttcaagcgtggctcaactttaccaggaaaaattgctttaaaatttgaccctgaaattcttaaatcactgaccaaaaattatgaaatcattgttgtgactgggaccaatggaaaaacattgaccacagctttgaccgtgggaattttagaaaaggcttttggaccagttgtgacaaatccaactggagccaatatgatcacggggattgtatctacctttttgaaagctcccaaagcgaaaactggcgaaaagaaatttgctgtccttgagattgatgaagcgagtttgccaaaaatcactgaatacatcaaaccttcattatttgttttcacaaatattttccgtgaccaaatggaccgctatggagagatttacaccacctacgatttcatcgtcaaaggtgcggcaaatagccctaaaggtactgttttattaaatggtgatagtccacttttcaactcaaaaaaattagttaatcctgtaaaatattatggctttaaccacgaaagtcatgaagctactcatgctcattacaataccgaggggattgtttgtccagtttgtcatcatattttggcttacaagatgaacacctatgctaacttgggaaattatatttgtgaaaattgtggctttagtcgtccagaattagattatcaactgacagaattatccgagattacaaatacttcttctaaatttatcattgatgggacagattataaaatcaatgtcggtggactttataacatctacaatgcccttgctgctgtctctgttgctgaatatttcaatgtgccaaaagaaacaattgcggctggttttgaactttccaaagcagtttttggtcgtcaagaaactcttgaaatcgatggaaaaaaagtaaccattgttttgataaaaaatccagtaggtgcgaatcaagcccttgaaatgatgaaattagccaattatcctttcactttagttagccttttgaatgccaattatgctgacggaattgacacaagttggatttgggatgctaattttgaattaattaatgacatggaaattgaccaaattatcacaggcggtgttcgttcatctgaaatggctagacgtatgcgagtgactggatttgatgcccaaaagatttccgagcgtaaagaactttcagaagtattagaggcaatcaaagaaagtcaaaaagatcatgtctatattttggcaacttatactgccatgttgcaaatgcgtgaactactggctgaaagtcattatcttggaaaggaaatgcgttaaatggcatatatctctttaaaatcaaatcttgaacatccaaattatgcccttaatgtggctcacctttatggtgatttaatgaatacttatggtgataatggaaatattctcatgctcaagtatgttggagaaaaattgggggcagaaatgaccttcaatattgtttctttaggcgacacttttgctaaagaagattacgaccttgttttttggggaggcggtcaagattatgaacaagaaattatcgctgaccaatcactgcttgacttgtcagcacctttaaaagattacattgaatctgagaaaccacttcttgcaatttgtggtggttatcaaatgctcggtcagtattatgttaattccgaagggacaaaaattcaggggacaggaattcttggacattatactgaaaatttgcgaactgaccgttttattggcgatattgaaactcataatgaagaatttggcgaaacttactatggttttgaaaatcattcaggaattacctacctctctgatgatgaaaaacccttaggaaccgtcgtttatggtggcggaaataatccagatgaccaaactgaaggtttaatttacaaaaatacttttggaacttatttccatggtccaattctttcaagaaatgtccgtctggcttatcgtttagtgactactgctctttaccaaaaatatggtgaagaaattcaactccctgcttttgaagatattttagctgacgaagacaacggtcaacaaattggagaccttaaacgtaaagttgaaaaataataaaaaaaattactgacagaaatttctgtcagtaattttttttattttttaaaaagctatcagtaaaatttttatgattaatctactgatttcagagctccaagcatatccacggcttttaatttgaaatgaacaacaagcgccagcaaaagagtggtcgcaaaagtaatcgctgctgataacaaaagatttgtccacagtagccccggtgcaaacatgatttgatcagctgacaattggttcataataacctgatggaaataatcccctagaccaaaacctaccaaaatccccaaaaaacttaataaaatcgtttcccgataaatataaagtgtgacttcacggtcataaaatcctaaaactttgattgtcgctaattcacgaattctctcggaaacattgatatttgttaaattatagatgacaacaatcgcaagcagaatggcacaagtaatcaaaacaatcatgacactattaatgccatacataaaggattcaatcacttttttaaggtcactattttgtgaaatagcctgaattccgttttcttgcatcaattgagccgacatcttttgaatattatttacagaggcattttttaacttaatcaattgaccattggtcataaaatcttttttaaaaactttctggtaaaccgattggttcatgaaaatataatggcccatatacatttcagtaattgccgacacttttatccttacaggcttattttcatcatctttaagcgtcaaagaatctccaacttttagacctaaaagttccgcaaatttctccgaaatgactgctccagaatcatttaatacaatcttttgattatttttacgagattctaaactaacatattttgataaatcatcagattgattcgtcgcaattaagctgacctcttgcttttctaattttccactggcttctttttctttgtcactaactttatttttttcaatggcaatcatatcataatgcaaaatttgcccaaattgttttgatgcaagtccagaaatcgaatcacgaatcccaaatcccatgacaagtaaagccgtacatccagcgacaccaaagatggtcattaacatcctttttttataacggaaaagatttcgagccgtcactttgtaagtaaaactcattcttttccaaataaaatcaattttctctaaaagaatgcgtgaacctgcttttggcacttttgctaaaaataaactagctggtacttcctttaattcttttcggacaacccagtacgctggtaaaagactacaagcaatggcaatggcaaaagcgactattgtccataggggtgagaaagttaagcgcaaattactaaaggtagatgaagccgtgtaagcattaaataccgcaagcggtaaaaaagtatgtccgataattgttcctactaaagcacctagaccactagaaactaaaccatagaccataaatttcttacgaatctcacgatttgaatatcccaaagccttaagtaaaccgaggttccctcgttcttcttcaacaaaacgggtcattgttgtcaaactgactaataaagcaatggcaaaaaggacaaccggaaaaatatttgaaagactgtcaattcttgttgaatcctccaaaaaagttttgtaacctggatttccttctttacgattattaatctgataagttggttcttcaagttgatttaaagctgcttcttttttagccagctctgctttagccgatgcaagcttttcttttccagcatcaatttgattttgagccccattaagttgctcaatagtctgcgctgatgaagactcgcctatttgattcttttgagcaattaattgattttcttgctgctttagttgactttcttcatgggaaatttgacttttagcctcaataatctgtttttctgggtccactttaagtgctgccaaacgtttctcaggttgatttttaaatgtattttctaaagctttttgttctctttttagtcgattatcgtacttgtcatcaaaaatggagatattttgtaaatttttataagataaacgagcaatcatataaactttagaatcaaaggcatccttagtcacaagcccataaccatttagcttcccagtccctaccgtcgttgcgccaaaattactcttatcgacatattcactagatttaacaaatccaacgattttaaaagaatgattttttaacagatcagaatcctcagatttaggaggggtaaaatcaatgctttggcctattttatactgactatcatataaataatccaaggcaatttctgaattgctttgaggcaacttgccagacattaactcataggttgacaattcatctggcttagaaaataagcgtagactgctttcttttcccttgattaccaaatcctgaaagtagccgaattctgctttttttaagccttttgtttcattaatcagcctttggtcagtctcatccaatcctaaagttgaagttaccgttaaatctgctaactgatgctgccgataaaactcttccgcagttgccctcatatccggaccagaaacttttaatccgacaaaagcaaaagttcctaaaagcatcaaagaaaaaatagagatgaaacgacctaatgaacccgtaattgacctacgaatttctttgtttaaggtttttttccgcataagtcaccactcaattctatcaatatcttctggttggctattattttcaatttttttaatttttccatcatgcatctgaatcactcgattggcaattggtgcaatggcagcattatgagtgacaataataaccgttttcccttcctttctggccatatcttgaagaatttttaagatttgttttcctgtgtgataatccaaagctccagtgggttcgtcacaaagtaagattttaggatttttagctatagcacgcgcaatggccactctttgttgctcacctcctgaaagttgcgaaggaaaattatgaatccgatgttccaatccgacacttttcaaaacctctttagcatctagtgcattctcaacaatttcagaagctaattcgacattttctaaagccgttaaattattgacaagattataaaattgaaaaacgaaaccaacagcatatcgtcgataagtaatcaattctttatttgaaaaattggagatcttttccttgtcaataatgacctctccttcatcatttgtgtccattccccctaagatatttagaactgtcgatttaccagcaccagaggaacctaaaatgacagccaactctcctttttcaatttcaaaattcacttggtcattggcataaattttttcttgtcctgattgatagattttagattcattaatcacttcaataaaagtcattatttccctcctttaattgtaaacgctttattaaattataacataattggcctttactttttatctatgtcctcagttttttaatataaaaattactgacagaaatgaaaagttactgacgaaactcccgtcagtaactttttatccaccgattcaacactcactttggtcgtgttgaactgtcagtaattatatttatttttatttccagaaatcatcaaagatactgattggtaagtgacgtttatgttgcgttttattccaccaagcttcgattttggccttagcatcctcagaaatcacctttccttctgtatagtcatcaatatcattataagtcacaccaagtgcaatctcatcggcaagtccaggcttaccttcttcaaggtcagcagttggaactttttcatagattgctgggtcagcaccaagttctgctaaaagtgctttaccttgacgtttattcaaacggaaaagtggcaataagtcagctccaccatcaccaaatttcgtgaaaaatccagtaatattttctgctgcatggtctgttccaagaacagcaccttgatattgtccagccacagcatattgggtaatcatacgttgacgggctttaatatttcctttattgaagtctgaaacctcaacacctgcttcatttagagccgctacttgtccttcaacagctgctttgatatttactgccaaactgacatctggcttaataaaggcaagcgcacgttgagcatcttcctcatcggcttgcacaccaaaaggcaaacgtacagcaacaaatttataagaagcatcagctgtttcttgtcgcatttcttcgatagcaatctgagctaagcggcctgctaaacttgaatcttgtccgccagaaattccaaggacaaatgatttgatgaatggatactttttaagataatctttcaaaaaatcaactgacactctaatttcttctttaggatcaataattggtttcacaccaagttctttaataatttcttcttgtaatgtcattttctcttcctttcactgacagctataaaattttactgacagctccacaacaacttttaatctaaaattttactcatgtaaaattcatcaataaattctccatcgacacacatagactcgcgacgaacaccttcaattgtaaagccttgcttttgaaaaagggcaatagccgcatagttattaatcattacggtcagctctaaacgttttatttctttttctttagcccatctatcaagttatgcaaaaaattgggctccaataccttgatgctgaaattcttcaatgataccaacaaccacataggctgtatttctaatccgattggcatttcctcttttagctgacagaaatccaacgaattttccctcaacatcagcaccaattaaaaaatcaaaatgtgaaatatgaccaattgtacgactaaaatcaaatcgtcgctcatctggctcaagcatcatgaacttactttcaatatccaattgcttttggacatcccaaaaaagtcgtgcatcactgaggtctattcgtcttattctcatcattcatcatccaatctcgtcattgatactgttgtacgcacctgtgaaattaggcgcattttatgattccataattcttgtgacaaatctactgggtaaggttgaggattcaaatcacgcttatattcatcccaaagctcctcaaggttttcacgagcaaatgttttaatttcctgtagttccggaagttgataaataagctcaccatcaataaaaatatcttttaaaagtggattagcattgaaatcccgaacatttttattaatgtatgtatagagcgggtggaacatgtagatttcttctgctacatctggacgctcgtcagaaaaagtgatataatctccctctgattttccatctgcttttttggtgatgcgccaaacttgctttttacctggtgtcgatactttttccgcattacttgaaagcttaatcgtatcttgcatttctccgtgttcatcttccatagaaactaatttataaaccgcaccaagcgctggttggtcgtaggcggtaattaattttgttccgactccccaaacatcaatttttgctttttgcattttcaaacttaaaatagtattttcatctaagtcatttgaagcataaatctttgcgtcagtaaagccagcttcatcaagttgctgacgaacttttttcgagatataagccatatctcctgaatcaattcggacaccttgaaaattaattttatcgccaaattcacgcgccactttaatcgctgacggaaccccaacacgtaaagtatcataagtatcaacgaggaaaacacaatctttatgcgtttgagcataagccttaaaagcttcatagtcattaccataagattgaactaaagcatgcgcatgtgttccacttgctttcaagccaaagattttagccgcccgaacatttgatgtcgcatcagctcccccgataaccgcagctcttgttccccaaattgctgcatccatttcttgagctcttcttgtaccaaattccaacaaagggtcttccccaattacagatttgatacgggcggcttttgttgctatcagagtttggaaattaataatatttaaagtagctgtttctaccaactggcattccgcaagtgaaccttcaatctgaaccaaaggttcatttgcaaaggcaagttgaccttcttgcatggctctgactgttcctgtaaagcgtaattcttttaaataatttagaaaatcttctggatagtctaattcacgcaaataggcgatatctgtttccgagaatttgagattctttaaatattcaaccattcgctctaaaccagcaaaaacagcataaccatttttaaaaggcatctcacggaaaaaaacttcaaagactgcatggcgctggtgtcttccaagctcaaagtaagtttgcatcatattaatttgatataggtccgtatgtaatgtaagactgtcgtcttgatatagatgtggcataattttttctcccatattcactttcgctaatcacaccgattttaacgcaattctaatctttattttatcaaattttgccctaaatttgtactgggaaccctttacaaaagcacaataaataaatatttagctattcttcatttctattttttatttccctttataatttttagaaaccaatgctattttttgctccacttatgttttttatactacaatggaagtaatggagaaaggagaggattatgattagttatctaaaaaaactacttaaacaaaatgatagtgtgaaaatccacttaatagacggaacagtcgtctctgccttacatttcaagaaaggttacagcaatggaaattgtctcgtaattgatgaggataatgtcgaacactaccttagtagcagatacattgttcaaatagaatcttaaaccaaaaactccataaggagtttttctttaatttccctaaatgcagcaaatcatttctatagattgcggtaagctatggtacaatataaaatgactgattcaaatcattggtacattaaatattcataaaaaattaaggagaaagccccttatgggtaaaggaaacagaaaaaaaatagggttgttgggaggaaattttaatcccattcatcacgctcatttaatgatggctgaccaagtggctcaacaaatgaatttggatcaggtcttactcatgcctgaaaacattccacctcatgttgatgaaaaggaaacaatttctgcaaaacatcgagttaaaatgcttgagcttgccatcaaaggcaaccctagacttggtctcgaattgattgaaattgagcgtggcggaaaatcctatagttatgataccctcaaactcttgacgaaagctaatccagatactgattattatttcattatcggcggcgatatggtggaatatcttccaaaatggtataagattgatgaattaatcgaactagttaaatttatcgcgattaggcgaactgaaaaaaatattgagagcccttatcctgtccaatggttagaagccccacttctaccaatctctagcacaatgataagagaaatgtttgttcaaaatattaagccaacttacctcctccctcaagacgttattaactatatagaaactgaaaaattatataaaaaaaatgaccaataatggtcattttttatttaaacttccaaatttagaacttcttgtgcgtaaattgatgaatttccattcaaaacataagcgatagtcataattggtaaaatatattgaactgaaccaaagccaaagacctcggcggcaataaagataggtccaaaatatgaatttgttgcagcagaaaagattgaaacataacctgcagctgctacaaattcaacaggcaaaccaaacagcattgccaaagccgcacctagtgtggaaccaatcgcaaaaagcggtgtcacttcccctccttggaaccctgcagaaatagacaaaaccgtaaagatcaattttaaaatccaatcatatccattgatatgaccaccattaaaactcaaaccaatcaaattcgtcccaagaccagcataacgatccatatgaataacgagtaaaccaatcgagatgacaattcccattaaaataattctttgataaggattagcaattctttttgcaactgttgctttcataaaggctagagattctgcaaaaaatctccccaccaagccaaaacatactgcgatgatggccaattttaaaagaactaaggggtcaagatgaatgttagtattgatcgcgaaagaaaatttttctaatcctagataatttgaagtccaacttgcgacataggaaccaactaaggctggaatcaaagctctgtattctatttttcctaacatcaaaatttcaatggcaaaaaaagttgccgcgattggcgtttgaaaaagagcagcaaaaccagcagccataccagtaatcaaaagaatctttttagcttcttttgctgaaagttttttaccaatcgcatgaccaatgacgccaccgatttgaacggcaaccccttcacgtccgacactggcaccaaataaatgagaaagccaagttgagaaaacaatcagcggaacaagacgctttggaatatcttctcgcccatgatttcccgcttcaaaaattagtcccatgcctttttgactatctttaccaaaatttttatagagatagacaatcaagagaccagctaaagttaaaaatggaatcaaataaagggcatgtccatctctaaattcggtaatatagataagacctcgaccaaaaatcgcatcaaccaccccaattaagccaccaataattacagctaagaagacatataaaattgcacttctggaaattcctactttaaaaaaattcatttttgaaactcctataatctaatatttaacacgacctgataaaaatacaatcctatctgtaagcgctgaagcgccaacagctacgctttgacgaagcgaaaacgatattttttcgccaagtaggtagtaaaaactctagcatctcctcatagggagacgcgtctgccccttttctgcttatcacttgattttgtcgcttcaaaatttagaatgatagcagattaggggcagctgaattttacaaaacaaaaggcgctacaaacaggactgcttaaaaacagccttttgtttgtaggcgccattagttttaagattttattcttaaagctgtttcgggtgtgcaccatacccatcattattaatatttattttaacattttatgaaatatttgcaagaaaaagctcagtcacgcatgccatttttccgttgaatttctttgagtttgtcaggagtcacatcttctcccgttttttcatcaatgactttgattgtttcaacttgtgaacggaaatttgctttaacactatcaagataagctcgacgtaaaaaggcttgttcttcaagttctgcttctgataaaccttcggcttttttcttacgcgccaattcattaatgcgttctacttgttcatttgtaattgtcatttcttaattccttttcgtaaatgtttttaaaattactgacagaatttatttttactgacagcatttaaaagggctttgcaactctccgtcagtaaataagtcagcttttattttgtattaatcaaagaaaaatcagccataacacttgttaatgcaacaacttctgacaataaggcaatccgattatcacgaacagctaaatcttcggccataaccatcacattatcaaagaaagcttcaattgcaggagcaagcgtatgaacaattgctcggaatttttcttcacatggcttataagtccattgattttgcagagaaataacggcatcataaagtgcttgttcagtatcttcttcaaaaagtgctggattaatttcagcaatatcagctgcttttttaactaaattaattgaacgtgaaacattttcaatcgctggtttaaatggttcgtgaagtttatgaccatcaataacaaatgctgattccatcatatttgtaatatcaaagtttgagctattaattgctgcttcaacaatatcataacggtctaatttttcaagcaaaagtttttgaacgcgtgctttgacgaattccaaaatttcagcatgattttgaccctcaaattggtcgataaataaagataggtcgaaatgccaattcattttttcgataattcgaatcaatccttgtactgcacgacgtagcgcataagggtcatttgaaccagatggaatcaaaccaacattaaagaaagaaaggactgaatcaattttatctgctgctgcaagaacagaaccaacttttgtttcaggtaattggccgtcagctgaggtcggcatgtaatgttcacgaatagccgcagcaacatttgcattttcccctgctaaaagagcgtatttttcacccatcacgccttgcaattcatcaaattctccaaccattcctgtcaaaaggtcaaatttataaatttcagcgctacgagccacgtctactttttcttcatctgttaaaccagcaatatcagctaatttagcagcaattaattttgttcgtgccatatgttcagtgattgaaccaatttttgcatggaaagttactttaccaagtttagccactaagtcttcaatcttaagtttttgatcttctttccagaagaattcagcatcttcaagacgagcaaccaagactttttcatttccaagcactacattttcaatatgttcggcattcccattacgaaccgaaataaagttaggagccaattggccttcttggttataaacttcaaaataacgttgattatcacgcattgatgtcactaaaacttctgctggaacagacaaatattttggatcaaatgagcctacaaaggctgttggatattcaacaatattatttacttcttctaataaatctttatgaagagtaacttgccaattattttcagatgcaagagccaaaatttgtgcagatatttctgctttacgatgttcagcatcaactaaaacaaaattttctggcattttgctagcataatcattggcatttttgagttcaatctcaacatttgccaagaaacgatgaccacgtgaaaaacgattggcggtcacatctaataaatcaaaagcaacgatttcatcttctaaaagtgatacgatccattgtataggacgaacaaataagaaatcattatttccccatttcatataagttgagaaggtcatttttgcaatgacttcatccccaactttagaaagaatttcttctgcttttacaccatcaacatgttttttagcataataataataatcacccttaaggattaaatcatccggagtcgctccttgaccacgtgaaaaaccttgaatcgcttttgaccaatttccttcagcgtctttagcaatttttgcagaaggacctttaacttcttcatcaatcgcttctgatgattctgacagcccttcaacaataagagctaggcggcgtggtgttgaaaatttaatgattttatcaaatttcaaacggttttcattaagaaatgcttccattcgttcagccaattgattgattgaaggagtcaccaaatgtgctggaatttcttccaaaccaatttcaagtaagtaatttgtcattatttttcttctccttctacaatcttagtatattttccttttttaccgagatatttttcacgtaaggcttcatcttttaagagtgggaagccaagtttcgcacgttcttcaatgaaagttttagctactttacgtgccatcttacgcacacgatgcatataaccggcacgctctgttacagataccgctccacgcgcatcaagcaagttaaaggtatgtgaagatttcaaaatataatcataagctgggtgaaccaaacctttatcaagtaaatcaagggcttcttgttcatactcaccaaaaagtttaagtaaaagttcttgatttgattcttcaaaagcgaatttagaatgttcgtattcaggttctttgaagatatcaccataagccacaccatttccccattcaaggtcataaacagaatcaacctcttgaataactgtcgcaatacgttccaaaccataagtgatttcagatgttactgaatcaacttcaattccgccaacttgttggaaataggtgaattgtgtacattcttgtccatcaatccaaacttcccagccaataccagcacaacccattgatggattttcccagttgtcttcaacaaaacgaatatcatgttccaaagcatcaataccaagtgctgctaaactttgaagataaagttcttggatattttttggtgaaggttttaaaacaacttgaaactggtgatgttggaacaaacggtttgggttttcaccgtatcgaccatctgccgggcgtcgtgaaggttgcacgtaggctgctccccatggctcaggaccatttgaacgcaagaaagtataaggactcattgtccctgctcctacttcattatcataggcctgcatcaggttcgctccttgtttagaccagaagccttgtagagtcaagataatatcttgaaatgctagttttttatttgccattattctaattctcctcgtaaaaataataattgatattgtcgatatgcttgactaatatcgaaacttgaatagttaacataaacattaatgtccttttcaatagctaccgtcatcgttcgcccattgccagctagtttaggaattggataaatttttattttaccaaaatttttatttctagcagaaactttggaggaattcaaaccgatatactttcttaatatgcctggatttttgtcgtgctcttctttaataaattctactaattgaccacgagttatatgttcatgtttatcagtttctataacagactttgaatttactttgagcctagttaaagatatattttcctctataccagctaattctcgaatataagaaaagtgttcttttattttatcatctgaaacaataaaaaattcccgactttcattataacggtattctttaaataatgtatgtaatagtttttctactattttatagtttttcactcttacagtatcaataatttcaaaatctttaggtacgcttgtattcaatgaaaataatcttttcttcatcgtatcagatgttatcccaatttttacatacattctaaaaagaggatttcgaattgcataaacagttccttcttctttaaccacttcttcctcctttctacagaaattcaaaaaaccgtacattcacacgctcgtcatttttcagaaaatctgaaaagagacaaagggtgcacatgcacggttccacctttattttttactttatttgtgttcattacgattttaaattaagccattttctttctcgaactttcactatcttcgagtcgctacctataaattctagcgctattttctcattttgtcaagataaaataaacttatccataattaacactttcaaatacttcgtgatatttttcctgagctgtcagtaactttccttgctcatcaacttctagctctaattcaaagatggaaggaaaatcagccattgtctggaccataagtgtttttttccatttattaattgttttatctgtcttataagttgctctgtcaataatgacatcaatttcaggaaatttttgagctaaaatttgattctcatcttgccccagttgactgagtagaataataaggtttgcttctttcttttttagcatttttacaataaactcagttctgtcagaaggattggtaaaaatcgtgtccgaactcgggcaagaatcgtaaaccgtactcattggagtcagtccaaaaatcccaatcttgccaaatttactttctttcagtaaataaggtaaaaattttccatttttttcaaaagtatttaatatttcatctttttcaatctggacattcgcagctaaaactggaaaatctaattgcttgagaaatttagcaagaccttgtgagccttcatcaaattgatgttcccctattgctatcgcatcatatttaagcttttttaaaaaatttttttcatcattttgataatttgacttgctaaaatttatatcagtagctcctagaaataatgtttcctctgcggtttttttatttctctccttaatttcatctatcaaagaataatgattattagagttcaaaataatattatttgtatgtaaaatggtaagtttcattattataaccaaccctatatatagtatttaatacttatattttatcacaaaaataccatatattgtgtttcttgaacattttctataaaaaaatgactaaagtcacttttaatggttgcgattgtagattacactggacacaaacgaaagaataataagaatagctccagtaagtcctgttaccacttcaccaatttcccatttgatactcactaaaatcagaaaagcaagtgtcagaatagcccaatgagctccatgctcaagatagactaaatcattcaaagttccattttgaactagatagagcgtaagacttcttacaaacatggccccaatcacgccaagtcctaataatataataattggatctgccgttatggcaaaagcaccaataactccatcaaaactaaatgaagcatcaataacttccaaatataagaaaagtgccaaccctgctttacccgtggcaacaacaaagtgcgtagaggttgcggcttttgaatggctcatcgtttcgccaaagccatcgacgagcataaaagttaaaatcccaagtatccctgcaaataaaacagcatgggaatctttagcgataaactcagaagtaatcaacaagataatgattgaaataatcgcattcgctgctggaaagtgacctattttttgcaagaatttttctggcaatttcaaccaagtgtgagcgcgatcatcaaagaaaaatcctaaagcaagcattaggagaaacattccaccaaaggctgcaatttgagggtgggcatgatgtaaaatatagccataagttcctgctgtacttggatttcctttttctaaagctaatcttagagcactaattgggtctatttgtgcagatactccaacgatcaacaaagggaaaaccaaacgcattccaactactgcaatcaaaactcctaaagtcaggaatgtcttttgccaggccggactcatccgctctaaaatccgtgcattaacaatggcattatccatagataaagaaatttctagcacggcaagaatgagtgtaataaaaagcccattccatccgccataaataaacgcgatgattagggcaattaaactaacaataattgagcctctgaatattttcataaatcctcttttctaaaacggccttgaccaccattttatcatacttctaagaggatacaatgagtttaatactgtgggaaataaatccaaaataaggtctgaccaataaagaataaaacaaatcctagcaagagacaaaagagacttatcaaaacaatgttaacttttgttttagcaaaaattttgattaataaagcataaaaactcaagccaatcaatgccccgagtgtatttgtgataatatctgtaatgtcacttgcaccaatagccaaaaggtattgcaaactttcaaaggataaacttaaggcgaatgaaagaattacttttgtcaaaaatgaccatttgggagcattcattccaaataaaattccaaaagggataaaggcaatgatattatatagaatttcacgtgacccaccagacatagcaaaagggacaaggtttaaacttcttgtatttactaattcaaggtaagtgatgggatgaaaagaaattttaaataaaatcagccaaataagcccgataatatataggataaataaaatttttcctaatcttttagtcatttttctacctctatcttttttagatgattatctaaaaaattttattcttctacttgatagtcaatctcaacttgctgattttcgcctttttctactctaatttttccattaaagctttctgtcagtaattctaaaaagttattgattttttcttcatcaataaaacatcttacagtaacctctgacaagaattcactatctgaaatttgtaaattttgagtcaataaaaagcgttgaacactatcatagaggctatagtcaagtttcaagataagttctcgttggttaacaatttgaactaaaccaacttcttctatcgcatgattcacacttccagcataagcacgaatcaaacctcctgcacctaacttgattccgccaaaataacgagtgacgaccgcacaaacattgataatttcttttttctttaaaatttcaagcattggtacacctgcggttcctgatggctctccatcatcactacttcgctgtatttcctgacgattgcctaatgtacatgctgaacagttatgatttgctttccaatgttcctttttgattttcgcaataaaatcacgagcttcttcttctgtagatatcctttttaaatgacagatgaagcgtgattttttgatttcctcttcattgataaaatcagtttttatagtgatagtcatgctaatgattttaacaaaatttgttacatttgaacagcatttccgtatagttaagtatgaacttaattttagaaaatctccttgggcgtcttttactagaaaaagatatttcagctttttataattttactgaccaagttaacaatgaaaacaaattaattaaaatttgtgcaatgacatctgtcaatgctaataaagtaagatgtaatcgatgtggcacgattcatataaaaaccaatgttaaacttccgattggtgcttttttctgtccaacatgtcttgaacttggtcgtgtccgctcagatgaatatttctatcatctccctcaacaagacttttcagaaaaaacttatttacgttggacaggaaaattaacagaaaatcaagaaaaaatttctaacgctctctgtcagcaaattactaataatcaaaaacgacttgttcaagccgttactggtgctggtaaaacagaaatgatatatcagcttattgaacaaattcttagccatgggggttcggtcggtttagccagcccaagaattgatgtatgcattgagcttcatcaacgtttatcacgtgatttcacttgtcaaattccccttttgtatcatgagggagattcttattttcgttcgcctttggtcgttatgaccagtcaccaacttttacgtttcaaagaggcctttgatttgcttatcatcgatgaagtcgatgcctttccttttagagataatgacatgctttatttcgctcttgaaaatgctaaaaaaattaatggaaacttgctctacttaaccgctacatctactgacaaattagaaaaacagataaaaaaagcatgaaattaaacgactttttttaccacgccgctttcacggtcatcctttggtcattccaatgttttttttggaaaaaaacattttataaaaaattcattgagcaaagaaagactggtttcccacttctaattttcgttgccgaaatcgactttggtcaagactttgccaaaaatttacaagaaaaatttccaaaagaaaaaatggcttttgtcgcttcaacaactaaaagcaaaaaacgattgtcgaagcttttcgcaagaaacaagtttcgattttaattacgacttctattcttgaacgaggcgtaactttttcttcgattgatgtttttgtcattaatagcgaacaccctaatttcacaaaatctgccctcattcaaatggccggacgagtgggacgcgactctaaacgtccaacaggtttagttagtttttttcactctggaaaatctttagccatgtgtcaagctcagaaagaaattaaaaaaatgaaccgactcggaggtttttaatgcaaacttgtctgctttgttccagaattatcaaacaaacactcacttttagtgaattctttttactaaagaataacagaaatttaatatgcaataaatgccaatcactgtttaaaaaaattcctaacgaacgttgtcctcgttgctctaaatctaactctaaaggtatatgtgctgactgtctcaagtgggaagaaaaaggaatcattgttaatcatcagtcaatttttatttataaccaagcaatgaaggattactttagtctttacaaatttatgggagattatcgattacacgaagtcttcgattcctattttaaaaatttgtccaaaaaaattcctctggttcccattccggtttctcctaaaagattacaagaaagaggttttaaccaagtaacagcttttctaaaagatagagcttatcttgatttgcttgaaaaagaggatactgtcagacaatcaagtcttaatcgcgagggacgtctatcaactagcaatccttttaagttgaaagagggtgaaaaaataccccaaaaaatcattttgattgatgatatttatacaactggaactactttttatcatgcaataaaaaccttaaagaaagctaatccgattgaaattacaactttttcactctgccgttaagccttcacttagatcaaatataccgtcagtaaataaaaaaagcttttcagctttttatcatttattaacttttagttccgtccattttataatatttaaatcactaaaacgctcttgccatttggctaccttattttcatagagttcttgattattatctttatgataaatcgggcgaatcgtttttgtaaatatatcctctataccataaggagcaaatatagtaaactgatcagaatttccacttattccgattgcatgaacagtagcaatccaacgctcaatcgcattttcggtgttttcgtatggaatttttttactattttgccaaagatgcatataggcttcattgtggacatcaaaacgataaggaaatttttccgacaaagatttttctagttgtttgtcattactgatcgaatctataaaagaaatctggtcatcaaaatataccaaatcgatatcatgaacattcgtcattaaatcatttttatcaagataattccagacggattgaaagacactccctgcagccacataccaatttgataacttcagttctgaaatctcatctaaaatcatcattaaatctgagttttttgtcaagatgtctaaaagttctttttctctattcataagtctctccccagaatcagaaaaacaatgtccaaattttaggtaaaaatacaaagagtccaacaataagagcaaagccagaaataacaagcactgcccctgcagccatatctttagcccgtttagcacgcatataaaattgataatctgaagctaaatcaacaacattttcaatagccgaattaaaaagttcagccatgaaaactaagaaaatagaaagcaagagaaataaccattcaaattcagaaatttgaaaaataaagccaaaaacaattgctaaaacagccgctagggcatgttttctcatatttcgttcttctttaaaggctgtccaaattcctgtaagtgcaaactctaaactcgaaagtaaatttcgatttttccagcgggctctgtccttttgaacaggcgtttttcccttatgaaaatcatttttcttaaagagttttacatctttatcgtgtgagtccataggcagttaaaatctcctcttgcaaagcaaacatttctgactcttcttctggcgtgtaatgatcgtaaccatttatatgcaaaaaaccatgaactgctagccaaccatactcacgttctatcgaatgaccatagtcggcagcttgttcggcagctttatcaattgaaatgaacaactcaccaataaatggatccatttcttctaataactcttctggcagttccatatcttcgtcaaaaaagaattctgactcatcaggcttatattctagtgagataacatctgttggacgatcagtttcgcgatactgcaaattcaactcatgtgatcgcgcattgtccacaaaagtcacagacatttctgttgattcttttaaatctaattttttagcggcaaacgctaaaacttctttagtttgctcaataatctcacttggcacttggcctgtttcatcaactaattctacgtacattttattccttatttatattttattcctgacatatctgtcagaaagtagctcatgcgctttccatttttgcttatttatcctagcagtcaattatttattattatcagtaactccgctatattttttttgcaacatttcttgacaaaatgataagatgggtgcttttgtggcaagcaaaatttcttcaggtaagttatcaaaagcaaaccattgacaatcaagaacctctgtttcttctaaaactaattcacctgaaaaatcattacaaataaaaacagtatcaacaatatgaacttcatcaccattgggatagaaaaaatgttgatcagctccagaagcaaccgtgtataattccatatacccagctgacaaacccacctcttcaaatagttcacgtttagcagcttctgcgactgtttcatttggctctactgaaccgccatgataacaccatttcccattatcagtgcgtttttgtagtaaaacacctcgttcttcgtcataaataattatacttgcacaagctattaccattggcacatgaccaatttttttgcgcaaatccatgacatagccttcagccatatttacttcctcttctcttattcagcaataatcagcgactctatctaactttatctttttttacaaaaatcattcatcgccataagctttgataatttcggcaaccactggatgacggacaacatcttttgccatgaaatagacaaaatcaatcgcattaacatgacccaatttatccttggcatcaatcaaaccagatttaactttatttggtaaatcaatctgcgaaatatcaccattgacaatcattttagagttaaaaccaagacgagtcagaaacattttcatttgcatgcttgttgtgttttgtgcttcatctaaaataacaaaggcgtcatcaagcgttcgaccacgcatataagcaagtggtgcaatttcaataactcctcgctccatcattcgctcagtcgctgttttacccaaaatctgaaaaagcgcgtcataaacaggacgtaaatatggatcaactttttcttgcaaatcaccaggtaagaagccaagactttccccagcttccactgctggtcttgtcaaaataattcgtttgacctgaccatttcgtaaagcctgaacagccatcacgaccgccaaaaaagttttccctgtccccgcaggaccaattccaaaaacaatatcatgctgtttaacagaatccacgtaagtcttctgaattaaatttttcaaacggataggtttaccagctgcatcttttgtcagttcaatctcataaagtgccgtgaaattttcaatatcatcatttaaaaccatttttatagcaatgataacatccgacgcatggacaggaaccccacgactaactaaaacttgtaaagcttgcagtgcttttcgcgctcgctctcgtgtcagtttttcaggaccaatgatttgcaccatttccccacgataattaatctcaacagatagttgagactcaactaatttcaaatatttatcttgtaccccaaaaagaagactagcatcttcaggattttctagtttaaattcaattgaatttttagtcaaatacattatctccattaatcattttcttacattatagcacatttcatattttaatttaaatcacaccctacctatataaagaaaaactctattttaaatagagttttttatttccacgataaagttctaaaattgtccagattaataaaaggataactccaacaatcaataaaccggcaataaaatgagacaagtttagattattcggaagaaaactatcaatctgatttggtaagccaattaaattgagataagtcaaggcaataactgaaatccaacctaaaaatttaatgattaaattatttttaaaatcacccatttcttccttgctattagttagcattaacaatggaataatcgaaaaaggaagggcaaaagctagaaaaacttgagaattattcatcaaattatttattgcttcatgttgagctttcaaagtttgtcctctagtcatagagacacaaatcaagacaggaactaccgatagcaggcgagttaccaatcttcttgcccacattggcattctcatatgaataaatccttccataataacctgtcccgttaaagttccagtaatggttgagttttgcccagaagcaaggagagccacggcaaataaggttgaaagtgcacccgtttttgcaacgtctgcaagaagaccattacttaaaaccgaagggttagataatgcatcgtataaaccaaagaatgatggatcatcaattactcctgttttaaagaccgctacacccataattagtaaaagagaatttacaacaaaagcgactgtcagctgaatattagagtcccatgtcgagaaccttactgctctggcaacatcacttttatcttgatgattaatttttctactttgtgaaatagaagaatgaagatataaattatgaggcataaccgtagcgccaataattcctaatgcgcctgttaaaggcgacatcccggctactgttggtgaggaagcaaaagttcgattattaggaataaatccctcaataattcctttccaatctggattggataaagcaacttgataagcaaatattgctagaataactagaatcaaacaaataaccaaggcttcaatcttacgaaaaccaattcttgtcagtaataaaagcaaaaagacatcaaggactgtgataaaaacagctaatattaacggaatattaaacagaagatataaggcaatagccgcaccgatgacttcagcaatatcagtggccatgattgccagttcagttaaaatccataaaacaattcccagagtcttgctggtgcgcgccctgatagcctgagctaaatccatctggctgacaattcctaattttgctgacatatattgaaggagcattgcaatcagactggacatcagaataaccgaaatcagtaagtattgaaagttctgccctccagtaattgacgttgaccaattcccagggtccatgtaaccaaccgcgaccagcgcacctggtcctgagtaagtcagcaacattttgaaaaaaccaacatttttaggcacttctactgtcccatttatttcctctaaggattttccattcgtatgataaatcaatcgatgtcgttgatgttctttatcattcattatttctccaaattctaagctgaataaaattcagcaccctttatagttaagtatattttgaagttggggggatacctaaccgacagccacagtttactgtctgtgagcttttaatatgttttgcggtaaattatattcaatcaacatcacgcgcgtgctgtgcttgttctgtggctttgtttataatctcttttacttgcttaatggctgggttcgtgtgctgtctatcctgtcagtccatgactacaaaacacgcgccacgtcttctttgaaagcaatgtatatttttttagctctcttgataggtatttctatgcctgcactctctaactccatatcgacacgataccacgtaaaaccgttataacctttatatcttaactctatgactcttttttctgatactgttaaagtattgtataaagttcctaaaagttcaagtgttcgccttaattctatcagatctttatcttcttccatgcgttctttgtttaatgttttcccctctggctctgctgttcctttataagctgttctaattcctaagttgtcctgttttaccctgtatagataacggctctcaattgcttttattttggcttgtgtgcgtccgttgacataatcgcttataattctgtctgttttatctttcacgcttccccctctctgcttgctaagattctaagttcttcctctgttagattctcaaaagggttactaacttttaaactccctttgatattaatgtcttgggcaagtgggtaacgttttaagatttcagcactcgccctaataacttgattagtatcagggcgtttgtctatgacgtcgccctctgctgttatcgcttgctctgtatgctctccgcggactatctgcgttaatatggccaaagtttcctctgcggttgctatggcattgtttgaaatgtcttttaacttgctatcaatgtatttttttaagtcaggtttagtcaggttttcagctcctatcgacttcgctgttttttggctataccctgcattaatagccgactgcgtggcgtttcctgtttttatatattcatcacaaaatttacgttgtttcggtgtcattgttttgcctcgtttctgtttatatgtccttttgattataacaaagtaaaaagacaagttttataagttttataagttttatatttccacataacgttaaaaaagcccagtcattgactaggctctttttgtttattcttctaactcaaagccgattaattccgcgatattatccaaagcgttgacattcatatctactaaatcagacagtttgataattgtgccgtctgtatatcttgggatatagttagggtcatcagtaatcattgaatcgttaagcgagtataagtcttgtacctgtgctttgagtgcaagctcttgcggtttgttctcgctctctgctgaaaggctcatttcattcaatcctagcgctttaattaaacgctcgatactatccgtcagcaagtccgcaaaaacttgcgtatcattgcctgatatttcatgaggtgcaaaggtcagctcttgcatttcctcaataattgattttactgtttcctgtggttcatactcttgcggttctgtgtcgctttcgtttgcatagatttcaatagcttcaaaatcctgtttgatgttttttaatgcttcttgacttgcttgctcgtcaatgctatcgctgtatttttcaatcaatagtgctttagctttgttcaagtgttttgtaatttcgttgttcattttattttctccaattttctatatatagtttttttatgtcaacaattcaatttgttggacagcgtgcttttttcatgtttttgttttcctgtgataatttctagctagtaagtgttttgacagtaacatagtaacaaagtgctacaaacggcttaaccatagggttaaagctgtaacttctaacagtaacgcgttaccgattttcagtaacgttttttattttttcttgcgcaaatagcctttagcaacctttttttgtttgtcgtcatcccaatgaaagagccgtctaaaaagctcatattcctccgctcggtgtaaatcaatggctctattaaaacctgcgctattcggtctttgcgttgtttttatccatttttctttaatgtggtcaggtagtttattttcaaactctcgcttagtaaatggcttaataccctcatcttcacaccatgctcgatataaggcacttagaaaagtagtcggtagaaaatcactgacaaactcatcaaatatatcatttacaaatgccagtacattgtcattgctgattttgaagtcatctaacagcccctttgtggctttaggttcgtcaaatttatcaaaattaagtgataaggcgattttaagcacgtactccaaaacgtctttgcgtttaatataatcatctttaattttccaattgtcattatctgcggtaaaagacttttcaaaaggcacgatgagcaaacgtctataagttccgttcgacttgtttctgaacttaggcaagaaattagtcgattgaataactagcttgttaaatactgctaaagtcggttgttttacttttgcttcaatcggtactgggtcgccagtaactacgctgaaatagttccctgcattgtctaagtaactaacttggctatcatctccaataatgcaagttttaccaacgacttgagaaagggcgaaccgttcagcaaattgttcagctttgacacttgccacgttctcgcgtccgataaggttcatgataaggctctgaaatgtccctttgccgtcatttcctttaccgacaagccaaacgccttttcgataagaatagtttccgttggtacttgctgaaatgacttgccataacaatttgacaagctcttcatctccgctcattaaatcattgagccagtcgtctatattccagccgttaatattaggcgctttggctttagcgttgtacttggtcgcaatcgttgaagtaaagacataactagggctaaatggctctaattgttgcgttttcttgttgaaaataccgttcgccactgggataagatgagcttctgcggtttgttgcttaacctctgctaaggtttcaagtttgaataagacttcttttgaccgtgcttgactataagacggctctagccaataaatgagccgatgaaagaagttttcatttgtttcatatattcctagttcatgattgtaaatgcctaacagtccgctttggtggtctagtttgatgactttgagcgtcttatagatgattcttgctgtttctaaagggcttaatgatttcggtggctttccgtcctctttaggtgtgcttaaaaataagttacggtgttcaaagaatagctttctaaccgctctaagcgtttgagtgtttgctttgacatagtcagggctattaatgatttctttttcttgttctagccagtctttcaaactgtcttgataacctgcgacatcaacgacttttttgccgtcttggccataatctgtgaagtcctctattttaggtttcggacttcttacgttttcctgtggcgtttctgccacaagtttatctaattggtctgtcatgacttcctttctatttcatcttgaatacacttttccaaatagttgccagctcgtcatcaggtaagggcggactggttcgattgttaaaggttcgcaataagtccatacagctattattatcaatgcctatttttctccagtagtgaagaatacggttcgtgtcattgtttcggttgccttttcgtgcgccttggttgaatagctcccacatttcagcgccataagttcggctacttgtgccagttgttgcgcgtgcctgcggtcgttgtatcatttcaagtaaccagtcagggcaatcgcaaagactatcgaaagttaagggcttattggtttcggtatcattcaaagggatataatcgccgtctgtgcgtttgcttgggtagatgggtgtaaagtgtgtttttatctccacgccgtccgctagttcattgacaatcggctgattaaatagctctttcggaactttaaagaaaacgtgtaagccgttgcctgtgggtgtcttctcgacataggtacttaatatttcgccctcgctgtgttcattccacaatcgactgaatacagttctgccgttctgtccgttttggtgctggtctaagtcaatacaaatcaaaccgctattcctaagattaatcatgatgttgcggttcggtatttcatcaaaccacgcgctcactgtgatttcgtcaagacttcctgaagaactcccctttataattgccctttcgctttttccagcaggaaaaccagcgataacagaaaaaccgcgattaatacagtttagggcttgttctttgggtgtcaatagtcaacctcctcaaagagttggtcaatccaatcaagttctgcaagggtgtagccgttgactgcattattaatcgcaatgcctgtccgttgttttttgataatgccagctctgcgctcgtcttcattagttgggataaaataaccgttatcaattgaaccaatggcgcaaccttgcttatggaggtactcaatgcgaccttgtaaggtacgaaaatcaatgttaaggttttgtgctaaatttctacctttgacagctcggtcaattcctctatgttcagcaagaaatttaataatgttttggtcaattttctgtaattcgcttaatttcattttttagtttcctttatttgtaatttcatgatagccagttgcttacctaaaatcggcactgattgcgtgcataagttgcttttcactccgctgggtaagattatgcctgtactctcctcaaactgctgtatgaggtcgtatttgaccgctcgtgcattgttaatcatcttaaacgggtgtttacctgcttgtctaaaactattccgtccgtaccgttttatagtcgtgtagccttggtggtgttcaatcatttcgctacctcatcaaataagctgatttctccgccctctttttcgccctcaaatcggataccgtgcttatatttacgaactttaaaagaataatcaactgtgcctgtgtttgcattcaatgggtctaatttctcaatctgcttgtctgtaagttctgtatgatagacttgtaaacttcgcatacctacgctatcaataccagccacatagggacaaactctaataatatttgtcattttctcaatcctctaataaaatttgccttgcctgacaagttgctatgtatctatgatgatgaacttgcatatatcatcaatcaaatagtaaataagtgaagttttgtatcttggtttatagcgattcaagccgtgcttttcccaattatcaagagttccgtctgatatatctaagtcttccataacacgctttttagagatataaggtaatactcgcttttcatttctgattttgagttgtgtaccaagatacttattaaataaatgaatgactttatcaactaagccacgggcaacaaggtttattaaagtgtcatcattcattttttgcctccgtttttacgtttagagataacttccataactgcgtacgttagtttatcttcactaattcctaactcatgagaaagctctgaaacatcttcggaactaataacgtcaaaggctgtgagtgctttgtgcttggtttttctacgttgtctttcatggcgaataccacgattaaacgctacgtcatacaggtactcgtaaacaacaacacgcatccagtcccgccaattttctttattggcattgtgatagtccatcaagataattttttcctcgataatgtcagctaattgcataacgccctcggtaacagatcccttatattctgtttgtttgatttcctgtttaatacggtagcgttcagcttgattattagtgattttaagttttaaagggtgcttagaatctaggtaaaaaagtttgcttgtgattatccctaagactctatctttcttatcgaatgaaagtgttattcctgccctacttttataggcatttaattcaaatgttttaaatttcatgctttaccccttaacctttcgtcatgtatctagcgtatgaagttacgtttctaaacgtgcgttctaagcctcgtttgttccaaaccgtccaagtatgagtgcttgggtcaaactgtacttgtgcgcctgattgtgtgccgtgagtggggtagattacctctattgtgttattcatttttagctccgattctattcaattattgatacaccgataatgttagcaatggtcataaggtaatcactgacataatctgataagtcctgtgcgttacctttggtaataaagagagtgcctttatcgtctaactcgaaactttcataagttccgcttgcataatcattaacagctttgtagatgttttgtatatacatctcaacttcttcgatatgaatttctagttcttcaaacatgattttacctttgaatttctagagctaatttgtattttagggtacaaaaaaactctatttctcgcactttaaaaaatgcgtgttgaaaaagagttcacttcttgatataatttatttatcgagtgaaactctcggtgcggactacttaacttcaaactttggtcggggagaagtttagtagttttttattttacttttaatttgtttacgccatgacgtactgcttcagctttagttatccctttttcttgggaataatcgctgattagttttgcctgttcagcattaaaacttacagacatccttgtttcttttgggtcgttggtaggtcgccctacacgtcttttttcttcctcagtcaaatcctgcacctttcttactaaaattcgtaagtcaatcagtactcatttgcctaagctgtaacccttgattaaccttacatatataattatagcaccactaattaaatatgtcaagaattatagcaccacaaattaaaaataaatcatttttcaagaagttcactcttattcaattgtcaaagttcaatcagctttgattttgctgataatttttgttagaatggagtaaagcaaaactcgtaaagagcttgccttactaagtttaaaagtcgttttgatggggatcagttacggctttttttgttgtcattttggatttgattgctgttttgataggttcataatcagaaccagcttcaatcattgctattgcgatactttcaagcattttataacgttccatttcctctgaatttaagaggtctaggagcgttttttcttttcgccagtctgtatctctagcttgtatctgctttttagttagtcctgttacagttgtagcaagcaaacttctaataatggtgtgccatgtattgccatgacgtggatagtgtacccattctgaaatagattgatgaagattaacaccttttggtttctcgactgctcttgcaatctttcgtgcctgaagctctttttccatttcattaaatcgttttacaagagccagtttaaaagctcgaactggttcggtattgtctagccatgtaataagtaacatagcttggttacgattgagttgataaatttttgttggacgtccaccagttgaacctttaataggttttgtcatttcaaatgacaatatccctagctcttcaaggtcttgtttattgttatcaatcagtttacgaactgaaattttattaagtcctgcatattcagcaataacgacatggttagttacaacttccgctttactcatgtcaggactggttaaaaatgctaagtctttcatttatcctcgtttctacttcgtttaaagacatcgcggtcatcatgttagggcagtagtttagagccatgcttaggctgtgaaaatcaaaataaatactttgttagtaattaatttaacaaagaatcaatagcattcatgacttttttctttttatcatcagtaagttcgtcacgcatccaaattgtaaatgtagttggagcaatgccgatttcacgagcaatttcataaaatttgagacgtttatcattgataagttgacgtagtgcaatgtttttcattttttggagcctttcttttatcgctcgttattcatcgttcagcgatgtataaaatatgattatagtatagcgataatttttgttaatgtcaagaaaaagaaatctgtgttataatatctccaagagataataagaagaattgaggtaatttctatgataggaaaaaaactaaaaaagtatagactaatgcttgatttaactggaactacacttgcgaaacttgcaggaataaatcaaccatatctttcagaaatagagaatgaaaaaaaagtaccgccattcgatacttttatgaatttagtaacagccatatctaaaatatccccgttaaacgaagaaaaccgaagcagtatattaacaaatgataacttaaataaatttcttggtactgcaatcattaaagcttatgagatacctaactatccagataaagttagtatcagtgtacggttcgaaggaatatatggtgagcttgggtggatatttaacaaagattctgataattcaagagacgaaccaatggaaccgttcaagcggggaaaagaaattgattcatccccttttaaatataaagtccttgatgagttaatatattttttccgttacactctagatgataatccaatctatgatagtataacaaatctaagcgaatcggtactttatgatttggatgagacgagtttatatgattttccatttattcgtcaatcactttttgagtggtggtataaccaaattttaaccgatataacagacaacctcatgagtgatgataataaaactatagaactttcgatttctgagggcgaactactcatggaagttgaaagtttaagaaatactaacggaactttcactcccactaatttagaaaatactactaatttatcaaaagaactacttgatggaaaaactgtaacctttgattttcgctcaatcactgataaaaatgtacgtgcattacttgatggtcagttacttacaaatgatgaattgacagccctcaaatttaccttgaacggtattagatataatagacaaaacagtaaccaaaacagttattttggtcgcaagagacaaagacttattgatgagggatattttgataataaagattagttatcaacaacttcttagacttttacagctatcatcacaacgcttatgacgaggctcgtgcgttgctgtatgagctgtgctggtttgagttggtgggttaaaaaaggaggaaacatgaaactatcggactacttaaagagtattgatcacttagatgaaagaatggaaaaggctgtaattatagctgggtatgagaaaatgtttggagaacactacagactaccacaagaacagtttgctgacctgatggaattacctttgccaaaattaagaagagttattcatgaaatgaaaaaagcaatagattagaactttaatagtgctaaagtctatatatctgtgaaccttaacatttcttaacatagctaaaggttcaaaaagtaaccaagggaaaattgcctgcgttaaatggcttatagcaattcactataagcacatacctttagtattatttagtactggtaacgtcaaagatgacactacaaaagttataaaacacgcgaaagccaaggaataacaatggttgacggatataatgaaacagttgaaaataactgtatttgttagtttttgtcaagtagaaaaggatataaaaatgaaagtaaataatagcgaacaaagaggaattaataaaaaggtaattgctaaaactataattttcttatttggtttattaatacttctaatgataagggtatttttaaaaattaatttgatgccgtcaatgttcatttcattgctttttgtagtaatagtattgaaaaatcctgaaaataaatatatgaaaataggacgtatagggctcattgccgttttatcgattctctcaatactttctttagtgttgcgatgaacacagtatactatagcaagtcctaaatttagtaacgcaaaataaaaagcgcttgggcgcgtgaaaatgaaaaattaggtgttcccagtcactaaaaactggtaaggagtaatttatgaaaaataaaagtaaaaaatggtggttttgggttctagctgttttactgttccctttcttatgcctttatggcatttatcgtttagttataaattatagaacgacaggtcgaaaagtttggttagtcggagttgtcccacttgcgttagtttcattgtttggatttgtagtttatgctggagcatttagtggaccgaattcggataataaaactgaaacagctatatctagctattcctctagttcttctagcagttcaatatccacaagcactaagcctgcgaaatctgtaagcaaaagcagtagcacaagcccttccaattctaaagtagctaaaaaagtagttgctagttcgtctgtagctagtacaacggatattttaaacaaattaaacgagtacactaacgccaagtcagcaggtcctactggtaattactactgggaaaatggttcagcaagactttcagggcttgatgcaataaaagcaggagaatataactttaatgctgatgataaagggcgttcgggagtagcacgcgcagtattaacatactcacaatatgaagattcaaaaggttcgagacaaggacaaccattagaccctccagcttggccgtcaagcaaccccaaaatcgctattacattctcactaacagaaagaacttaccacggttatttgtataatagaagtcattcaatcgctgatagcttgctaggagagggttcttatacatctaaatataatttcactactggtacacgtagtcaaaatgttggagcaaaccaaaatggaggaatgaggtatgcagaagaattggctgagaatttttggaaagctaatccaaataccagttcaaccatagattatcagacaactcctgtttataatgctaatgaaactattcctcgtgggtcaattgtagatatcaagtcttcagataatactctaaatatagaagtgatcgttattaatagtgcagagggcttagaaattgactatgcctcaggaactccgatctcttcaacaactcaaccagtacagtcagaagcgcctaaagtaagttcatcgcaagcagtagaacaagccccagtagttacagagccttcatctcaaacagtagctaatgataactcctacacaactgagggcgggtggtctatcgcagctcctggtatggtgtttgtttctgaaagcaacaagtattactcttcagtaactaatcctagtaattaccaatatatgtcacaagcagaagcctctaatatcgcgcaaccagcgcaaagagggaatcgatatgctagaccatagaaaaataaaaagcgccaaaatctcattttatttatatgtttttggtttcacttttttctgaaaccaataataggatatgaacatttttgtacaaattccccctttttccaccaattccataagtaaattactgaatcttttttacttaaccctaatacgtgcaaacctgaaccacgttaaaagctgatgaaaatataggagtatgtatatgagagtgaaaacaataacatgttacaccagcgcaaaagtttttgacgataaaattaatgattttttagtctatcttgagagaaataattttgacctaatcaatattgattatcaatatcacttctgtacttttacagctctaataagttatcaagataagaactaataatttttctcagacaatttgttactcttgataccttactgttactcttaatatagagaaaggtaacagtataaaccattgatataactacatttataatactttgttactcttgttaccgtaaataatactatatcagttgagaatttaataactctataaactaataaaccagttaactaattaatcgtataagctctaataacaatatttctcaatcctcgtacatgccttgcctgacattagtacaaaatggaaaggaagaaataattatgaatattaaagaatatataaaaaaagacggtacaaaggtgtaccgaactaacgtttatttgggtgtggataatctcacaggtaagcaagtacgaacaagtgtaagtgccaatagtagaaaaatgtgtgatattaaagcacgccaagctataaataagtttatcaataatgggtctacaattgcaagggaaaaagtggtttttgataactttgaatctttggctttgagttggtttgagagttataagctgacagttaaggaaaatagtataagtgttgctgataattacttacgtaattatatactacctcctattggctcgtataagctctctaagataacgccaatgttattacaggaacttgtcaataaatgggctaataacgcaaatacagccgaaataatcaacggtaagcgtgagcgaggaaaatgtaaggattataagctacttcttaactttataaaacgtatccttgattatggtatgcaattaggagctatcgaggacaattcagctataaaggttttccctcctaagttaaagacaaggacagttaaaaagattaagtattttgataatgaggagctaaaacaattcttgttgtatcttgatactttagaaccaagcacggacaatcgaaagagtaagactttatacaaactacttcttgcaactggcttacgtgtaggggaggctatggctctttcttggtctgatattgattttaacaaccattatctcagtgtgtctaaaactctaattcaacaaagcaatttgatacaggatagcgcaaagacaaaagagagtaatcgttctgtgtttttggataacgacactcttgaaagtttaaaagaatggcggaaatatcaaaatgacggtgctatatccttgcatgactctttagtcttctcatatcatcaaaaaatgaggtcttatgaaatagagagacagaaattagtgagacacttcaaaaatgctggagtacctaacattggctttcacggtttccgtcatactcacgctagtcttttgatgaacaacgatgttaaccctaaagagatacaaagacgattaggacatgcagattatgctatcacaatgaatacatatagccaccttgccaaaagtaaagaaaaagagaccgctgaaaagttcagcagtatcttaaaagcattatgattttttggtcgaacgtagtaaaaagcgttaaaatttttgtttataatctctacaacccttatatatcaaggatttaagctctatattttaacatagttctactataccacaatcactttcattctttttattcaaattaattattgtaatttttttaagttaaatagaagaatcatgttataataattctagtacatttgaaaggaaaaattatgattatccgagaactttgccttgaaaacttcacaaaagtcccacaagcgctccaagctggtattgaacgaattgagctttgtgacaatcttgctgttggaggaacaacaccttcttacggcgtcattcaagaagctgccgaatatgttgccgagagcaaaacaactctggcagtcatgattcgtccacgaggcggcaattttgtttataattctcatgaacttaaaattattgagactgatacactcaaagctgtcgaagctggtgctcaaaacattgtatttggtgccctcacgactgacaataaaatagatagtgatgcactcgaaacagtgagcattgctgcccaaggacttcctattacatttcacatggcctttgacgaaattactgatcaaaaagaagccattgaccaacttgttgaatttggaatagataaaattttgatgcatggtgggccacttgaccaaccattagatactgacaaaatcaaatcactcattgattacgctcaaggaaaaattaatattatcattggtggaggtgtcaatgctgaaaactttgaagaacttgctcaattgactggaacaaactacgttcacggtacaaaaattattaatttataaaaaaataatgacagaatttctgtcattattttttatttattttttaatcggaatctgacatagaacttcgtcagcaaaaagttcaccaataaaatcacaagtgtcaagaaaaacggtcgaacaaaaattaatgatagcactaattcaacaatcgtcacaaacatcattactctaaaaataatcatgcgtaagccggcagtttttaccgcttttttcaatggatagattctcgtcaaaagttgataatcaaaagtcgtttgtaaagataaaagctgaaaaataagcaagtaattaaagactaccaccataacaatggcaacaataccattcttgacaaaaatcattgataaaattgacaaaataaggaggcgaatcgttaagcccagataatctcctgaccgtaaaaaacttcgtgtaaatagatattcgtaagttctttttgtttttgtcagtaaaaaatcaaggtattttcgacgatgactgtgcgatttgagccctttaacatttgtaaataatgaaaatagtcgcaaagttcccgtttttcgcgcttcctctaaatcaatcaatcccgaccaatctaaaagtccactgttttgaaagcgccaaatttgataagccagtaagccagctttaatcccaacaagaaccaaaaaccagagaatcaagaaaataggattaaattttaataaaggtgccgcaatcagaaccaaaagccctgatacaattgctggaagaattaatgaacgaatcaaacatttaattaaataagctcgaacttccaattcttttgtcagtaaaaaaaccttatcgggggcttcgataaacgttgctaagcgtcctaaaacttggctaagcaaactgacaaaaaccaccaaaataatcttaccccacaaattcaaatgatgaacttgtaaaaaattaacatattgcaccactaaagcgcccaataaaatcattaagaacaaaacaaaatgatcattaaaaacatagcgaagatactttatattttgttggtaccaaagtttacgacgttttttaaaaatttcattcatgcgtctttcctgcctctacaacttctttagagtttggaatattcccctttgttaaagcaagataaatctcatctaagcttgcttttggttgattaaattgactccgtaactcctctactgttccaaaagcaacaacctgcccttcatgcagaacaatgaatttatcacagaatttttcggcagttgctaggatgtgggtactcatcaaaatcgaactccccgtttttttcatctccatcatcaaatcaattaaatcctgaatggcaagagggtcaagtcccataaagggctcatccacaatataaagggaaggttcaaccaaaaatgcgcagataatcatgactttttgcttcattccttttgaaaaattcactgggaaccaatccaacttatcgctcaaacgaaaggtttcaagcaacttctctgctcgtttgaaggcaaggtcaacagaaatcccataagccaaggctgtcacctcaatatgttcacgcaaagtcaactcttcatacaaacttggtgtttctggaatgaaaccaatttttctgcggtaaccttctaaatcttgctgtaaagtcaagccatccaattcaatctgtccagaatatggagttaatagtccaataatttcttgaatcgttgttgattttcctgcgccatttaaaccaataagtccaacgagctctccttctttaatttcaaaattaagttcttttaagacagggtatcccaaatatccacccgttaaatttgttacttttaacatatattcctcttttaaattctattctatttccattagtgaagtcattcttaaaatacgttgtgcataacttggactttcatcatcttcggcaattacgccttttaagtcatcaagattatcagtgataatcccgttcactccattaaacatttgttctctcatatccgtttcatcgttaactgtccaagcgaaaaccatttgatgtttagcctgtgctttgtccacaaaactactggtaagtgtcgtcgcttccattgtataagcagacattttagtttgcggaaaaagaagattgaaaggaaggataaaactgactttaatcttcggattaattttttgttcaatcaagagcgcattataatctaaagaatgaatcattgctttatcctttaaaagtcttgcaccatatcttttactaaagttttcaaccatcttcggagagtctaatggagatactttaatctcaaccaataatttttgatttattttttcagcggccgataaataatcatcaaaacttggaattaaagcttttttaccattttcagaaacgactgtatttgtcaattctgccaaggtaagtttttgcggcgggctatcaattccagctaaatcttttaatgttgggtcatgaaagacgacaaattgatgatctttcgtttcttgaatatcaatttcaacataatctggttttgcttttgctgttgcttctaatgctgggatagtattttgcacaccattttcctcatcaactcctcgatgagaaattgtcagcggaacagtatccataaatccttctacataagtccaactcactaaagcaaaaagtaaaatcgtcaaactagaaaaaatcaccttatacttcatgcggcctttaggtgctattttaggaacttcaaagctttccatttgagcttcattaatcaaataactaaaaagcatcatcaaactcaaagtagaaataatcaagcttcccaaccaaatcaaatccaatatagaaactgccccaatcaaagcaaaggaagttttatcaagataatcttgcgcaaagtagccccccataaaaagaagcccctgcattattatactaaataaaccgataagtccaaaataaacagaaagtctaaagaattttctaactcccttggtccgttttaaactctcttttatcgccaatttcaagggttgaccttttagaatcataagcggaagagttaaaatcaaacgcgtgctaatccagaaagtaatagcataaaataacactaaaatcagcatattttgccaactttttaggaaaaattcaagtgtaaaaaccggaatcttgatttttgacaaaagcggtgtactaaaaacatatctcccaaaaggaataattagtagaaaataaaataagaaaaagcctaactgttgaattttaacctttttcgcagatgagacaacttccttaaacaaatttttcaaagtcaaacttcttgactgaatcaatcgaattcctttaaattgaacaataaattgaacatagactagaaaaattaataaaaataaaatgattagaagtcccagaacgcccaagaaatgattttgaatcaaattccccagattattataagaagggaattcctgacagacgcataataaggcccgagattgattctaacagaggaataatcacaaaagtaattgctaaagttgttcctataaaaaccgagatatattcaaaccaaaattttgaaaactctcgtaaatatttaaaaatcaaaccaaatggtcgattagctttttttctcaccattacttttaactcccatcctttatatccttccccacctctatctaggcggattaaattttattacattatatcaaatttataaaataaaaagtgcttaaatttcaatttataataaatacaagttttattcattatagcataatttaaatttcctcttttcaataatcgctcttacttttgaaacccccgttattattactgggttttttctactttttatactataatctatagtagattataaagttttagacttctttatcagaagttaccgaataatgctggaggaattatcgaaatggaagattgtattttttgcaaaattattgctggtgaaattccaagcaccaaagtttatgaagatgatgatgttgttgctttccttgatattactcaaaccactaagggccacacattagttgttcccaaaaaacactaccgcaacattctagcgatgacagctgaggaatctgctgaactttttagtaaagtccctcaaatcgccagtaaacttgtggataaacttcatgctaaaggtatgaatatcttacaaaataatgaagaaatcgctgggcaaactgtttttcataatcatattcatttgattcctcgttatgatgaaaatgatggtttcattgcaaaattcacagcccatgattatgatttagccgaaatagccaaacaaattaatggctgataaaggacgtgtctatgtttgaattatttaaagacttaaagaagttaatgactgacttatctgaggaagtcaacacaatgaaaataaatcttgagagagtgcaagaagaaagcatcaaagcagaacgtgtcggtcaagatatacaaaagaaagttaatgaatttcaagtatccattcaaccaagagtggaaaaaattaatgaacttgtagagcaaataaataaaagggttgaataatatcagcccttttatttatttgatttttcttgatgtttataaaattgtcgcccccaaaaaatccccaataattgagccaacacgaaaccaacgatgattactgaaaccttttcgacatcgtgatgttgaatataagtaaagacatgttgtgaaaaatataagacaagaataaagaaaatattaatgatattcatgccaataattcgtcgataccttccctttgtactttcccaaaaactaataaaaaggagaataatggtaataacttctaacccaattagagtaagatttaggacttgaaaaaggtaggcaattgcaaagataattgttgtgtaagcccatagaaataataacatacctaattctagcatgtttttttagattctacaataaataaaaaaaagagaaaattaattttctctttttatttttattagaatgaagctgaatcaactttaacaccaggacccattgttgttgtaacagaaaggtttgtgatgtaagcacctttagatgcagcaggtttagcagcagcgattacagtgttcaaagctttaaagttttcaacaagtttttctgtgtcgaatgaaactttaccgattggaacatgaacgttaccagctttgtcagcacggtagttaactttaccagcttttgattcaccaactgctttagttacatccatagtaactgtaccagttttagggttaggcatcaagttacgtggtccaaggacacgtccaagacgtccaacaactgccatcatgtcaggtgttgcaataacaacgtcgaagtctaaccaaccaccgttgattttagcaacgagttcgtcagaacctacgaaatctgcaccagctgctgtagcttcttcagctttcgcacctttagcgaaaacaagaacacgagcagttttaccagtaccgtttggcaataccattgctccacggatttgttggtcagattttttaacgtcgatgttaaggttgtaagcaacttctacagttgcgtcaaattttgcaaatgaagtttcttttgcaagtgctacagcttcttctacgctgtatgctttagttgcgtcgattttttcaatcgctgcgcgcaatgctttactttttttagccatttctattttctccttgtggtaatatcggttgtctgtcttccttgttgtctttgaatattcgctctgattcacttaaaggaaaaacttttcctcaaaacagaacctttacactaaacgtcggacgaagaagaaagctctgctttcctcatttgcaaccttgaaacagtgtttcaagccacgttccgcaccgctcagttgagccaatagattcttttttataacaacaagcgtaacagccttccactaaatgtgtggattgcatgtgtgactttttctgaatttacaaaatgtaaatctcgaaaatttagtcgaagtacgaagcgacaggttccgaagcctacctaagtaggtgagggttctgtcaacgaagtaattcgtctaaatttttagtcagtaacagtgaatcccatagattttgcagtaccttcaatcattgacattgcagtttcaactgatgctgcattaaggtcaggcatcttaagttctgcaatttctttgatttgtgcttttgtaactgaagcaacttttgttttattaggttcaccagaacctttttgaacgcctgctgcttttttcaaaagaactgctgctggaggagtttttgtgatgaatgtgaatgatttgtcatcataaactgagataacaactgggatgatcataccagcttggtcagctgtacgagcgttgaattcttttgtgaatcccatgatgttaacacctgcttgacccaaagctggaccaactggtggagctggtgttgctttaccggcagggatttgtaatttaacgagtttttctacttgtttagccacgataaattctccttatattttgttttcgtgatgtggtatgatgctgtattttacagcttccacgccttatatgtgaaaattcacatacccgagtattatatcaaaaaaagagcactctgtcaagtactctttagtttataaatcttgttttctgataagagagagtccgagtaatccaaaagcaacgatttcaactactgagaagataatcccaatcaaactattatttgacatcatattttgactatcaatcgatactacgtttatcgaactagtaaagatggtgaggacaatgcctactcccattgcaatacctaaataaacgaaaactccccaaaatttgcctcgggtcataatgacaacgaaaaacaaaataacaatagaggccagagcacctgcaaacgaattaagcaagaccatccaaacactcctaagagaaagagagcgggaaaccatactcaaaaattcacttagttgtcgggcataaacgcctaaaattaagaaaaatggaataatcaaaattgtaaatagggccagtaaagtcgaaagaattgtcgaaattaatttaataaaataataggtcattcgatttactccagaagcaatcattaaacctaaagctttattactataatcaactgacaatagatggaattgataaatgatttgaaaggcccaaattccaagtcctaaagctaaagtgaagaaaattgttaaagctgccaagacagctgttccggcactattatggctgtatccagaaactgtttgtccgataagattgatgattaaaattgaatcaattaaagctagaatcgccataactccgatgacaatcaaccagcttttatcacgaaaatttcggtaaaactccattttaaatatattttttgcgttcatcagttgacacctttcttgataaattcagcaaatttcgattcttttttaatactatcaaagtttacaccttcttcaacagcatgacggaaagcaatttggaagtcttcagggctactgtcaaacttaattgtattttctttaatctctacttgaacacctgtctttgtcaagaagtcggctaagacttggacatcggtcacagaaaccgtataagtcaagacttcttgttgatttttcaaatcaaaagtagctgtgaaatcgccattagccagaagataaactttatcacaaattgtttcaatgtcttcttggacatggcttgaaatgagaatcaatcgtcctcttcctttgagttcaagcaagtaatctctaaaccactcaacagattttgcatcaattccacggaaaggctcatcgaaaatcaaaatttctgcatcattcataactgagatgagtagaattaactttttcttcattccaagtgaataagtagcgacttttttggataacatttcaggggttaaatctagtttcttagctaggctgagtgctttgtcctcatcaaattctccgcgcaaaccaccaaaatagcgcagattaaatagacccgtgtaacttttgtaaagttccatatcatcaagcatgataccaacttttgcaagcaatcgcgggttttctttgatttcttgaccatcaagttggatatgtccttcatagtttgtgataatatttgtcaaagttttgaaaaaggtggttttccccacaccattattcccaacaattccataaatatggcccgattcaaaagctccttcactaatagacaaaattagtctagcttgatatgagaatttaagtttttttactttaatttgcataaatctctcctttgcgtctattatatcattttatgatctttttttaagaaaaatttatgataatcattaggcttccaaataacttagccaaacattttcaaaaagggtgagattaaaataaaaaggtgcttctgtttctaaataggtcgaaatttcatcgaaatctttcgattgtttcggaaaaagtggatcttgaaaaacaagatttgcaagacgagtcgcatcgtctttctctactggtgcgcgatggcgcattaggtaattataaaatgtcattttctctttctatctagtgattcacaggattttttatttgtcttcccattgtttttccaaaaaatcatggcggattttacttgattgggcataatcttctggattttttctgtaaaatccttgatgatagtcttctgctggccaaaatttttgagtcttctcaatacttgtcacaattggagagtcgaagtttccactggcttgcaattgtgctttactttctttggcaatcttttcttgttcattattttcaacgaaaataactggacgatagttatcccctcgatcttcaaattgaccaaaagcatctgtcgggtctgtcagtgtccagtaaagttcaacaagtgtctgataattaattttactattatcaaaaataatttctactgcttctgtgtggccggtcaggtgcatttttacttgttcgtaagttggattttcaacatttccacctgtataaccactcgtgaccgataaaattccttcacgttcttcaaatggttgtaccatacaccaaaaacatccacctgcaaatattgctctttctgttgccattatttctcctttgctttagttgtcttgtgaaatattatagcatagctcaaaaaaagtagcttttagagctacctttttttactgacagaaattttttaagtcgtctttactgatagaatttgctgacgaagtctttaaacttagcttctctctttgagtaaagctgtcagtaaattattctccaattaattctgtgccttctggactttgtttgattttttttgctttcatcaggccaccgagcgcttttttaaattgtccttttgaaataccaaatgtggctttgatttcatctggatttgatttatcattaaaagccattttaccgcccattgattgaagataggccaaaatcatttgactatcagcatcaagcatttcataagcacgtggttttgctgacagatttagactacggtcttcttttctaaatccgataacacgaacttgcagttcttgaccaacgcgtgggactgagaaacgctcattaggatgaataaatcctagcatattgttgtcaggcaagtacacaaaagttcctgattctttatttcggtaaacaatagcacgtaaatcttggttttgcatattgtcataaccaggtccagcaaggttccaaaaatcttcatgccaagccaaatgaccccaaatccgctcttttctgtcaacaattaatttcacataaagttggtcgccaacttttggccattggtctttttcaagtggcaaatcatcaagagatacaaccacgtctttccctggtaaacctgtgtcaacaaaggcaccgaggtctttacgaacagctgttaccgttccccaaccatattgctcatttgttgctttttgttccaaagtcgtcagacgacgatgttcatctttatccacataaacaaaaccagtcaccacatcgccaatagcatgttcaccttctgttttgtctaaccgtaataaatcttctcctttttggagaaaatagaaacgttcactttcttccacgataatcgcagagattgtttgtccaataatactcatttgttcctctttattaaatgtaatttagagacttctagtctctcttaattaatatttccttcgtaaatccgtgacttgtcaccccaaggatgataaccgtcagctagataatgaaaatcaaactgttcataaaaatcaataaaatctgttgctaagtaaagttttttaaaactaaaagttttgcattcttctttgacaacttcaatcaacagacgagcaagcccttgctgacgaaattcttcttcgacataaagcgcacagagccaaggatataaatccattcgactaataaaatcattgctaattagcccgcagcccgcaataatttttccttcatcaacaatcaggtaccactgaggaatagaattttgactatccaaactgtgcttcaaacagtcttcataaacagaattactctcagcactccccccacttttcctgaaaaaaactgatggcttttttgagataggacggttgctctctgagttttatcacttttctcaatcttattatccttacaaaactttgatgtaaaaacggctcaatggagccgtcaatgctttttcaaattacttttttgtcggttttttagatatccaacaattctttttcttttactgatgcaagtctgtcagcttcttttacagcatcatcagtcactttttgaatctcattttcaagatctttaagatcatcttctgtgatttcttttgctttttctgattttttagcagtatccattgcatcacggcggatattacggatcgctacttttgctgattcaatgtatttacccatttctttgacaagttcgcgacggcgttcttctgtcaacattgggataactaaacgaatgacagaaccgtcatttgctggcgtaattccaaggtctgattcatacaatgatttttcaatgtctttcaaaattgatttatcaaaaggagtgaccatcaagacacgagcctctggaattgtgattgacgctaactgattaagtggtgttggtgcaccgtagtaaacaacttgaacacggtcaagaagacttgcattggcacgaccagctcggaggtgtcccaaatcacgttgtaaacttgctaatgagtgtttcatccgttcttgagctgttgtaacaatttcgtttgccattttatttcctttttctactttattaattcttttatttttactgacagaaattctaccaaaggctagccattgccctttgacgtttacgaatatgctaatgtttccatcagtaattttttaatgaataaatttactgacagctttgtaagtaaatcttattcaacagttgttccgatttcttcaccgcgaacgacgcgtgtaatatttccagcttcattcatgttgaaaacaacaagtggaatatgattatccattgacattgttgaagctgtactgtccataacttgcaagcctttggtaataacatccatatgtgtcaaatgttcaaatttaatagcgtctgcaactaatttagggtctgcgttataaacaccatcaacaccatttttagccatcaaaatgacgtcagcattaatttccgcagcacgtaaagcagaggttgtatcagttgagaagtaaggtgagccagttccaccagcaaaaataacaacacgccctttttctaaatgacgttcagcacgacgacgaatataaggttcagcaacagctttcatctcaatggccgtcatcactcgtgtgtcaacaccaatgttttcaagtgcgctttgaatgaacaatccattttggattgttgcaagcattcccatgtaatctgcctgagcacgttccatcccggctttttcaccagtaactccacgccaaacattaccaccaccgcaaacaatcgcaagttctgcacccaaatcatggacttctttaagttcttcagcaacagcttttgctgtttcagggtcgaatccgaatcccttttcgcctgagagagcttctcccgaaagttttaatagtacgcgtttatatttaatttcagccatattgcacctattctattatattttctctattttaccataaaatgctcacgaaaaaaagactaataaaagcctttataaaaactgttaagatgtcaataaaccaagatgccccaataattgaataagcaagtaaatcacaaaaagaattccggcaagccaaaaaatcaaattaagactttttaccccttgccaaaaaggatgcttaatttcttccaattctttcaatttttcagggtccatactatctatatgttttaaaatatgttcccaaagaagctcagcaggaatcactgaatcattgagtaataaatccccattaggttcaatcttaatttcatttcctatccatgaaaccattccaccaagaaataaatttgctccgtaagtcttttttaatttgctcacgtcaaaagggttcataagaaaatcaatttgctcatgaactggataatatcgaacttgtccgttatcaaattctaagcgtaaacgaactctcggcaacatttcagcctttataacttttggtaaattctccataatttccacctctactcacaataattatagcgctttcttttatagatgacaagcttttggacaaattttactgacagctttttcttaagtaaaaaattactgacagccttgtcagtaatttttatttcattatttagccgcttcgacatcacgagcaataaccaattcttcgtttgttggcacaacaagtactttcactttagactctggcttagaaatgatgccaaaagctccacgaacatttttactttcatcaatttccattccaaaccacgaaagtccattaactacatccgtccgaacagccgtatcattttctccgacacctgcagtgaaaataagtgcatcagctccatttaatacgccaaaatattgagcaataaattttttgagacggtcaatgtacatttcataggcaagaatcgctttaggatttcctttggctactgcttctgaaaggtcacgcatatcactagaaagttcagatgccccaagcactccagactctttgttgagaatatcaatcacatcttgagcatttctaagactcggatcgctctccaacatataaggaatgactgaagcatccatttcccccgcacgtgttcccatcattacaccggcaagcggtgtgaatcccattgaagtatcaacagatttaccaccttcaatcgctgtaattgaagctccatttccaatgtgggccgtaatcatcttcaattcttccagtggttttcctaagacctttgctgcttcttgcgccacatacatatgtgaagtcccatgtgccccatattttctgattgaataatcttcataatattttgttggaataggataacgataagctttttcaggtaaagtgctatgaaaagccgtatcgaaaacagcgaccgcaagtgcatcgggtaagagacgttggaaggcttcaatccctaaaacgttggccggattatgtaaaggagccaaagttgaaaggttttttatctcagctaaaacctcaggtgtaataattgtagagtcattaaaaaattccccacctgcaacaacacgatgtccaattcctgtgatttcacggaactcatgaattaattgaaaatggattaactcatccatcagcaataaaacagcttgacgatggtccacaatttcttgttttctaacgtgttcttcgttgttgaatttagttgttgaaattgagccagatagaccaatacgttcaaaaatccccttagcaatcacggtttcttctggcatttcatagagttgccattttaatgatgaggagcctgcattgacagcgagcgttttttccatacttactctccttaatgtatgcgttttattcttaaaattatatcatactttagagttgatttcatttctcctctatcaatgattcctacaactttgtatcttgctgtcatttttaaaataaaaaaagatcttgtttgatgacaaaatcttttgatttattattttttaagtgcctcaacgtcgcgagcaatcacaagttcttcatccgttggtattacaaaaacttttaggcgtgagcttggttttgaaatttctccctcaacaccaaaaacatttttttcaggatctacttcaataccaaaccaagtcaatccagaaagaattgcttctcgaacaggaacagaattttcaccaattccagcagtaaagacaagtgcatcagctccatttaagactgccaaatattgaccaatgaatttttgaatgcggtcaacatacatctcaaatgcaagttttgcatcagcatctgtatctttagcagcaatgatatcgcgcatatctgatgaaataccggataccccataaagaccagattctttattcatcatatcaactacagcttgagcatctttgagttcagaatcattttcaatcaaataaggaaaaacagaaggatccatttcacctgtgcgagttcccatcatcactccagcaagaggtgtgaagcccattgatgtatcaacagattctccgccttttactgcggtaattgatgcgccattcccaatatgcgccgtgataatttttgtttcttcaattggtttaccaagtaattttgcggcttcttgcgaaacatacatatgtgaagttccatgagccccatacttacgtacggcataatctgtataatattttttaggcaatggataacggaaagctttttcaggcattgttgtatggaaagctgtatcaaaaacaactactgaagtagcatcaggcaacaaattcaaaaaagcttcaatgccggcagcatttgctggattgtgcaaaggcgcaagagctgacaaatctttaacttgttgcaaaacttctggtgtaactactgttgatttttggaaaatttcacccccagcaaccacgcggtgtcccacaccagtaatttcagtaaattcctctactattttcaaacgttttaaatcttcaagtaaaacttctactgcttctgtatgatttggaatatcaaaaactcgttcttctttttcttctccaaatttaacggtgacgattgaatctttcaagccaatccgttcaattaatcctttggcaagaactttttcttctggcatttcatacatttgccatttcatagatgatgaaccagcgtttactgctaatgttttggtcatgtttaataaaccttccttgaatttgaaatacggttaaattataacacaattacaatttcttttgtgtttttcagccatgattcacttggttatttttttatttcaattacaaataaaaagcgtttgcatttttaatgattttatacaataaaaaattactgacagactagccaataattttttatttttacttataactttacagtttttgtaaattcttccataaagatttctaaactttctctgtctgtcaatgatgacaaaggatgagcaaaggtcgcatgagcagcaggcccttttttcaagacataaattgctttagcatcagcattaaaaagtgagcttggtaaagtaattaccgccataatacttccatgctgactaatccattcttttaaaagtgggccttgtacacttgtcagtaaatcctccggtgctaagaaaactgcaaaagcaccatctttcaagtaattaaatgattgttcaatcaacaaatgatgtgcaaaggtgtgtccatcagtagcagcgacttcaaaatttttcgaaacttcatcatctggataaaaaccgattggcaaatcactaacaacaacatcagctggctccatcaaccgtttttgaaccgcatcaatttgcataaattcggcatagcttcccatgatttcagccattgaagctgacaaatctaaaagtaaatcatcgacttcaaaaccaacataatctacttttttattaagattaacaagcaatgtttccgcaagattacccataccagaaccaaactcaattaatcgaagttcagaatttttattgagatgttcaatgataaagttgaaaattagaccaattgcatcaggagtcatggcatgatttgcctgaagaggcgcaacttgcgaaccttttaataaaacaaattgaaaaagtttttgccattctttatttgataaatttaactgacggagtttgtcattatttactgacagctcaacaattccttggtcagtaccatctaaaaaagcagcattttgttccacaaaagcatcataaaaatctgtatctaatttctcagataattttgtaatattttcaactaccagctcaaaaccttgagccactttttccatgttcatgatttttctccatttccataaaatcaaaataaaactgccaaactttgacagttttattcgctgattgatttttatttcatcaacaacttattttttctttcgacgagtgtccagtttttcaagttccatccaagctctaaccgtcacaacaatcatgactacgattcccaaaacttctaaaagaaatgcttgatggctagctgcttgagctactgcaaaagcaactatcaagacacccacgccagcaaagaagaaaatgtccatactccgccgaacgtctttgggcatcataaagatatacgcaaaggctcctaaaatcaacaggataatataaaacatctttctccttgccaaactagacaagtcctcaagcaaaaatgctcaaattacttatctttttataatcgaaaaattaatttcagtactttttataaatctttattttttcttcttagttgatttttcacgcattgctttgtccaagatttgtttacgcaagcggattgattcaggagttacttccaagtaatcatcatcaccgaggaattccaaagattcttcaagtgaaaggatttttggagtgttcaaaacagatgtagagtctttatttgaagaacggacgtttgtttgttgtttcattttagtgatgtttacagtcaaatcattatcacggctgtgttcaccaacaatcatcccaccataaacttcagtaccagcgtcaacaaaaagttgtccacgttcttgaacataacccatagcatatggagttacttgaccagagtccatagaaatcaaagaaccacggtgacgtccaccgatttctcccttaacagctggaagatattggtcgaatgtatggttcatgattccgtatccacgagtcattgacatgaattctgttgtgaatccaatcaaaccacgtgcaggaacaaggaaaatcaaacgtgcttgaccgttaccagtaacttgcatatcaagcatgtctcctttacgttcagagagcgcttggatgattgaaccttggtattcttcaggagtatcgatttgaacacgttcaaatggttcgcaagctacaccatcaacttctttgatgataacttcaggacgtgaaacttgaagttcatatccttcacgacgcattgtttcaataaggattgacaaatgcaattcaccacgaccagaaacaacccatttatcaggagattcagtattttcaacacgaagtgaaacgtcagtttgcaattcagaaaccaaacgttcttcaactttacgtgatgttacccattttccttcgcgaccagcgaaaggagagttattagcaaggaaagtcatttgcaaagtaggttcgtcaatgtgcaagattggcaatggttctacgtgatctgaaggtgtaacagtttcaccaacgaagatatcttccataccagataaagcaatcaaatcaccagcttttgcttcttggatttcttgacgatcaagaccgaagaaaccaaaaagtttagttacgcggaagtttttagttgttccatcaagtttagacaaagtaacgctgtctccaactttgattgttccacggaaaacacgaccgataccgatacgtccaacatagtcattgtagtccaaaagtgaaacttggaattgcaaaggttcatcagagttatcaactggaccagggatatggtcgatgattgtatcaaaaatatttgccattgtgtgttcttgatcagctggattatcagacattgatgaagaaccgttgattgctgaagcgtaaacaactgggaaatccaattgttcgtcatcagcaccaagttcgatgaaaagttcaagaacttcatcaacaacttcagctggacgagcagatggtttgtcaatcttattaacaacaacgataggcgtcaagttttgttccaaagcttttttcaaaacaaaacgtgtttgaggcattgttccttcataagcatcgacaacgaggacaaccccatcaaccattttcataatacgttcaacttctccaccgaagtccgcgtgacctggtgtgtccaagatgttgatacgagttccgttatattcaactgctgtatttttggcaaggatagtaatcccacgttcttgctcaagtgcatttgagtccatcgcacgttcagccaattctttacgagcatccaacgtttgagattgttttaagagttcgtcaaccaatgtagttttaccgtggtcaacgtgggcaataatagcgacgtttctaatatcttcgcgtaatttagtcaattttatcataccttactttcgtatatatctaacccattatagcacacttttttaaaagctgtaaatgcacacgtttacaagcctagcaaagacttttttagctaaaaaatgaaaactccaaagaaaattttctaaggagttctttatttttttataattaataaaatcgctaagaattacccttctttttggaaattcctcatttttaaagcatagagaaataataaaagaaaagcaaataaacccagtaagacagcaataatatatccagatccataaaaagttagaaagatagaaagttgagccccaaaagtatccccagataaactatgattaaaaataatcatagatggaaaagctataattaaaaaactgatgtaaaaaattagactagcaaaagaaaaatagacactaaactttgtttttttataataaatgagaaaaaatgagataagtaacaacaaacccaaaataaaactataaagagggaactgatgaaaaagaaaataaaagaaattttctctactttttttataatcaaagttcgtattcaatttattctgattaactgttgctggaagaaacatcgttcctagccagatgatgaacatgagtagcatttgccaaatttttatcttttttatcctcatttttactctcctttgattttatagttatctattctctctttctataagcatccacataaaccaaaatattaaaaactaaaaacaaggagaaactgataaaataacctaaatgataagtttctaacactatcattcctctttgaaatcccccaatcaaaatttgatttaacaaaagagcaccctaggcacaaaggacagtaattgtgattaaaaccggaattacccttttatatttcacatattgactggccatcgtgaaataattgaacagtagcacaattatgatgataaaatataattcaacgttatattttatagcatattgaaaacccaaaagattaatactttcaaagctattatttgtagctggaaaaaacggaagaaacagactaagtaaactgataataaatataataaatcttattatgagaatgatttatattatcgagtgctcatttatcgcttcctctataaagtaatccttaactgtattgattctggaaggaaagaaaaagctcaggaagtgctcgatatttccaaacagttctttatgcccggtgatgtgatgagtcgtgtcattattaattatgccgaatctttttttgtttattattatgttgataaacaaaaaggtaagaggcaacttcaagacacattaaaatttttaaaaaaaataggagccgaagattttcgcaaaacactaaaaatgcaatatgataaaagaataattagagaaaagcccaatgaaagatgaaggtcgtcacgtcaaaattttgggctgcagaataaaaactaaacttggactaaaaacttcatatttttagattaaggtccaaaattccatgtgtgattattacatgatgttacaattgaaaaagacatataaaaaccgttctttaaaatgaacggtttttattttttgtttaaggtctatgtaatacagctatacaaagctcttttgttttcaaagcattaaataataaatcaattttttagtcaaaaaaataatattacaaagctagaaagatttttgttttgttaaaatgcttgcttctgttttacttgacgaaacattattgcaatgataaaataaccttaagacaggaagggattttcaggatttcatcattaaacaacttgagacgactaaggaataaagatttaagaaagtgaggtatcggacatgtactattctaagcaccaaaaaggttataaaaccagtcataaagtacaagtgactcacttccgtacttggaaatcggggaaaaaatgggtttatgcttttatggcctttagtcttcttgcaggagatattggttcaattcccctacttcagcatggacaagaacaaatagtacatgcggcgacttccagctcaggaactttagttcccaatagtccggctagtacgaacaataataatgtactcgcaggagacgtatctactgcaacaaactggacgacctcaaagctaacaggagcgggctatggttcggggacatccaccgcaggtggcggatggtcaggtgggacttggactgcgattgcaggcacaacacaaaccaatgcggtcagtctttttaatcaaccgcttgatatgactcaaagcctaacactgtcaggcaagataacgacaagtactaatagttctgttgcctcagcacttggggtaatgctcttaccaacagggacctcccttagtctcaatgtagggggaacgggaacaggtatccttccgacagaaggaacgcctaatgctatctttgctgggcgagatatttttcctctaaactctggttcgacgtcaattaatggacaaagtgtcgccaataatgactggacaggaggttcttactatcagattcgtatttctcagacaggggcgaatggtcttaaacaagcgtctgcttctacaaataacacagccaatccagttgttgggacaggcacctataacggtacatctggtgaaagctatgtcttgacatggacgccaactactgggactactacaggttcgctaagttatgcactgacaacaggcggtagcacctatattgtcacttggccaaatcttaccttgcccgcttcaatgcaggtaggacttgccgcttcggcaggtggttggacatctacgatgaccttatacgaacaccacgctcactgcaagccgagtcacagctccggttcctgtcaattatttgaacaaagtgacaggtcaagcgattcctagtatgggtccgagcacaatcacggcgaatgtcggggataccgttggactatcgcttgttgctccgacgacaagtagtcccgatagcaatagttatacttttctagcaccagcagcgccggcaggctataatgccaattcttctacgaatacggtaatttctgcaacgaatcctgcaagttcaaccaataccgctgcaacaaaggttcaagctgtcgctcaaggtgcaacaaatcctaatgtagtgaacgtgacttatacgccgagccaacagaccgttgctttcaattgggcactggcctctggcagcactcttgcaacacttcctgcatctaaaagctacggcgcagcaggaactggagttacgaccgatagctcggtcgtaactgacaatcctttcgcctctacgaccctccttaaaaactatgccagtgacttgacctcagctgtccctgcaggctacaacattacggatatcacgaatggcacgacgagctatacaggtgcgacaactgcagcaacactggcagctttcgcaagcagccaacaacccgacagtcagtgcgactcaagcaagcaataactatacggtcacgctcacagctgcagcacaaacggcaaccttcaactatggctatatcaacacggcacagcacacgccggctgtacccagcagtatgacaacgacaggagggacgacaggagcgaatgtcgcacaatcactaccaactggctggaacacgccttccaatacagcgatagcggcgaataaaatcccttatggatattatatctctgccatctatgcaggaaactctgcaacaggaacaccgatagccacagggacgggaatgggaccacaaacaacgtctggtgcatgggctaattttcctgcaacaggtcagacctacggggcaacgggcaatcaatactatgttcaactctcgccatattcagtcagaacttcttggaaagtttctgtattagggacggaccctgattaccttgatgggcttggaaatcagcctaatggtgttgtggtaggtcaagcaactcccaataatcaagacaatctgtttagttatattgctactaatagcggtatatctatgacgacgacagataatatcgtctatactgatcctgcaggaattcgctatatcatcacaagttatacctatgcgacgactgctggtgggactggaacgacttattcgacatttgaggctcttcttgccgcaaacccatacattcctgctgggctttataatcaacccctacaatttgtcactgtcaacatgatttctgaccagacgagcatcacatctaattcgacaagtagcacaacaccgttaaccccagcaacgaactatatgcctatcaacgatatcacggcaagtacagatattgatggtgtagatgatgacggtctaccttatgccatcaatggctataatgccgtgaccaatatcgtaggcggcacgactaactactggggagatgcgacaaactctctgaaacttccgattggctcatacacagaaacttactatgcgcttaattacttgagacttcaggcttaccaagcacagtcaacatacacgacagtcgctagttttcttcaaagtttgtctagtgccaatctggcaaaatatacggtaagttcaacaaccacactaaccgtcgctgacgcaacgactatctcggcaaataatcagcatatcattcctaaagccggctcttacaacccaagctcggatattcttagcgcgacaaatgctgatggcactaatgcttttgcatctgtcaataatgttccggtcggggtgattatcacagacagagcaggtaataatgtttgggtcaacaacatgaccgttaacttacccaaaaacaaattggtcgtggggacttatagtgaaaagtattatgctttaactgctaaaggagctgcggactatacgacttggaaagcaacagcaagtccaagtgctaacacagtgggcgactttatcaactctggtcaaacaacaagtggtgattatgtgacagccacgacgcaactcacggttacaaactttatcttaccctttgcaggtgggagtggaaatcaatttctctatctaatgataagtctagctgcaatcggagcgctcggactctactttagtaagcgacgtaaagaagaagaattagagttcgtccctgagcaagcgggttatggagcttcaacaaatactaagggcaacaaggcaaggtttttccaaacactaagaaaaaccagaccctatcgtaaggtcttccatagcaaaaaccgtatccatctggcgcaaacgcagcgaaaggaggggaaaaatgattaagaaaataagaggaaactctacttaaccttagaacttcatttagctacaaaagtgcgataagcagagatgagcgcacagcctcagactcaatcaaacaaaaataggagaaaaaacatgaaactcaattcacttaacaaaaaatttgcccttgctagcgttagtcttctgacaattagcacattagcaggatttggtgggctagtaaatgttaatgctaaaactacggttgtaactgaccaagtctcaaatggtgaagttgctatctatgcccaatcagcagcaggtaatgcagtcgcaacgaccaacaacgatggtacaaaccctgatacaggtgttgccaacaaccaaacaggtggacaagcaggaaatactggtacaactaaaaatgacgggagccaacaatcaagccttgaaggttcaactccgagtgtaatggctaatgtgacattctcagctaccaaatacacaggaacaggcgttcctacgggtgttgccgattcggcattcaatggtgcaaaagtcacagcgacttcagctccttcaggacttgctgattttactggcttggcagatggttattaccttttccatcaagtaacaacagtcaacgggattacaacagttggcgactttatcgtccaagtcaatcataatgatagtcaagccggcatcgtcaacgtctatccaaaattagatatgtcaagttcggcaggtttagggacaagtgccacaacaaacgccgatgataactttaatggttcaacaccaaaccaaattgctaatccaaatgcaacaggcgattctgaccaaacacttacaaactcagataataatgctggtaatgaaaatcttgctaatggaacatgggtaaacaatggtgataaccaaaatacaacgactgcagcagccggaaatacagtgagctggaatgtgaacacagtctttgactcttcacaaacaaataatggaaatggtacaactggtgtaacaggaacttatgttgtgaccgaccaattaccaaataaccttgtggatagctcaacagctgcagatggtactgttatcgtgaatgtcacagacggtagcggagcgaaagtcgggacattgacagctacaacagactatacagtcacaaatgacggtaacggtaaaatcattgtaactttgactcctgtaggtcaacaacatgcggcgagcttgcttggaaatgccgatggtgcattgaatatcatcattccttctacggttaagacggctgttgttgactcagcaaaagactcggcaacaacagccatcacgaatgcttatggggctgacctttcaatgactgccgctgttcagtctacattgaatgttggtggagttgacatgacgaagacagacgcctcaacgagcgatgccttgaaaggtgcaacatttacggtagtccgtgcggacaataaagctgatgcccaagcttttgtcattgccaatgcagcctactttaataactcggcagctggcggttcagtggcaaatccaactttggctaaggcagcctttgtcacaggggattccaatggtaacgcaagtacgacagcaaccacaccagtgacgttcacgactggagaagatggtattgcaacatttagcggtttgaacttggtagatgacaatacagatactactaatacaagcaactactaccttgtcgaagttgccgcaccaaaaggttatcaacttccagcaccaaatacagcagcaaacttgacaggcgctgtgacagctagtaccgcacctactgcgactgacacaaccattactaatagcaaaccatttgctttgccatttactggtggacaaggattggcagggattatcgctattgccacagtctcaggagttgtagcctttgccatcaaacgtcgtaaagataatgaagaagaagtcgtaaaataagctagattacctttgataaaatgaaaatctaattagtaaggaggggaataatggcaagaaaaaaaccaaaaacctcccgtaaaaagggctttagtttacgaaatatactaagtgtgattttggcaattatcgcaatcggattacttttttatccgattgtggttaattacctagcaggacaacaaaacgtcaaatcagtccaaaaatatgataatcaactgtccacaattggaaactcgaaagttaagtaactacttgctcagtctcaattatacaatgcacagctttacaacgaatacatctatgatgcaagtcagcatattgcatggaataaacctattcccaactataacaatgttttaaaagttgattctacaggaatgatgggctttatcacgattccacagattaaggtcaatgatattccaatctatcatggagattctgaaacgattttagggcttggtgttggtcatgtgccccaatcttctttaccaatcggaggaaacaatactcacaccgttttgcctgcacattctggtcgagtgaatgatactttatttactaatctggacaaacttaagaatgggtacgtcttttatttacacgtcttagatttaactctaaaatataagattgatgatattcggattgttgccccaaatcaagtttcgtcattgagcatcgaaaaaggtcgagatttagtaactttagttacttgttatccgacagggattaataataaaaggttattggtcactggcgagcgtgttcctatatctaaggtattaccccaagaaaaagtccaacgaaatcagtttggttataatttttgggtgatgcttggttcgggtctgttactgcttttggggcttctctatcttttatggttactcttaggctcgagacataagctgtatcatgttgctgacagaaaaatagaagaaccaaagctttcagatggacagttaaggggagagtttggagaagggttttatttgactgactccaagaaactagctaatcaatggttagatgaacaagctcataaaaaaaatcaaaatcctgatgaactccttataaatgtttatcgcctgaaaaaaataaaaaatttatctcgttggatatttaaagataagacagaaaactggcaacattatatcctttaaaaacaaggatatggggatgagaaacatgcgcttgttgtgggtcctgtatttaccagtgataagaaagtcatgaaatatgctttgaaaacagaagaagcatttgagcatctaaagtatattaaatgcttgaataaaaataaatcaaagaaagggggaggaagaattgactaaaaggatcaaattaatgagcattttagcgtttgctttggttttgatttttggatttgtcagtcaaaacgcttttgctgatagccgtttaacaattgtaaaatatggattaatcccaggggcatctggttttagcgagaatcagacgacaaatgatggactaaaaattaacaacctccccttggataatttgggcaatgagctttcggtagtgtctggaattcattatttagtctatgaaatctcacctattggggatggttcagagcttacggcaacaaatcctccacaatcaagttatagaatttcgaaagaaattgctgacttagtgactgattcaaatggtgtgaccagtctttctgtgagcgatggttattatctgattgaagagtaaagtaacccacaaaagggtctgctaaagcctgctctacctttagttgtaaagctgccagtgactggattgaataatgtttatatttatcctaagtctagtgtagataaagaagaaacaattagtcctccacaagcaaagcctcaacctaagcctaagccgattgaagttcctaatgcacctaaaaaggttgatgattcttctaagaaagtatttggattattaccaaaaacgggcgtagtgagctccttactattgacttcttatggctttgctttattcttgattatcattcttttaaaaaagcacatcaaaaacgaagaagaagttaagtgaaataataactcctaggcagataaaaaaacgctggacaagtaaagttcaacgtttttttttttttaaatagatagttaataaccgagaataattttagcgatgattggtgcgaagataacatacatgataccagtgacaccaatactgagtgctgccattgctccttgcgttttaccaagttcgatcgctgttccagttccgacagcatgtccagttcctccaagggcaattccttgagcaacagggtctgtaattctaaagagttttaataatggaccgccaagcacactggtgagaattcctgtagcaaccacgacaacaacggtaatttgttccacgccatgcattttatcagaaattcccatagccattgcagtagttactgattttgggaagattgaaagagaggcgagtttactgaggctgaaaaatttagcacagagagcagtaaagacacaattgactaatgccgcaatagcaattgagctaacgattgaacgcgcgtggtgtttcattaaatggaaagttttataaagaggaattccaagagcaacggtactaggaccgatgaggtcattgatgattgaacccccaatataataatttttataaggaatatgagctagtgagagaatgagaataatgacgacagtagcaaagaggagaggatttgtccaaggcttacgaaagttttcattaattcgtacaccaatcataaagacaagaacggtaaggacaaagccaaagagtgggtcagtagtgataatgttcatgattttaaatactccaaattattggtcttcagtagacgatgtgacgttagtatctggttttaaagcgacatagtcgccttcaaatttcactttaatccactcgactaattttcctaagataagcatattgataacaagtgctccaacaacaatcaagagaatttgtgcccaaaaatgactgattaaattccacttggccatgattccgacaccagcgggtaaaaataaaatggtcatattattaataagaaaacttcctgcttcatcaacatgacgaaattctaaaagtttaaattgcagggcgagaaaaagtagtatcattcctaaaatagagccaggaaccggtaaacgaaaaatgtttgagatgacatttccaataaaagaaaagccaaaaatgattaataattgcaggtaaattttcatatttgttaactccctaagttaattacggataatttttacaacaatttttattgtactctttgaaatagggtttttcaaggataagctggtattgcttttatgaaaataatcttgaaaaatttttttataaagtccacttgacatttgcttaaaacatgttataattaaaataaataaactattagaaaggagcgttcgcaagggcgctccttctcttgtgttttaaaattgaagttgatttcaactttggattttatgaaaggagaattgcctatgaatgatgttgtaaaaattgtagaagatttcattaaacctcatattccaaaaccctttgaactctttgctgttgaatgggaaaaatttggcggagatatgatgctttcaattctggtggataaagaaggcggaatcgaaattgatgaaacagcagaactaagtgaacttatttcacctttgcttgataccatcagcccagatccatttccaacagaaggttatctattagaagttgcaagtccgggagctgaacgtccgttgcgtaaggctgaacattttgctggtgcagttggtgagtatatctttgttaaactttatcaaaaaatcaataatgaaaaagaatttactggtgatttggttagttttgacggggaaaatttagtagtagatgttttagataagacgcgtcataaaaatattgaaattcctttatctgctgttgcaaaagcacaaacgatggtgaaattttaaagaattctgaatggatttaattaattttctactgggaaattaattttccttagctgagttcgatttccttgagttaggtgaaatcggaaaaatttccttgattcaaggtagtcgaacttagcagatattaaaaatgaaattttcttataaaagaaagagagaaaaaaatgagcaaagaaatgctgaacgcctttgcaatgttagaagagcaaaaaggaattaaatctgagattgctattgaagcgattgagcaagctatcacagcagcttacaagcgtcaatatggtcaagcacaaaatgttaaagttatctttgatgaaaagaaaggaaactttaatgtttattctactcgtgaagtagtagatgaagtttttgatagtcgtctcgaaatttctcttgaagatgctcatgaattaaatcctcattatgaaattggggacaaaatcatgtttgaagaaaaaccaaaagattttgctcgtactgctgcaggggctgctaaacaagtcatcatgcaaaaaatgcgtgaagaagaacgcacaatcatttacaacgaatatagccgttacaaggacgaaattatccaagggactgttgaaaaagttgatgcacgtgccgtttatgtaaatcttggacgtgttgatgcacttttgactaagaaagaccaaattccacaagaaaacttccatgtgggtgaccgtgtgaaggtttatgtgactgatgttgtcttgactccaaaaggaactcgtgtctttatttctcgtactgcgcctgatatgctcaaacgcatgtttgaaaaagaaattcctgaagtttttgatggaactgttgaaatcaaatctattgctcgtgatgctggtgaccgtgcgaaggtcatcgttcaaagtcatgatgaaaatgttgatgcgattggtacaatggttggggctaaaggttcacgtattcaaggaattattcgcgaacttgctggcgaaaaaatggatatcattgaatggtcagaagacaaagcaactcttgtagctaatgctttgaaacctgctcgtattgaacaagttttgattactgctgatggttcaagtctggctgttgttgctcgtgaccaattgtcacttgccattggtaaacgcggacaaaatgttcgtcttgctgctcacgtcacaaatagcaagattgatattaaagctgctgacgagtttaacatggacgattatgaatttgttggtgaagctgacgaagaaactccaactcttgaagttgaggaaacaatctcagttgatgaagttgttgaagaaccagtagttagcgaaagtgaagaataaattttaaaagttgaaaaatttactgacagaacgtaaaagattagtagaagcataaaggttctaggaatttctttttaataagtctgtcagtaaaatgactgagagtttaggaatcaaaaaatggctgtcagtcactttttcaacagaaattttgaggattttcgatgaagcagaaaaaaattccaatgagaaaatctttagtttcaaatgagcaatttcccaaacgggatttattgcgcattgcctacaacaaagagggagaaattttaattgacccttctggcaaggcacatgggcgcggagcttatattgcaattcttaataaagaagcaaaagaagctaagaaaaaacgcgtatttgaccgagcttttcaaactaaaatcgctgatgagttttatgatgaattaatcacttatgttgaacaccttgttgctcgacgtgaacttgaatcgacaacttattctgctgatttagcgccggattatgactaaagatggataaaaaacaacagatttcaaatttgctaggtattgcaaaacgtgcgggtaaaattattagtggagaagaattggtgattaagtcaattcaatcgaataaggcaagacttattcttcttgctaatgatgccgcagcaaatttgagtaaaagaattactgataaatcaaattattatgagattcctgtctcaacactctttacagaaatagaattatcgcacgctataggccaaaatcgtaaggttattgcgcttgtggacgatggatttgcaaagaaaatggagagcctcatgaacaattgatcatataaggaggacaaagattgtctgataaaaaacgtattaaccaaattgctaaagaaactggattatcaaatactgagcttgtcgcaactgcacaatcactcggttttgaagtgaaatcacattcaagctctgtaacagcagaacaagcggaaaaaatcattcaaggtgtaaaaacaggcactgatactattgttaaacctgctgaaaaaactgttaaagctaaaactaagactgttccagaaacagcaaaaagtaaacaagaggaccacccacgtacttttgctgggaaagcagtcgttgaagatccagctattttagcaagaatcaaagaaaaagaagaagctaaaaaggctgctaaaacagaagccgaaccgattgaagaggttattactacggaaaaaccaaaagtggctgagccagttaaaaaatctgaacctaaagccgcagcaaaagctgaagaaacaaaggttgaaaaagtagaagccaaagccaaaacagtaactccaaaagctgaagtaaaaacagaaaatgttgctgacaaaaaagaaccagttgttactgaagagaagaaaaaatcattgactcaaaaaccaagaattcaaattaaagttatcaaacgtgccgaagatatcaaaaaagaacaagctgctgctcgtcctgaaaagaaaaaattcgacaaaaatcgcaacgatagaaacaaccgtaatgataaccgccgtccaaaccaaaatggaaatggtcaaggccattcacaaggtggaaatcattatgataaaaaccgtccagctggtcaaggacaaaatcaagggcaaaaacgtgataaatttgcttcatcaggtagcagctctacaagtgatacctttactccagctgcttcagggaaaaataatcgtcgtgatcgtgaccgcaaaaaaacggatagcaaccgcgataatacaaaagatggtaaccgcaaaggtggaccacttcgcgtaaacgataatcgtaatcaagtccgtaatgctcgtaactcaaattggaatcaaaaaggtggtcgtggtcgttaccaaaataaccaatcttcaaatgttccagcaactcaacgtaaattccatgaattgccagaaagtcttgaatatgaagtaggaatgaacgttcaagatattgctaaatcaatcaaacgtgaaccggctgaaattatcaaaaaactcttcatgatgggaacaatggtcaatcaaaaccaatcgcttgatgaagatacaatcgaattaatccttatggattatggtgtgacaccacttaaaaaggttgaagaagataaatcagatattgaacgtttgtttgttgaagatggttatcttaatgaagataaaatggttgaacgtccagcagttgtaacaattatgggacacgttgaccatggtaaaacgactttgcttgaccgtttccgtgaatctcgcgtaactgaaggcgaagctggtggtatcactcaacatattggggcttaccaaattaaaaccaatggcaagaaaattactttccttgacacaccaggtcacgaagccttcacttctatgcgtgctcgtggtgcttcagtcactgatattacaatcctcgttgttgctgctgatgacggtgtaatgcctcaaacaattgaagcaattaatcactctaaagctgctggcgtgccaattattgtagccattaacaagattgataaaccaggggctaatccacaacgtgtgacacaagaattgactgaacatggtgttttcccagttgcttgggatccagaaaatggttcagaatttgttgaaatttcagctaaattcaaccagaatcttgaggaattgttagatacagttcttcttgtggcagaagtgcaagagctcaaagctgacccatctgttcgagcaattggtactgttgttgaagcacgtcttgaccaaggtaaaggggcgattgcaactctcttggttcaacaagggacacttcatatccaagacccaatcgttgtcggaaatacttacggtcgtgtacgtacaatgacaaacgaccttggacgccgaattaaagaagctggtccatcaacaccaattgagttaacaggtctttcagatgttcctcaagcgggtgaccactttgcggtatttgaagatgaaaaagcagcccgcgctgctggtgaagaacgtgctaaacgcgctcaattaattaaacgtcaaaatacacgtcgtgttaacttggataatctctttgacacacttaaagaaggtcaaactaaatctgttaacattatcatcaaagcggatgtacaaggttcagcagaagcacttgccgcttcacttcaaaaaattgaagttgaaggtgtaaaagttgatatcgtccattcagctgttggagcaatttcagaatctgatatttctcttgctgcagcatcaaatgcgattatcattggtttcaatgttcgtccaactggtcttgctcgtgaacaagcagcgcaagaagaagttgacatccgcttgcacagtatcatttataaagtaattgaagaagttgaaactgcgatgcgtggaatgcttgacccagaattcaaagaagaaatcatcggtgaagcaattgttcgcgaaacattcaacgtttctaaagtgggtacaattgccggattcatggttattcgtggtaaagtgactcgtgatgcttcagttcgtgttatccgtgaaggtgtcgtgattcatgatggtgccattgccagccttaaacattttaaagatgatgttaaagaagtcggaaatgctcaagaaggtggtttgatggttgaagacttcaatgatgttgaaattgatgatacatttgaagtttacaaaatggttgaaatcgaacgtaaaaaataagatgtgaggaagattcgcttagaagttaagagaaatgccattcgacttgcgactatagtcgtatagcgagaatggacaacgcagtagcaaaagtgcggagataggaaaatttaggattcacacaagttgtggttctgtatttcacctattttcaatgatttctaggactattgactcacttaaaaaaatgtaaaaatagtttcatacttatttcttacattttgaaataaattaggaggaaaaaaatgggaaattcttttcgtagcgaccgtgtcgcagtagagattcaacgcgaaatcaatgatattttgcgcaataaagttcgcgatccacgtgtacaagatgttaatattactgatgttcaattgacaggcgatttgagtcaagcgactgtttattatagtctcttgtcaaacttagcttctgacaatgaaaaagctgccactgctttgaaaaaagcaactggacttttcaaaagtgaattggcaaaacgaatgactatttttaaaattccagatttaactttttcaaaagatgaatctgttgaatatggttcaaaaattgacgagctcttacgtgggcttaacgataaatcagaatattaattaaaaagttactgacagaaaaagttgaatctattctctatagagatagattctgcaccttttgtcagtaattttttgtcttaaaattactgacaaattgttctagataaattttgtgatataatagacattgtgaaatgaaagcgaataaaatctgctcatttggaggaaaatatgaaagaaccattgtttttgaactcagttttgcaagaaaaaatctggggcggcgaccatttgaaagaatttggctatgatttgccatccgataaagttggcgaatattgggccatttctgctcatccacatggcctgtcaacaattgctaatggcgaatttaaaggtcaaaagcttgaccaattatacgcaagtcaccgcgaattgtttggtgacagtaaaaaggaaatctttcctttattaactaaaattttagatgccaatgattggctttctgtacaagttcatccagatgatgaatatggacaaaaacatgagggtgaacttggaaaaactgaatgttggtacataatttcagctgaaccaggagctgaaattatctatggtcataatgccaaatcacgtgaagagctcgctgaaatgattaaatctggtgattgggatcatttgttgcgtaaagtgaaagtgaaaacgggtgatttcttccatgttccatcaggaacaatgcacgcaattggtgctggaattgtcattcttgaaacacaacaatcttctgatacgacttaccgtgtttatgatttcgaccgtaaagatgaccaaggaaatcttcgtgaattacatattcaacaatcgattgatgtcttgaatattccgggcgacaaagttcctgaaaatcaagttaaaactgaaaaatttgctgatgcagaaattaaaactcttgtgaaatcagacttctttgatgtttataaatggcaaattcatggtgaccatgaatttgccaaagttgctgattacactttggtttctgtccttgatggcgaagggaaactgactgttgatggaaatgaatatcccttgaaaaaaggtgctcattttatcttaccaagcaatgttgaaaactggactttatctggtcaattagaaattattgccagcaatccagcctaatcaaatgaaaaattactgacgaaagttcaaaaaaattctgtcagtaatttttttttgacaaaatttctgtcagtaaaaatagcatttttacagataaaaactgtggatttttaaaaaaatttaaaaatgttgacgttttctaaaaattattacttgcaaatcattctaaaaaataatataatttgatacagaaaatcatttgcaatataaaaacaaattgagttcatcttgcgcgaaagataaaatagattattaatcaggggataaattgatgatattttgctatcagtttatcccctgtctaaatgtaataataaaagcccatagggacttttatttatttcggtttcctatttttactaatgtctaaagtcggactcacatctaaaaaatgaagaggatgacagatgaaaacagattttgataaggtaaatgaatggctgattcaactctttcatgattttatgatattagaggagcaattcttaaaagattcagcttattcagatgtaacagtaaaagaattacaaattttgacactcgtccatacgttggggacttgtcgagcaacagatattgccaaaaatcaaaaattggccttatcaactatcacaattaccctcaatcgtttagaagataaaggttacattgaacgtaaacgttcaacagcggaccgacgagtgactcatattatactgacatcaaaaggtgacgagctttgcgccactcatcgtgagtttttccatatgattactgacaatctatttgatagtgtttatggaacaactgaaaacaagctagctggtgaacttgcagctctgcataattctttggagaatatgaaataatgaattttgcgaaaatcacgcaagcggcacattatgtgccagaaaacgtagtatctaatgatgacttatcaaaaattatggatactaataatgaatggatttacagtcgaacaggaattaaaaatcgtcatatttcaactggggaaaatacttcagatttagcaacaaaagttgttaaacagttgattgaaaattctggggtagacccagaattgatagattttattattgttgctactgtgacccctgattcaatgatgccctcaacagccgcacgcgttcaagcgcaagtaggtgcaactaatgcatttgcttacgacttgaccgcggcatgctcaggatttgtttttgcactatcaaccgcagaaaaattaatttcctcaggtgcttatcaacgtgggattgtcattggggcagaagtattctcaaaagtaattgactggtcagaccggtcaacagccgttctttttggagatggtgctgctggtgtactcttggacaatagtggaagtcaacctcttattattgctgaaaaaatgcagacagatggcaagcgaggtggaagtttactttctagctacgctgatattcaaacgccttttgcctctgtttcatacgagggttcaaacttgagtatggaagggcgagcaatttttgattttgctgtacgcgatgttccaaagaacattcaagcaacattagaaaaatctgaccttgctgctgaagaaatagattattatctccttcatcaagcaaattcaagaattcttgataaaatggctaaaaagttaggcgtgacaaggaataagttcctccaaaatatgcaagaatatggcaatacatcggcagcaagtatccctatattgttgtcagaatccgtaaaaaatggtatatttagtttggacggtcaaacaaaagtcgtcttgacaggatttggtggtggcctcacttggggcacagcaattattaatttataagagtcaaaaagtttagcctgcttttggtaagttgtctactttaaattttaaagaagtgacgaaaaagttgaagctgacttaactcttaagtagattttaaaaatctacatttaactaatggttataaaccgctttgcggatataatataaatattttcactcaattaaaggagaaaaaattatggcagtatttgaaaaagtacaagatattatcgttgacgaactcggtaaagaaaaagaagaagtaacactcgaaacttcatttgaagagctcgacgctgattcacttgaccttttccaaatcatcaatgacatcgaagacgaattcgacgttgaagttgatacagaagcagatatgaaaacagttgctgacctcgttaaatacgtagaaaacaacaaataattcgggatgggggtgaagcgagcaagggagttgattcttttgcgactttcgccccttcttttcgttggactagctctatttttaaaaatagaattctagtatagggagctcagtagtgttatactgggcttatcctataattttcatattgaggaatgtcattttttttaagataaaaacattttacaatactaataattaactttataaaagaaaatacgaggaattctaatcttctagtttgaatagcttatttgaatttgaaatagttgattactatatattatgactaaaacagcatttttattctcgggtcagggcgcacaacagctaggaatggctcgtgatttatatgaccaacacgaatcggtaaaaacgacttttgatgaagcaagcaaagctttaggatatgacttacgtgctttgattgatcatgatgaagaaaaattaaatgaaacaaaatatacacaacctgctattttgacaacttctgttgccattatgcgattgttgaatgaaaatggaataaaacccgacgtagttgctgggcttagtcttggtgagtattcagcattagttgcttcaggaattattgattttcaagaagcagttaagcttgtagctaaacgtggtcaatacatgacagaagctgctccgactggttcaggtaaaatggttgcagtaatgaatacagagcctgctttgattgaagagatttgtcaaaaagcatctgagcgtggcattgtgagtccggcaaattataacacgcccgcacaaattgttattggtggtgaagttttagccgttgattatgccgttgaattattaaaagaggcaggggttcgtaaactgattgaattaaaagtatcaggacctttccatacagctattcttaagccagcttctgaaaaattagctttggaacttgataaaattaattttaaatcttttgaattacctttaatttcaaatactagcgctaaagtaatgcaagaggatgaggtaaaagccttgttaactcaccaagtaatggaacctgtccgtttctatgaatctgttgaaacaatgcaaaaactaggagtgactcgctttattgaagttggtcctggaaaagtactttctggtttcataaagaaaattgataaaaatgcagaatttacaaatgtttgtgatattgctacatttgaagccttgattaatcagtaaaattggagaaaggaattgagttcgtccttctaaacagtcagcaataatctgacatcagagatatcagattattgctgtccttgaagtctaagcactaaagtgctaagaccctaaggcgggctcacatcttataaataatggaaattaaaaataaaaacgtctttgtaactggttcaactcgtggaattggtaaagcaattgctcttcaatttgctaaagcgggttctaatgtgatcattaatggacgttcagctgtttcagaagaacttttagctgaatttaaagcttttggtgttcaagcggttgggatatcaggtgatatttcaaaatcagaagatgctaaacgaatggttaaagaagcaattgaagctcttggttcagtggatattttggtaaacaatgcaggaatcacgcgtgatggcttatcattaaaaatgtcagaagaagattttgagactgttcttaaaatcaacttgacaggtgcctttaatatgacacaagcagttttaaaaccaatgactagagcgcgttctggagcaatcattaatatctcatcagttgttggtttgatgggaaatgctggacaagcaaattatgcggcttcaaaagctggactcattggtttaacaaaatcaattgccagagaggtagcaggacgtaacgttcgtgtaaatgctgtggctccaggatttattgaatcagatatgacagaagttctttctgataaggttaaagatgcaatgaaagggcaaattccaatgaaacgttttggtatgccagaagaaattgcgaccgcggttcaattcttggccgaacaagaatatatgactggacaagtactcaccattgatggtggggttgcgatgtaaattgctcatttataaattttgaaattaagaaggataataatatgacaaatagagttgtaatcactggttatggcgtagttagtgcaattgggaatagcccagaagaattttggaacaatcttaaagctggtaaaactggaattggtccaatcactcattttgatgccgaagcaacaggaatttctattgcagcagaagtaaaagaatttccatttgacaaatatttccagaaaaaagatgcacgacgcatggatactttctcactttatgcggtttatgcagcgcttgatgcgatggaaatgtctggaattacagaagaaaatactaattttgaccgtttgggttgtatcatggcttctgggattggtggacttgaacaatcacaaaaaaattcacaagcgattgttgctaaaggacctcgtaaaggcgtagcaccactctatgttccacttgctattgctaatatggcaactggtaatgttgctttacgtacaggtgctcgtggtgtttcacgtgccgaagttactgcttgtgcggctggtgccaatgcaattggttcagctttccgtgaaatcaaacatggttacgctgatgcaatgattgctggtggtgctgaagcggcaatttgtgaacttggaattgctggatttgctaatttgacagctttgactaaagaaactgaccctgaaaaagcatgtattccatttgataaaaaccgttctggtttcgtaatgggtgaaggctctggtgttttgattttggaaagtcttgaacatgcacaagctcgcggtgctaatatcttggctgagattgttggttacggaaatacaaatgatgctttccatatgacaactccttcaggagttggtgctgaaaatgccattaaattggcattggaagaagctggggcaagtcctgctgatgtagattatgtcaatgctcacggaacttcaacacatgctaatgaagaaactgaaagcaaagcgattcacaatgttatcggcgataaagcttacgtttcatctacaaaagctttgcatggacatgcacttggtgcaacgggtgcaattgaagcagtagcaactgttcaagcccttttgaatcaatatgcaccagtaaacgctggaacaactgaacttgatgaaggaatgacaattaatgttgttcttggtgaagggaaacctgctgaaattaaccttgccttgtcacaagactttggttttggtggacacaatgctgtattggcattcaagaaatgggaaaatgcggccgaataaggcgtattttgacgatagaataaaactttgcctagcaaagtgtcaaaaaggataaacaaaaatgaacatttcagaagtaaaagatttgatgaaccaattcaatggttctactttacgtgaattttcttggaaaaatgctgacggcgaattatcgttttcaaaaaatgaagggcaagcccttgttggtcctcaaagttccgctcctattgcagctgcttttacagctcaacaagctgcgccagttgcagaaagcacagaagttcccgtggcaaatgaaatagccgtagaagctgaaggtgaagcagttacttctccattggtaggtgtggcttatcttaaaccttctccagataaagctgaatttgctaaagttggagatacggttaaaaaaggtcaaaccttgcttattattgaagcaatgaaggtgatgaacgaaattccagcaccaaaagatggaattatcactgaggtgatggtttcaggagaagatgttgttgaatttggtcaagatttgatgagaatcaaataaaaattactgataaggctctgtcagcttatctttaatgtaaaaatttctgacagttctagaggctagatgatttacaggcaagttctgtcagtaaatcatctaaaagaaaagtgagaataaatgactgaagtaaatattaatgtaacagaaattatggaggctttgcctcatcgttatccatttttattagtggaccgtgtgattgatattgctgatgatgagattacagcaattaaaaatgtgacgattaatgaagaatttttccaaggacattttccacaatatccagtaatgccaggtgttttgatcatggaagctctcgcccaagcggctggtgtcttggaattatctaaacctgaaaataaagggaagcttgtcttttatgcgggaatggataacgttaaatataaaaaacaagtcactcctggagaccagttggtcttacatgctaaatttatcaaacgtcgtggaccaattgcggttgttgaagcagaggcaactgttgatggaaaattggcagcgaaaggaactttaacctttgccttaggtaaataggttattcccatttaaaaataatcatatttattatgattaagaagcaaaaaatttattttaaccataagattttttacttatggtaaatttcggacttatttttatttatcaaaaaattgttttgttggctatgactttctttttatcattcctttcaaaactcccattgagcaaaagctcggggtattttcccatatggagaacatctatgtttaataaaattttgattgccaatcgtggcgaaattgctgtaagaattattcgtgcagctcgtgaattaggagtgggtacagttgccatttattcaactgcagaccgtgacgctttacatgttcatttagctgatgaagccatttgtgttggtccagctagaagtacagaatcatatcttaatatgaataatattctgtcagctgctgtagcaactggcgcacaagcgattcacccaggttttggatttctttcggaaaattcaaagtttgctcgtctttgtgaagaaatgaatattaaatttatcggcccctcagcaaaagtcatggatatgatgggtgataaaatcaatgctcgtgcagaaatgattaaagctggtgttccagtaacaccgggttctgaaggcgaagttcataccactgatgaggccgtgaaaattgctgaagaaattggctatccaatcattcttaaagcgtcagctggtggtggtggtaaaggaattcgtaaagttaatactgtcgaagaacttgtcccagcctttgaggcagcccaagctgaagcccaagcagcttttggaaatggtgccatgttcatcgaacgtatgattttcccagctcgtcatattgaagttcaaatcttaggtgacagccatggcaatgtgattcatcttggcgaacgtgattgttctcttcaacgtaataatcagaaagttctcgaagaatctccgtcagtagcaattggacatactttacgtaatgaaatcacgtcggctgctgtaaaagcggctcaacatgtttcgtatgaaaatgcaggaaccattgaatttttacttgatgaatcttctggtaagttttatttcatggaaatgaatactcgtgttcaagttgaacatccagtaactgaatttgtctctggtgtagatattgtcaaagagcaaattcgtgtagctaatggcaatgagttatctgttaagcaagaagacgtgacttttagcggacatgcgattgaatgtcgaattaatgctgaaaatcctaagtttaattttgcaccatcgccaggaaagattactaatctattcttaccaggtggtggggttggcttacgggttgatagtgccatgtacagtggctacactattcccccttactatgacagtatgattgctaaagtcattgttcatggcgaaaatcgttttgaagctttgatgaaaatgcaacgtgccctccttgaattcgatgttgaaggtgtgacaacgaatgttgatttccaattggagcttatttctgatccacatgttgttgcgggagattacgatacaagtttcttaggaaatgttttcttaccagaatatcaaaaagaagactgacaagaaaattctgcaaaagcagaaagcgaatgtctgtcactaaatttaataaaaaatgagaaaaggatgcaaagatggctcttttccaaaagaaaaaatacattaaaattaatccaaatcgttcaattattgagaaacaagcagagcatccggaagttcctgacgaactttttgctaaatgtcctgcttgtaaacatacgatttatcaaaaagacttaggaaagaataaagtctgtcctaattgtgactataatttccgaattacggcaaaggaacgtctagccattgttgctgacaaagattcttttgttgaaatgtttactggaattgatagtaaaaatcccttagattttctaggatatcctgagaaattggcggccacaaaagcaagaacaggtcttgacgaagcaattatgaccggagtggctacgattaaaggtcaaaaaacggctttggcaatcatggactcgacttttattatggcttctatggggacggttgttggtgaaaaactgacacgtctctttgaacatgcgacgactgaaaaattaccaattattgtttttacagcatcaggtggggcacgtatgcaagagggaatcatgtccttgatgcaaatggctaaaacctcagctgctgtcaaacgtcattcaaatgctggtcttttttatattactgttttgactgacccaaccacgggtggagtgacggcatcttttgctagcttaggcgatattattcttgccgaaccacaatctttgattggttttgctggccgtcgagttattgagcaaacggtgcgtcaaaccttacctgatgattttcaaaaggctgaatttcttttgaatcacggttttgtcgatacaattgttaagcgcaatgaattacgtcaaaaattggcccttcttttagaacttcatacggaggtggaaaatgtctgaaactattgattcaatgacaggtgaagtttcgcaaaaaaatattgctgatattattaatgaagcaagagctgctgatagaatttcggcaagagatattattgctcaggttttcactgatttccttgaattacacggagatcgtcaattaacggatgatgaagcaatcgtcggtggaattgcacgatttaatgaccaagctgtgaccgttatcggaattcaaaaagggcgcaatcttgaggaaaatttggcgactaattttggacaacccagtccgaatggttatcggaaagctttgagattgatgaaacaggccgaaaaatttggccgaccagtcattacttttgttaatactgcaggtgcttatccggggattgaagcagaagaacgtggtcaaggtgaggcgattgctagaaatcttttagagatgtctgaccttaaagtcccactgattgcctttataacaggtgaaggaggctctggtggagcacttgctcttgcgcttgctaataaggtttatattttagaaaatgctgtttattctgttctttcgccagaaggttttgccactattctgtggaaagatggttcgcgtcgtgatgaagcggctgagctgatgaaaattactgcgccacatcttttagaaatgggaattgttgatgggattatttctgaagaaaatctgattgataatctcaaaagacagctgacagaaacgctcagcgagttaactttactgacagaaactgaattagcagaacaacgctataatcgatttagaaaatattaagaacgaagccctttgcctcgtttttttatttttcaatcagtaaaggagtgaacaatttgtatgcgaattaagcttgccataaaaaatattaagtctgccatagcattttcttatggcgactttttaactttcatgatatttttatattatagaaaaaattagaaagtaaaggactaatgacaagtttaaaaacaaaagtaattcacggtggaatttcaacagatagaacaacaggagctgtttctgttccaatttatcaaacatcaacttataaacaaaatggacttggacaacctaaagaatatgaatattcacgttcaggtaatccgacacgacatgctttggaagaattaattgcagatttagagggtggggttcaaggttttgcttttagttcaggcttggctggaattcacgcggtactatctttattttctacgggcgatcatatcatcttagctgatgatgtttatggcggaacttttcgattgatggacaaggtgctgacaaagacaggaataatctatgatttagtagatttgagcaatcttgaagatttaaaggcagcttttaaagcagaaaccaaagcagtctactttgaaactccctcaaatcccctgctaaaagtcttggatatcaaagaaatttcaagcattgctaaagctcataatgctctaacattagttgataatacctttgcgacgccttatttacaacaaccaatcgctctaggagcggatattgtcttgcattctgcaacgaaatatttaggaggacactcagatgtagtggctggtttggtaacgacaaattcaaatgaactcgctagtgaaattggctttttacaaaattctattggagcggttcttggtccacaagatagctggttagtccaaagaggaatcaaaacacttgcactccggatggaggcccattcagcaaatgctcaaaaaattgctgagtttttagaagcatcacaagctgtttcaaaagtctattatccaggtctcgtcaatcatgaaggacatgagattgctaaaaaacaaatgactgcttttggtggaatgatttcatttgaattgactgacgaaaatgcggttaaaaattttgttgaaaacttgcgctattttacactagccgaatcactcggcggagtcgaatctttgattgaagtgccagcagtaatgactcatgcctcaattcctaaagaacttcgggaagaaattgggataaaagatggattgattcgcttatcagtcggtgttgaagctcttgaagatttactgacggaccttaaagaagcactcgaaaaagaataatatattgacagagttgtaagcaaagcttacaactcatttctcccccgcttcaacagctcccgttggtcctgttgagctgtcagaaaaattagatagtaaaaattgagaatgatttactgacagaatggtaaacttcaaagtctgtcattcttaagcagaactgacaagactgtcagtaatttaggaattaatatgacaaaaattgttgaaaatatcactgaattagttggcaatagtccaataataaaattaaaaaatagcccagaaaacagtgctgaaatttatctcaaactggaatatttcaatcctggaggctcagttaaagaccggattgccctacaaatgattcgacaagcagaacaagagggactcttgaaaaaagggggaacgattgtagagcctacttctggaaatacagggattggacttgccatggttggagcagccttgggttataatgtcgtaattatcatgcctgatagttactcaaaagaacgtcgtcagctcattcaagcttatggggcaaaattaatattaactccagcagctgacggaattaaggctgctattgatttaggtgaacagctggtcaaagaaaatggctggtacatgccaatgcaatttgaaaatccagccaatttgaaagcccatgaattgagcacaggccctgaaattattgaagcctttggtaaagaaggactggatgcttttgtggcttgcgcaggaactggtgggacaatttctggagtttctcattatctaaaaagccaaaattccaagataaaaacttttgtcgttgaaccagcggaatctccgattttaacaggaggagagagtgggcctcatcgaattcaaggaatcggcattccttttatgtcgcccaatttggatacaaagtcttatgacggcgtggtggatgtgacaagtgatgatgctttagataccgcacgaaagatcggtaaaacagaaggctttctagtcggaatttcttcaggggcggccatttgggcagcttatgatttggctaaaaaactcggaaaagggaaaaaaatactagcactttgtgctgataatggggagcgatatctttcaacagaactttatgattattaaaacttggcatgttccaagttttttttatcgttatgagcagttttctgtactttttttgctacggatgttagaatgagaatagattaagaagagaataaaggagggaaatcgtacattctattttatcaatcaatgattgataaatttaactgatttagtttttctaaaaattattatgaaactttcatgataatttgagatgaaatcgcaaattacgaggaggatttaaaatggctttaaatgacaaacttgatgcaacaaaagataaagtaagtggaaaagttaaagaaaccacaggtaaagtaactggtgatgaaaaactagaagctaaaggtaaaacagaaggacttatgggaaaagctaaagaaggcttggaaaatatcaaagataaggcttctgaccttgctgaagatgttgcagaaaaatttaatgatacggttgactctgtcaaacataaaaaagataactaattaatttcctattttttatcaacaaaaacctaagtgattaaaaacttaggtttttttattttataaattaggaagtgataaaacttgacttatatacccatgggggtatataatggttttaaattaactaaagaagaggcaatgaagtgcaaacaattgatgctggtcagttaaaattactgatagaaaataaaaaagcaataatcattgatgctcgagaagattttgaatatcgaaatgggcatgttccaggagctaaaaatcttccattaagtcagctagaagaaaaatatcaagaaattactgacggaaactatattatctgtcagtcaggcgctcgttctgctagggcttgtcaatatcttttggcaaaaggaattgaaacaatcaatatttctggaggaacttcagcttgggatggacagctagattttgattaaaagcaagaagtgacaaagttgaggagaaaatgtgttcaagttatttaataaaataaaaacaataagtatctctgattaacagaggaaataaaaaaaggaaaacaattaattgatgttcgggaagtagaggaatttaaaagaggacatattagtggcgccagaaatcttccgttgagtcaactgaccgctcaatcattaaataagaacaaaaaatacttactcatttgtcagtcaggaatgaggtcaaaaaaagcttacaaaatattgagcaaagctgattatgatgtgaccaatgtatctggtggaatgttagcttggagaggaaaaatcaaaaaatgacagagaaaatattaattgttggtggtgttgctggaggaatgtctgcggccacccgcttgcgtcgtcttcaggaaaaggcagaaattattgtttttgaaaaaggaccttatgtttcatttgcaaattgtggtttgccttattatgtgggcggagaaattgaagaacgagaaaatttaattgtccaatcgtctaaagcattgcaaaaacgttttaacttagatgtgcgtgaaaattctgaggtcactgcaattgacagtaaagaaaagaaaattacagtcctttcaaatgggaaaagttattttgaaagctatgataaactcattctttcaccaggtgccaaaccatttgttccacaaattaaaggattagatctggcaaacaatgtctttactttacgaaatattcctgatgtggataaaataatggctcagctgaaagagaaagcgcctaaaaaggcgacgatcattggtgctggtttcattggaatagaaatggccgaaaatcttgcaaaacgtggaatagcggtcacaatcgttgaaaaagcgccacatgttttgccaacgattgatcgtgaaatggctgcttatgtcaatgaagaattaatcaaaaataatgtctcagtaatgacaaatacaggagctgtggaatttaaggacaagcaaattttacttgataatggtgaaagtcttttatcagatctaacaattctctcagtcggtgttcaacccgaaacgagtttagctaaaatggctgatattaaattaggacttaggaatgctattctagttgatgaacattacgaaacatcggttaaagacatttatgcggtaggtgatgctattgttgtcaaagatcaattaggacatgatgctttaatttcactggcctctccagccaatcgtcaaggacgtcaggtcgctgatatcattagtggcttgccagttgaaaatcgtggttcgctcgggacggcgattgttcgtgtatttgatttacaagtggcaagtacagggctttcagagtcgcaacttcagtccttaaatctgaagcataaaattgttcatgtgacggcaaacaatcatgctggatattatccaggagcgacatctattgttctgaaactaatttttgagccagagagtggggaaatttttggagcacaggcgcttggtaaagaaggagttgataaaagaattgatattttatcgacagcaattaaagctaaactcactgtgtttgacttaccagaattagaatttacttatgctccaccttttggatcggctaaagaccctgtgaatatggctggttatgctgcaatgaatattatattgggacagtcagaaaatattcagtggcatgaacttgcagatgaattggcaaaaggaaaagttttgcttgatgtaagaaatcctgctgaactaattaaaggtaaatttaaaaattctcaaaatattccacttgatgagctccgtgaacgtcttaatgaactggataagaagattcaatatatcgtcagttgtcagtcaggacttcgttcttacaatgctgaacggatcttaaaacaagaaggttatcaagttaaaaatttagatggagcctttggtttatatagtaaagtcacgaatgatttaattgaataaacaaagggaagatgctgatgaaaaaatatgataaaaaaatggaaaatcgattgaaaagggctaatggtcagctgtcaggtgttttaaacatgatggattcaggtgaggagtgtattgatgtcgtcaggcaactgactgcagttcgttctagtttagatagtctgattggtctaatcgtggcagaaaatcttaaagagcttttactggataatgaagtgactgacaaggaagaaaaacttgaacaagccatcaaattgattgtgaaaaaataacgatggctgaaacttagtcagcaataaaaaaccatattattttaataatacggtttttttatcaagaaatttttataaaaattgactttttattatgctataataagactggatttaaggaggggaaaatgtacgatttttattggtatccaaaatgttctacttgtagaaaagcaaaagcaaaattagatgaacttggtatagactatcaagcgattgatttgaaggaaacaccacctagtcagcaaaaatttgaaaagtggtttaaagaagctgactttcccattaaaaaatttttcaatacaagtggcttagtttatcgtgacttgaatcttaaagataagctagcaacattatcggaaaaagaaatggcagaacttctttcatcaaatggaatgcttatcaaacgcccattactcgtaaaaaatgatcaagttcagcagattggatttaaagaatcatcttataaaaaaatataaaaaaatgagttggttagactcattttttcatgtaataatatttaaatcttaggagattctaaaaaagctaaactttcaaacgaaagcgaaaatctttcttatgaagaaaatatatcatattttagaaaatctgtcaataaaaaaacggacattgtccattttttattgaatagttgtgactttgatattttgattttcaagaattgcttcggtttctttactgatcgctttatcagtaaagacttgcgaaatttcagggaatgaaaaacaagtgacggtgccgttttgcttaaatttagaagcatcagttaaaataatgacttccttagcggcagctgccatgacatgaatggcttcactacgggcaaggtcattacttctaaaaccacgtatggggtcaaaaccatcaatgccgataaataatttgtcaacataaaattcatcaactaccttttttatcagtgggcctacattgacttgggagttgttttgatattctccaccaagtaagatgactttaacggaatcggatttccggatataattggcaataaaaacagagttagtaatgatggtaacatttttccgattaaaggctaactcttcagcgagtagagcacaagtagagccagattcaatcatcactgtatccccatcaagaatattttcagcagctttaatggcaattttacgctttaaggtaacggtttttttatttttttctatcaaaaaacttctctctaaccaaatgctcagttgctgaaaaacgctatttttggtaaaaaaagtattttttaggtataatagtcagtaatagtcaaagattatttagaaaatggataaaagaaaggatggatcgatggcaggtcaaaaaaacacatcagatattattgaagcttatctgagacaactcctagaagaagcacaggttattgaaataaaacgggctgatttagctaatcaatttgacgtagttccaagtcagattaattatgttattaaaactcgttttacagcctctaaaggttttgatgtagaatcaaaacgtggtggcggtggttacatcaaaattgtaaaatatcaatattccgctcgtcatgaatttttaacggccctttatcaaaaggttccagcaaatctctcaagtaaggctgctcatgacatcgttcaacttctttttgatgaaaaagtactgacagaacgtgaagggaatttactattactcgtaatcactgacggagccatcagtccctttactcgtggtataatgatgaaaagtataataaacagattggatcgtgacgatgaaatttgaaaatgtaaaatatacaccaacactggaccgaattttcgagaaagcagcagaagatgcccaccaatatcaatacggtacgattgaaagtgctcatttattggcagcaatggctactacttcaggctcaattgcttacagtattcttgctggaatgaatgttgattcttcagacttactgattgatttggaagatttatctagccatgtcaaagtgaaacgttctgaattacgtttctctcctcgcgcagaagaagtggtcactgtagctagctttttagctgttcataataatgcagaagcagtaggaacggagcatttgctttatgcattacttcaagtcgaagatggttttggtattcaacttttgaagttacaaaaaatcaatattgtttctttgcgaaaagaaattgaaaaaagaacaggacttaaagttccagaaaacaaaaaagctgtaacaccaatgtccaaacgtaagatggcaaaaggggtagcagagaattcaagtacaccaactttggattcagtttcttcagatttaactgaagctgctcgttcaggaaagcttgacccaatgattggtcgggaagcagaagttgaccgtttgattcatattcttagtcgtagaacaaaaaataaccctgttttagttggcgaacctggtgttggtaaatcagcaataatcgagggattggctcaaagaattgtcaacggccaagtacctatcggtttgatgaatagccggattatggccctaaatatggcaactgttgttgctggtacaaaatttagaggtgaatttgaagaccgcttgacagcaattgttgaagaagtaagtgctgacccagatgtcatcattttcattgatgaattgcatacaattattggtgctggcgggggcatggactcggtcaatgatgcagcaaatattttaaaaccagcccttgcacgtggtgattttcaaatggttggggcaacgacttatcacgaataccaaaaatacattgaaaaagatgaagcattagaacgtcgtttggcaagaatcaatgttgatgagccaagtccagatgaagccattgctatcctacaagggttacgtgagaaatttgaagattatcatcaagtaaaatttactgaccaagcgattaaaagcgctgtgacacttagtgttcggtacatgaccagtcgcaaattgcctgataaagccatcgacttgcttgatgaagcagcggcagcagttaaaatttctgttaaaaaccaagaaacaaaacgtcttgaattagagaaagacttagttaaagctcaagaagaactagcggaagctgtcattaaacttgatgttaaagcctctcgcatcaaagaaaaagctgttgaaaaaatttctgacaagatttataaattctcaataaaagaggaaaaacgtcaagaagttactgaccaagctgttattgctgttgcctcaacgctgacaggtgttccaattactcaaatgactaaatctgaaagcgaccgtttgattaatcttgaaaaagaattgcacaaacgggtcgttggtcaagaagaagcaatttctgcggtttcaagagccattcgtcgggcacgttctggtgtggctgatagtcgccgtccaatgggttcatttatgtttcttggaccaactggtgttgggaaaactgagttagctaaggccttggccgatagtgtttttggtagcgaagacaacatgattcgagtggatatgagtgaatttatggaaaaacattcaacttcacgattgattggagcacctccaggatatgttggttatgatgaaggtggtcaattgactgaacgtgttcgtaataaaccctattctgtggttcttttagatgaagttgagaaagctcatcctgacgttttcaatatcatgttgcaaattctagatgatggatttgtgacagatacaaagggtcgcaaagttgattttagaaacacaattattatcatgacttcaaacttgggtgcaacggctcttcgtgatgataaaacagttggttttggtgcaaaaaatatcacggctgactactcagctatgcaatcaagaattttggaagaacttaaacgtcattatcgtccagagtttctcaatcgtattgatgaaaacattgttttccattcattggaaagtcaagaaattgaacaaattgttaagattatgagcaaatctttgattaaacgtttggcggaacaagatattcatgtgaaacttacgccatcagcaataaaactaatcgctgaagtaggatttgacccagaatatggggcacgtccattgcgtaaagcactccaaaaagaagttgaagatcttttaagtgagcaattgctctcgggtgagattaaagcaggaaatcatatttccattggtgcttctaataaaaaaattaaaatcgctcaaattgtttgagatgaaagttgtttcatgttataattaaattagaaataaaggaaaggacagttcgaaaagattcagaagtcctgaaaattccaaaagtttaagggcttcattgaaacaaaaagaactgttgaagaggtactcttatgatcaaatttaatatccgtggcgaaaacgtcgaagtgactgatgcaatccgcgcttatgttgaagataaaatcggaaaactcgataaatatttcaacgatggtcatgaagtaacagcctatgttaatcttaaagtttacactgaaaaacgagctaaagttgaagtaactcttccagccaaaaatgtaactctccgtgcagaagacacttcacaagatatgtactcatcaattgattttgttgaagaaaaactcgaacgtcaaattcgtaaatacaagacacgtatgaaccgtaaaccacgtaatgctgtcccaactggacaagtttttggtgatgaatttgctccattagatacaactgatgaagttgctgaggatcacgtagatattgtacggactaaacatgttgctttaaaaccgatggatgctgaagaagcagtacttcaaatggacatgttaggtcatgatttctacgtctttacagatgctgacagtaatggaacacatgtcgtttaccgtcgtacagatggtcgttatggcttaattgaaacagaataaaaattaaggatagattttttctatcctttttcattattattcaaatgataaaatttcaaaatgtaagcgcaaaaccttttgaagtttaggtttgcgaagattttcacttgaaaaatctttcaaaaaatagtaaaatcaaagatgtattaagagtgcagacgcacttaaaaataataaggagactaaaatgtcaattattactgatatttatgctcgcgaagtccttgactcacgcggtaacccaacacttgaagttgaagtttacactgaagacggtgcattcggtcgcggtatggtaccttcaggtgcttctactggtgaacacgaagcggttgaacttcgtgatggcgacaaatctcgctacaacggacttggtactcaaaaagctgttgacaacgtaaacaacatcatcgctgaagctatcatcggttatgaagttactgaccaacaagctattgaccgtgcaatgattgctcttgacggtactgaaaacaaaggtaaattgggagctaacgctattcttggtgtttctatcgctgctgctcgtgctgctgctgatgaacttggtgttccactttacaactaccttggtggattcaacgctaaagtattgccaactccaatgatgaacatcatcaatggtggttctcactcagacgctcctatcgctttccaagaattcatgatcgtaccagttggtgcacctacattcaaagaagcgcttcgttggggtgctgaaatcttccacgctcttaagaaaattcttaaagctcgtggacttgaaacagctgtcggtgacgaaggtggattcgctcctaaatttgacggaactgaagacggtgtagaaactatccttaaagcaatcgaagcagctggttataaagcaggtgaagatggcgttatgatcggtttcgactgtgcatcatcagaattctacgaaaacggtgtttacgactacactaaattcgaaggtgaaggcggtaaaaaactttcagcttctgaacaagttgactaccttgaagaactcgtttctaaatacccaatcatcactattgaagatggtatggacgaaaacgactgggacggatggaagatccttacagaacgtcttggtaaaaaagttcaactcgttggtgacgacttcttcgttacaaacactaaataccttgaacgtggtatccgtgaaaatgcttcaaacgctatcttgatcaaagttaaccaaatcggtactttgacagaaactttcgaagctattgaaatggctaaagaagctggtttcacagcaatcgtatctcaccgttcaggtgaaactgaagattcaacaatctcagacatcgctgttgcaactaacgctggtcaaatcaaaactggttcactttcacgtacagaccgtatggctaaatacaaccaattgcttcgtatcgaagaccaattggctgaagtggctcaatacaaaggtcttaaagcattctacaaccttaaaaaataaggtttattaatgaatgatttaacaatagctcttctctttagttagagaggagctatttttgataagagtccatcttcaatctgatagacgctgtcactatttttaatcattctttggtcatgggttaccataattgtcgctttattctttagatgagcttcctgtcttaataattcaacaacttgataagcatgttcagtatccaaacttgctgtcggttcatcagctaatattagatttggttcattaaataatgcacgggcaatggctgctctttgtcgttcaccgccagaaaggtcactaggatacttattttttaaatccaaaatatcaagtgagtcgagaagttcaagcccttttttagaggctaacttttcatgattaattttatcaattaaaagaaattgttcctcaagcgtcaaatatggaattaagtttgaactttgtaagataaatcctatttctttaaatctgagtttagaacgttttttctctgaaagtggtgtaaaatttaacccattaatcgttatattcccagaagtaggactctgtaatcctcctgctattgtaaggaaagtgcttttcccagaaccagaaggaccaataattgaaacaaattctccttggttcacttctaagttgattccttttagagcttgaatcttattatgaccactcccaaaggattttgtaatattatccattttaagtattgctttcattttaacctccaattgcttttgttgggtcaatcttgcgaattgtaatgattgaaaaaagtgacccaataattgatacgatgatgagaatgagagagtaaagtaaccagtttgttatgctaacttcaaaaggcattgcttcgggtaggataaagctggtaccatagctcgcaacaaaggcaactaaaacacccaataagataagaatgaaagtttgaccaagtaaggagttcatgattgtagtatttgaaatcccttgtgctttcatgattccaaaaattggtactttttgtaaggtaatcacatacataaatactccgatgattagtagaacgatgagtaataagaaataaatcatagcgcttagcgtcatattttgcgcagagtatccaagaatgtcgtttattaattcaggaatagaaattactttatattgatttgaaattgctgaattgatatcaatttttcctgatttgacaactagagcgttcacagaaaaaggagtcttactattcttgccatattttatttgattgagagcagagaaagaggtgtaaacggttgggcttgcagaataagaagatgctttagaaataccgacaatttttagcttaatattgttattaccaatggaaacttcttgaccaatcttatatccttgattagccaattttttcgagataataatatctaaactattgtcagcaaattttttcccatcaaagacttttggcatgatatttgaatcacttggtaaagccatcactgtgatattgcttcgttcactatttgtcttacgcattgaagtggaaaacaatgataattctgagccattttccaccttaattttttctaaatcactagaagaaatttgcgaagcagaaataatattgtttgaactggttgatagaattattttctcggcattccaatcaataaccgactgtttaaattgattggcaagtccaacggaaaggccagacagtataaaaactacataagcgattaaaaaaataatggctccgattaaagtgtagcgagccttattataacgaatttctctaagtgctaaaaacataaaattcctttctattttttgctttcagtaacataattaagcaagccctctgtgagcaatttgatttctttatcgtaagtttcaataaacttttgttcattccaattttcactaaacatgcgataaactagattgtgaatgactgattttaatacttgggaaataggattatcaagttcacgagcgggaacagttacctcgcctttaggcttccaatctctttctaattcataagtccaatctaaaaatcgatatttataaagattatattggggcgaatttactaaattttcaagaagaagatacttgtatttatcaagagcgacttctagaggatattcttttagtaagttaaaaaataaatcatgaatctcgacagtttcctgtgacaagatataataatatgaatccttcaaatcttcaaagtattgataaaaacttcctcttgggatatcaagtgcttttacgatgtgcatgattttagcttcatggaaagagtgcgtttgaaattctagtaaacaggcatcatagacacgttttcgtttttcgtcagaaagactaaaataggttgattttggcattttttctccaatcattcaatttatgacactatgtcatttatttaattctaacaaataaaattcttaacttcaataatttgaatttatattgaaaaaactactgacagacctgtcagtagttttacttttaagttttttgataaattaatttactgacagattagtcagcaaaatatttaggataatttatttggctaagtctctttcaagagctaatctttgaactttcattgttgcagtacgtggaatttcatcgtaagccatgagaataggttcatttaaaaatggtaagtcaacaattgaagcccaccaagctgaccaatccatttccgcattgtcagccaaggctaagataggttgtggttttccagatttatcgcgaataatcacaacttcatctaaaaaatcatgttgatctaaaaggaggtcttcaattgctaaatttgattcaattttatcaattaaatcgacttgacggtcatggaggaaaagatttccttcttcattcattaggccccaatcgccagtatcccaccagtcgccatagacttctttgttgaaacgatcctcttctttgtagtaagtcaaagcacgtcctttagaaaggaaatgaattcttccaggaatacctgcagggcattcatttccattttcgtcagcaatacgtgccttagaaagaccaggcataccaattcccatttcacgagcatcagtatctgctagggttgataaacggtgttttttccaaatcattggaccgcattctgactgaccatagatttgtaaaaagactgggttgtcgtgtttagaggctgataaaaaagtatgcattgtttctttattaatcgcatcaaaagttgaatgaagatagcgaatcgaagaaaaaatttcaggttcctgcttcgcaagatttgccaagcgaacaaagtcattagggtgagtttcaaaagcataaggctgatgtttagaaaatagattgacaagattagctctcgataaatcattaagtggcattaggccaaaaccaaaggtcatggcagatgaaacgccaatattgaaacgagaatgaacgggcgaaatgtggaaagccaaaatttcttctttatcgggcatccaatccatgaccgttctttgaagcacccagcgccagcccatggaattggcagagtgggcaatcaatttcggaacaccagttgttccagaagtatgagtgagataagcaatctcgtcattatccagttgctgactatcaacaagatgacttggtttttgcgaagcaaatttgctgacagaaagttttttagaattcttaagatttttcatttctgtcacagtctggtcagtcacttggtcataaatgagccaagggtcatctaaacgaccagccaaaatatccattgtttcagcagggaggtggtaagaaatcatcgctggaactgcaccaagataagaaacagctacggcaagaagataggtatcaaaagcacttgatttaaaaataatgactttgtcagattttttgattcctagttccgataaaagacttgccttatcaacaattgcttgatgggtcttttggtaagttgtttccagagctaattcagggaaggcaccaacagtttggtcaaaaataattgggctatcaggaaattgttccgctgattttgtaaagtttagatacaggtttaggggttcatgtttgaatttcaaaaatagtctcctcaagttaataagtttattatatcacaaagtattatttagaccaacttccttcaaaaaacttttcgttaaggctttgaaataaaataatgagaaaaaaataggaaaatctgctacaattagaaggagaagaagaggatttaaatccttttttattaggaaaagaagggatagataggctgatatgataaaaaattatgaactatccaatgaaaaaaaattgatctcaacttctgagatgaagaatttcacttatgtcctcaatccaacacgtgaagaaattgggaatatctcagaacactatgattttccttttgactatctatctggaattttagatgactatgaaaatgcccgttttgaaacagatgataatgacaacaatctgattcttttgcaatatcccgccttgtccaaatatggagaagtggctacttttccatattctttggtttggactaagaatgaatcggttattttggcccttaaccatgaaattgataatggtctcatttttgaacgagaatatgattataaacgctataaacaccaactaatttttcaagtgatgtaccaaatgactcatacttttcatgattatttgagagactttagaacaaggcgccgccggcttgaagttggtatcaaaaattcaacaaaaaatgaccaaattgttgacttaattgccattcaagcaagtttgatttattttgaagatgcgctgcacaataatatgcaagttctccagaattttattgattacttacgagaagatgatgaagatggttttgccgaaaaaatctatgatatttttgtcgaaacagaccaagcttatacagaaaccaagattcagctcaagttactagaaaatctccgagatttgttctcaaatattgtctctaataatttgaatatcgtcatgaaaattatgacctcagcaacatttgttctaggtataccggcggttattgtcggcttttatggaatgaatgttccgattcctggtcaaaattttaattggatggtctggctcattttggtgcttggaattttattatgtgtttgggttacttggtggctacacaaaaaagatatgttatgaatggagataatttctccatttttttcatctttgtgaaaaaattaattagtgataataaatcatgaagttagcaatgtttgtcaaagttattttgtgaattaattatgaaaacgttttaaaaaagtataacagatattaaaataattgaaactgtattagtaaagaatctgtaatttctcttgaattctgtttgctattatcaaactgtatgatataatgaagttgtaatttgaaacagaaagaacaaaggagatttcaaaatgaaaaccgaagttacggaaaatatctttgaacaagcttgggatggttttaaaggaaccaactggcgcgataaagcaagcgttactcgctttgtacaagaaaactacaaaccatatgatggtgatgaaagctttcttgctgggccaacagaacgtacacttaaagtaaagaaaattattgaagatacaaaaaatcactacgaagaagtaggatttccctttgatactgaccgcgtaacctctatcgataaaattcctgctggatatattgatgctaatgataaagaacttgaactcatctatgggatgcaaaatagtgaacttttccgcttaaacttcatgccaagaggtggtcttcgtgttgctgaaaagattttgacagaacacggtctttcagttgacccaggtttgcatgatgttttgtcacaaacaatgacttctgtaaatgatggaatcttccgtgcttatacttcagcaattcgtaaagcacgtcacgctcacactgtaacaggtttgcctgatgcatactctcgtggacgtatcattggggtatatgcacgtcttgctctttatggagctgactaccttatgaaggaaaaagcaaaagaatgggatgcaatcactgaaattaatgatgataacattcgtcttaaagaagaaattaacatgcaataccaagctttgcaagaagttgtaaactttggtgctttgtatggtcttgacgtttctcgtccagcgatgaacgtaaaagaagcaatccaatgggttaatattgcatacatggcagtttgtcgtgttatcaatggtgctgcaacttcacttggacgtgtgccaatcgttcttgacatctttgcagaacgtgaccttgctcgtggaacatttactgaacaagaaatccaagaatttgttgatgatttcgttttgaaacttcgtacaatgaaatttgctcgtgctgctgcctatgatgaactttattctggtgacccaacattcatcacaacatctatggctggtatgggtaatgacggacgtcaccgtgtaactaaaatggactaccgtttcttgaacacacttgatacaatcggaaatgctccagaaccaaacttgacagttctttgggactctaaactcccatattcattcaaacgttattcaatgtccatgagtcacaaacactcatcaatccaatatgaaggtgttgaaacaatggctaaagatggatatggcgaaatgtcatgtatctcttgttgtgtctcaccacttgacccagaaaatgaagaaggacgtcataatctccaatactttggtgcgcgtgtaaacgtcttgaaagcaatgttgactggtttgaacggtggttacgatgacgttcataaagattataaagtattcgatattgaacctgttcgtgatgaaattcttgactatgatacagttatggaaaacttcgacaaatcactcaactggttgactgatacttatgttgatgcaatgaatatcattcactacatgactgacaaatataattatgaagcagttcaaatggccttcttgcctactaaagttcgtgctaacatgggatttggtatctgtggtttcgcaaatacagttgattcactttcagcaattaaatatgctaaagttaaaactttgcgtgatgaaaatggctacatctacgattatgaagtagaaggtgacttcccacgttatggtgaagatgatgaccgtgctgatgatatcgctaaacttgtcatgaaaatgtatcatgaaaaattagcttcacacaaactttacaaaaatgctgaagctactgtttcacttttgacaatcacatctaacgttgcttactctaaacaaactggtaactctccagttcataaaggagtattcctcaatgaagatggtacagtcaacaaatctaaacttgaattcttctcaccaggtgctaacccatctaacaaagctaaaggtggatggttgcaaaatcttcgttcattagccaaattggaattcaaagatgcaaatgacggtatttcattaactactcaagtttctcctcgtgcacttggtaaaactcgtgatgaacaagtagataacttggttcaaattcttgatggatacttcacaccaggtgctttgattaacggtactgaatttgcaggtcaacacgttaacttgaacgttatggaccttaaagatgtttacgataaaatcatgcgtggtgaagatgttattgttcgtatctctggttactgtgttaacactaaatacctcacacctgaacaaaaacaagaattaactgaacgtgtcttccatgaagtactttcaaatgatgatgaagaagtaatgcacacttcaaatatctaattcttagtattaaaaaatataaagtctgtcagttctactgacagactttttttctataaactaaaaataatagttaaaaactattttttttagtttaagaaaaataaaatttgtgctaaaatagatgaatgataaaggtaatcggattaacaggcggaattgcgagtgggaaatcaacggtggttgattttttgatttctgaaggttatcaagtaattgatgctgacaaagttgtccgtcagttgcaagaacctgatgggaaactttttaatgtaataatggaaactttcggttcagattttactgacgaaaatgggaaattaaaccgagcaaaattgagtgctttagttttttctgacccaaatcaacgtcaaaaattgtcgaatttacaagacgagattattcgtaaagaattatatgctagacgtgaccagctgataaaagagctcagtgaaaagtctgtcagtaacagctttgatacagaagcgcaaccaaaaaattcgtcagtaaatcaaatcatatttatggatattccattattattagaatatcattatgaaggttttgatgaaatttggttagttgcgatacctgaaaatttacaaattgaaagattaatggaaagaaatagctttacagaagaagaagctaaaaaacgaatttcttcacaaatgtcgttgtcagaaaagaaaaaatatgcagatataattttagataattctggaaccattgatgcactaaagaaacaaatccagcaagaattggctaggataatcaaagagaaataggggtgaatcacacgaaaacagttaattggaaaaggaatttatttataacatggattggctgcttttttgtaggttcttcattttcactagtgatgccctttttgcctttgtacatacaaggattgggcgtaagtggtgggaatgttgaactttactcagggttagctttttctttgccagcattagcttctggtcttgttgccccgatttggggacgtttagctgatgaacatggtcgtaaagtgatgatggtaagagctagtatcgtcatgactttgaccatgggaggaatcgcatttgttcccaatgtttggtggttacttggccttcgcctactgatgggatttttctcaggctatattcctaactcgactgccatgattgcctcacaagctccaaaagataaatcaggctatgcacttggaaccttagctactgcaatggtttctggaacattgattgggccatcacttggtggattattagccgagtggtttggaatggcaaatgtctttttgattgtaggggctttattagcactagcaactttactgactatcttttttgttcatgaaaactttgagccgattgcaaaaggtgaaatgttgtctagcaggaaaattatcaataaagtaagtaataaacaaattctttttggtttattggttacaacatttattattcaaatcacctcacaatctattgaaccattcgttactttatatattaaaacgctgacaacaagcactaataatctgatgtttatttcaggtctaattgtctctgcagtgggcttatcagcaatgatgtcctcaagttttttgggtcgtttaggtgataaatatgggtcacatcgattgatcttgattggtttggttttcacatttattatttacttgccaatggcttttgtgcaaagtccattacaacttggaattttaagattccttcttggctttggtacgggggctttgatgccatcagtaaattctctactttcaaaaattacgccaaaagaaggagttagtcgaatttttgcttatgcacaaatgtgctcaaatctcggaatggtcaccggtcccttggttggttcagccattgctgggtacattagttatcgagcagccattgtcgggacaagcctatttgtcattgtcaatatcatctggtcatttattaacttccgaaaatatttacggaaacggagtattatggaatgagagttaaaattacattaatttgtagttcttgtggaaataaaaactatattagcagcaaaaataaggccacacatccagaaaaagtggaaactatgaaattttgtccgaaagaacgaattgttacacttcatcgagaaggctaaaaagcaagatatttcttgcttttttttgtttaaaataagctttaagtatatacagtcattaagaattgtgataatattatataataaactaaataatatttcattagaggtattttatgcaaaaaaagacatctctcctttttattccttttaatagtagctaaaaagattaccagtaaatatatttattataattttgtgacactatccaacagagtcactgacagagctgtaaattaataaatttcctcatacaaaaaaatagagtaaatgataataaaaatttctcttgctggtcattaacttatggttgctttgaatatctttataaattattcaactcatgctataataatatgaatgaggaaaaaaagataatgaatttgaataagaataattttttaaactactctatattaattccatacctaattcttgcaggaattgggatagtaatggtattttcaactacggttcctgaccaattgcaaaaaggcttaaatccttataaattagtaattaaccaaacggcatttgtactattgagtattattatgattgcagtgatttaccgtctgaaacttagagcgctcaaaaatagaaaaatgataggaataattatggttattttaattctgtcattaattttctgtagaataatgccctcgagttttgcactgacagctcccgttaatggagccagaggctggattcatattccaggaattgggacggtacagccggcagaatttgccaaggttttcattatttggtatttagcgtcagttttttcaacaaagcaagaagaaattgaaaaaaatgatattaatgaaatttttaaaggaaaaactctaactcaaaagctttttggggggtggagattaccagttgttgcaatactgctagtcgaccttatcatgcctgacctcgggaacactatgattattggtgcggttgcattggtaatgatcggtgcaagtgggatttcttggcgttggtattctggctattccagattaattttatctctgatggtcattttcctaggttttctttttattgtaggtggggatattattcctagttttttaccaattgcatatatcaataaacgatttgaagcctttgttaatccctttactgatttggccaattcaggtcaccagttagctaattcctactacgctgttgtaaatggcggttggacaggacgtggcctaggaaattcgattcaaaaaaatggatttttaccagaagctcaaaccgactttatttttccaattgtagtagaagaattgggaattattggtggaataattatattagcaattctatttttcttgataagccgaatgttaatcgttggaatcaaagccaaaagtgtctttaattcactgattatgattggtgtttctggattattgctaattcaagtttttgtcaatgttggtggtgcgattgggattattccagaaacaggggtaactttccccttcttatcacagggaggctcctccttcttggtcctctcgcttgggattgcttttgccttgaatatctcagctgatgagaaacgtcgagaagtttctgagctttctaatcactatagtagcagtgtcccaaattatgaaaacgattgacaaatgtcagtcgtttaaaagtgtataaaagatttttataatatatggaatagtgaaaggaattaataattacctttccaaacaagcctcattaaggagtcaaaatgaaaaaactactcgtcgccaatcgtggagaaatcgccgttcgtgtctttcgtgcctgtaatgaactcggactttctacagtagccgtctatgcaagagaagatgaatattctgttcatcgctttaaagcagatgaatcttaccttatcggtcaaggtaaaaaaccaattgatgcttatttggatattgatgatattattcgtgttgctcttgaatcaggagcagatgccattcatccaggttatggtctcttatctgaaaatcttgaatttgctacaaaagttcgggcagcaggcttagtttttgttggtcccgagcttcatcacttggatatatttggtgataaaatcaaagcaaaagctgcggctgatgaagctcaagttcccggaattcctggaacaaatggtgcagtagatattgacggagctcttgaatttgctcaaacttacggatatccagtcatgattaaggcagcattgggcggcggcggtcgtggaatgcgtgttgcgcgtaatgacgctgaaatgcacgacggatatgctcgtgcgaaatcagaagctatcggtgcctttggatctggagaaatctatgttgaaaaatacattgaaaatcctaagcatattgaagttcaaattcttggggatagtcatggaaatattgtccatctccacgaacgtgattgttctgttcaacgtcgaaatcaaaaagttattgaaattgccccagccgtaggactctcgccagagttccgtaatgaaatttgtgaagcagcagttaaactttgtaaaaatgttggttatgttaatgctgggacggttgaatttttagtcaaagatgataagttctactttatcgaagtcaacccacgtgttcaagttgaacacacaattacagagctcattacaggtgtagatattgttcaagcacaaattttgattgctcaaggcaaagatttacatacagaaattggtctcccagcacaagctgaaataccacttttgggctcagccattcaatgtcgaattactacagaagacccgcaaaatggctttttaccagatacaggtaaaatcgatacctaccgttcaccaggtggtttcggcattcgtttggacgttggaaatgcctatgctggttatgaagtgactccctattttgactcgcttttagtaaaagtttgtacctttgctaatgaatttagcgatagtgtacgtaaaatggatcgtgtgcttcatgaattccgtattcgtggggtgaaaactaatattccatttttgattaatgttattgccaatgaaaactttacgagcggacaagcaacaacaacctttattgacaatactccaagtcttttcaatttcccacgcttacgtgaccgtggaacaaagaccttgcactacttatcaatgattacagtcaatggtttcccagggattgaaaatacagaaaaacgccattttgaagaacctcgtcaacctctacttaacattgaaaagaaaaagacagctaaaaatatcttagatgaacaaggggctgatgcggtagttgaatatgtgaaaaatacaaaagaagtattattgacagatacaactttacgtgatgctcaccagtctcttcttgccactcgtttgcgtttgcaagatatgaaaggaattgctcaagccattgatcaaggacttccagaacttttctcagctgaaatgtggggtggggcaacctttgatgtcgcttatcgtttcttgaatgagtcgccatggtatcgtctacgtaaattacgtaaactcatgccaaataccatgttccaaatgcttttccgtggttcaaatgcagttggatatcaaaactatcctgataatgttattgaagaatttatccgcgtagctgcacatgaaggaatcgatgtcttccgtatctttgatagcctcaactggttaccacaaatggaaaaatcaatccaagcagtgcgtgacaatggaaaaatttccgaagcaaccatttgttatacaggagatatccttgacccaagtcgaccaaaatataatatccaatactacaaagatttggcaaaagaattagaagctactggggctcatatacttgccgttaaagatatggcgggcttgttgaaacctcaagcggcatatcgcttgatttctgaattaaaagatacagttgacttaccaattcacttgcatacacatgatacttcaggaaatggtattattacctattctggtgcaactcaagcaggagtagatattattgatgtggcaacggccagtcttgctggtggaacttctcaaccttcaatgcaatcaatttattatgcccttgaacatggtccccgtcatgcttcaattaatgtgaaaaatgcagagcaaattgaccactattgggaagatgtgcgtaaatattatgcaccttttgaggcaggaattacgagcccacaaacggaagtttacatgcatgagatgcctggcggacagtatactaacttgaaatctcaagcagcagctgttggacttggacatcgttttgatgaaatcaaacaaatgtatcgtaaagtaaacatgatgtttggcgatatcattaaagtaactccttcatcaaaagtagttggtgatatggcactctttatgattcaaaacgaattgacagaagaagatgtctatgcgcgaggaaatgagctcaacttccctgaatcagtagtttcattcttccgtggtgatttaggtcagcctgttggcggctttccagaagaattacaaaaaattattgtaaaagacaaatcggtcattacggatcgtccaggattacatgccgaaaaagttgattttgcaactgtaaaagctgacttggaacaaaaaattggttatgaaccaggtgatcatgaagttatctcttatattatgtatccacaagttttccttgattatcaaaaaatgcaaagagaatttggagctgtcacactacttgatacgccaactttcttacacggaatgcgtctcaacgaaaaaattgaagtccaaattgaaaaaggtaaaacgctcagcattcgtttagatgaaataggagaacctgacctcgctggaaatcgtgtgctcttctttaacttgaacggtcagcgtcgtgaagttgtgattaatgaccaatccgttcaaactcagattgtagctaaacgtaaggccgaaacaggtaatccaaaccaaattggagcaactatgcccggttctgttcttgaaatcctagttaaagctggagataaagttaaaaaaggacaagctttgatggttactgaagccatgaagatggaaacgaccattgagtcaccattcgatggagaagttattgcccttcatgttgtcaaaggtgaagccattcaaacacaagacttattgattgaaattgactaactttaaattaaccctaccattatggtagggttttttattttctaaaaaaaagtaattttaattttcagaaaataataattttcggaataaaaagtgtataataatgaaatagatggaggtatttatgaatttaatgaataaagaagaaaaaatgattaaaaattcacaaattcctagtgaattttacaaaaagtacaacgttaaaaaaggtttaagagatattaatgggaaaggtgttttagcgggattaactaatatatctgcgatccattctttcgataaggaaaggaatcaaattcctggtgtcttagaatatcgagcctataatattaaagatatcgttagtgacttgagaagtaaaaatcgttttggctttgaagagatgacctaccttttattatttggagagttaccttcggcaaaggaacttcaagaatttcaaattctgttagctagcaaaagaactttacccgagttttttgttcgcgaaacaatactgaccaatccttcaagtgatgtaatgaattctatgagtcgctgcctacttgcacttgctagttacgataaaaaagcttcggatatttcaattgagaatgtcttagagcagtcgctagcactcattgcagattttcctcttcttgcgatttatagttatcaagcttatattcattattttaagaaagaaagtctttatattcatttcccagaccctgaattgacaacggccgaaaatattttgcgtatgctacgaccagattgtcattattcagatatggaagcaaaagtattagacattgctctaattctacacatggaacatggcggagggaataattagaaatttacgactcatgtggttacttccagtggaacagatacttatgctacgatagctgctgctctttcgagtttaaaaggaccaaaacatggtggagcaaacatcaaagcggcaaaaatgctagaaaatattaaagaaaatatctctgattacaataatgatgaagaaataaaaaaatatcttcatcaaatattaaataaagaagtttttgataagcaaggattgatttatggcattggccatgcgatctatagtgtgagtgatccacgttttgaggtttttaaatcctatgttgaaagtctagcaaaagaaaaaggattagaagaagaatttaaactttatgaaaaagttgctttccttgctcctaaagtgatatccgaaaatagaaatatttataaaacaatttgtccaaatgttgacttttattcaggatttgtctataaaatactggaaattccaaaagaattatttacccccttatttgccatcgctagaattgtaggttggttggctcatagaatggaagaattaattaatatgaataaaatcataaggcctgcttatgagagtattttagagtctaaagcttatacaagattggaggaaagatgaaaactttaaaaattaatgataaagagtctcactattttgatattagtgagactgagagaattgaagactttccatatagtttaagagttcttttggagagtttgattaggcagaaaaatgataaaaatattgatcaagcttatattcaagccattaaagattatttaaaaagagaagtcggtcaagaaaccgtttttttaccaagtcgtgtggtccttcaagattttacaggagttccagccattgttgatttggcagcaatgcgtgatgcgatgcttaaattaggaaaaaatcctgagttaattaacccagaaattccagtagatttagttattgaccattctgttcaagtagattttcaaggaaatgaacaagccttcttattaaattcaaaaaaagagtttgaacgtaatcgtgaacgctacgaatttttaaaatgggcagagcaatcttttgataattttagagtggttcctccagcaacaggaatcattcatcaagttaatattgaatatttaagcgaagtaattagcgaaaaagatgggcttttatatccagatagtgtttttggtacagatagtcatacaacaatgattaatgctttaggcgttctgggttggggagtcggagggattgaagctgaggctgtaatgttaggggagcctagctcattaactgttccagaagtagtaggagtaagactaataggaaaacttggagtatttgcaaccgcgacagatttagctttaacagtcacgaaaattttacgagatgaaaaagtggtagggaaattcgttgaattttttggggaaggattaaaaaatttaagtttagccgatcgagcaacaattgcaaatatggctcctgagtatggtgccacctgtggatattttcctattgataatgaaacattgaagtatcttcgggcgacaaatcgttctgaggaaatagttgcgcgagtagatgcatatgcaaaggcaaataaactattttatgatgatagttaccaaccacactatagcaaagtcattgatattaatttagaaaaagtagaaacacgactatcaggaccttcacgcccgcaagatatgctggaattaggagatttatctcataattttgaaaagttcgttgaacaacaaaaaaattgaaagaagaagatgggaaaattgctattgcagctattacgagctgtaccaatacgagtaatccccatgtaatgatgatggcaggattactcgcaaaaaatgcagtagaacaaggtcttgaagttcctagctgggtcaaaacatcattagctccaggttcaaaggtcgttagctcttacctagacaaggcaggtcttcttccttatcttgaaactttagggtttaatgtaattggatatggttgtacaacatgtattggtaattcaggaccacttttaagagaaatagaaaaagaaattactgacaaggaactagttgcaaccagtgttttaagtggaaatagaaattttgaaggaagaattcatccattggtaaaagcaaattatcttgcaagcccccctttagtagttgcttatgcactagctggttccgttagaaaaaatctaactaaaaatccattaggtacgaatcttaaaggtgaaaaagtatatctgaaagacattttacctccttctgatgaagtggacgatttagttcaaaagtatgtgactaaagatttgtatgccaaaacttatgcaaaaatttttgatgaaaatacaatttggaacgatattcaaacgaaaaaaagtcaagtctacaattggaaaactgactctacttatatttctaatcccccttattttgatgatatgacattagtagctactaataaaaatatcctttcaagtttgcaggttttagcaaaatttggagattctatcacaactgatcatattagtcctgcgggtaatattccgttgaagtcacctgctggcgattatttaagaaattcaggaataacttataaagactttaatagttttggttcaagacgagggaacgacaaagtgatgactcgaggaacttttgcaaatattcgtatcaaaaatcaacttattgcaccacttgaaggcggatattctaaatttgatgatgaaattttacccatatatgaggtagcacaaaaatataaagaaaaaggagtaggcttgattgttcttgctggaaaagattacggaatgggttcaagtcgggactgggcagctaagggaacaaaattacttggagttaaggccgtaattgctgaaagttttgaacgtattcaccggagtaatcttgtcatgatggggattcttcctttacagtttttagatgatcaaaatgcgaaaagtcttggattgactggagatgaagttttttctatcgatttaccagttcatcctaaaattcatgagaaaatcacagttcaggctgatgagaagaagtttcaggttctcttacgctttgattcacaggtagatttggattactacactaatgatggaatcatgccttatgtgattcgtaaaaaataaaaattaggtgaaaattattatgaaaattgaaatgaagaacgggaaattaattgtaccagattatccaacaattggttacataagaggagatggtgttggtgaggacatttttccacaagcaaagcgtgtttttgatgctgctgttctaaaaatctttggcgaaaaaaagaaaatagattggcaaaaattattggcaggcggagaagctttcgcaagtaggggtgaatatcttcctgatgaaacacttgagcagattaaagaaaatatgatcgcaattaagggaccgttaatgactccagttggtgagagttttcgttctattaatgtcactttgagacaaaagctagatttgtatgcttgcgtaagacctgtagaatactttacagggataaaatctcctgtaagagcaccagagaaagtcaatatgacaatttttagggaaaatacagaggatatttatgcaggaattgaattttcttcttcgtcaaaagaatctaaaaagttaataaattttttggaaagagagctgtctgtccattcgattcgctttgcagaaacttctgcgattggaatcaaacccgttagccctgatggaagcaaacgtctggttagcgcagcctttgattatgctataaagatgaataagaagcgcgtgacatttgttcataagggaaatatcatgaaatttacagaaggaggatttagaaaatggggctatgaggtagctaaaaattatccaacttttacaaaactagaacacgataagataaaagaagaaaaaggcactgaacaggctgaaaaagagaaaaatattgcactaaaatcaggtaaaatttatgttgatgatgtgattgctgataattttcttcaacagattatccttaatcctgataattttgaggttgttgccactcttaatttaaatggggattatatttctgatgcccttgctgcccaagttggaggtattggaatcgcacctggagcaaatattaactatgaaagtggccatgctatttttgaagcaactcatggaacagctccggatatcgctggtttgaatcttgccaatccctctagccttttattatcaggagtcatgatgtttgaatatattggatggcaagatgtggcaaatattattagaagagctttagtttctacttttaaactaaaaaaatacacttctgatttaggtgggaatctttcaacatcttcttttggagatcttcttatagcttatattgagaatgattaaataaaaaaagccctagctttactaggactttattgcttattattttaatgaattattttccataatttcatcaatgaaaccatattctaaagtttctttggcatccatccaatggtcacgttcagcatctttgtgaatttgttcaagtgagcgattagaattatcagcaaggatttgttccaaacgtttacgtgttttcaaaagttgttcggcgacgattgccatatcagtttgttgagtaccttgacctgcaccacccattggttggtgaatgaggtattcagcatttggtaacatgaatcgtttacccttagtaccgcttgaggcgatgattgttcccatagaagcagccattcccataacgatagtttggacatccgatttgataaagttcattgtatccacgatagcgagcccagctgatacagaaccaccaggggtgtttacatagagataaatgtctttagtattatcttgtgcatccaagaaaagaagttgggcaatgatagaatttgccataccatcttcaacaggtcctgtcagcatgataatacggtcttttaaaagtcgtgaataaatatcataagcacgttcaccacggcttgattgttcaataacggtaggtactaaataacccatagaatgaatctcctttataaataagatatggactcaatttaggaataaattaagttcaaatgtttatttttctatattataactcattggtcaaaaaaggtcaaagaaaattgttttttttagcaacttttactaaaattattaaaaaaagagtttaaactttcttaacgctttcaaatttgttataattatggcatgaatacagaacttattattgcgatgatttttggcctgattatcggcgcatggttgatgattgcaggcatctacatttataaaatttatgacgaaaatcgttataagaagcgattaactattgaaaaattactgcgtgaaattgaagtccgaaacacacttaatcaaaaagtgatcgagattcttaatcgtccaattactggtaatgataaggaattgattaatcctcagagtgatgtaaaagtccctttttatgattataattttttgaagaactatacctcaatgtataatttatacattccaacttattttttgaatacttttttcaaaaaattgtcacatcatttagcagtatttgacgatgaacaagatttgaaaaatggcggatatattttcaaagaatcacgaacaatctttgaaaacttttctgttgaaattacagatgatattgaagccaaaaaacgagagttacagaaggcaaaaaatgtttatccttcaatgttgaaaaagcaacattataatatttaagatgataaaaaatccactattttaggtgactttttttacttttgctgtttgaaaaaatttgtgaaaaaactttgaaaaggtctttttttaagtctataaatatggtataattgtacaatcattgatgtttaatactattagataaataaatatacacgaaggagagacgatgatcacaatctatacagcaccctcttgtacaagctgtaagaaagctaagacatggctttcatatcaccatatcccatttaacgaaagaaatctcatcgcggatcctttatcaaccacagagattagccaaattttacaaaaatgcgatgatggtgttgaaggattgatttcaagcagaaaccgttttgtgaaaactttaggtgttgattttgaagacatttcactttcacaagcaattaaaatcatttctgaaaatccacaaattatgcgtcgtccaataatcatggacgaaaaacgtcttcatgtaggttataacgaagaagaaattcgtgcatttttacctcgtaccgttcgtgttttagaaaatggtggagctcgattgcgttcagcaatttaataaaatattcatttttggaatttttatagacgcgtttgcgtctttttttgttaaataatgataaataaaaaactactggtagagattaccaggagttttgagtagccaaagttagaagtatgtcaataataaaaatgaatattggagagtctagttagaagcaaccgcagactcatcaagttcaaaatcatcaagagtcgttgctgaaataaaaattgtgggcaagtatggatcaactgcggaaaccgcagcaagtgaaaggagcagtaagcttttaaattccatgatgaacctccagcaaaattatatttgtaaaaagattataacacaatattcagaaaattcaaccttttgatttgtaccctaaaaactcagagtttatcatttttgaaaaagtcttactttccattcactttcttcttgaacaactcctctgagcgagttgataaacataacgagccaggtgaacgatattgcaaaagcaatgatttcaaagactgttaatgagagataatgaatgctcataaaagcgaaggcagacacaattagagcgatcaacgcggtccatgataaggtaagaaactctttagaaatagaaggaactaaccattttaaaaagataatcatgagaagtacaactcctactaaaccaaaagcggaattgttatgaataggcattgtccaagactgtgcaggaaatatccctacgaaagcaatcaagattgagataataatataaaaaatacgaattattttaaatttataattgtagagcttgcttttagaaaattccgcaaagagaaaatctgtgatagtaagaagaataagagcagagaaaattaaagtaatattgaactgccaacgttgtgtggcttctccagtccctaaaaagctaaaattatgttgccaccaatctttttgattattagtggccattgaaacaagaatacctccgataaaggtagtaaaaagtagcaaaataagatttgataaagtgacagaaacagctgctgaaataagaaaataaaggactatcccgacaaatactaaaacaagcaatccagctgtgaaagggtcaaaagtcactccgctaaaagttttaccgataatataccagaaaataatctgaacggcaaatgcaatactggtgtaggctactgataatgttaagctttctctaaggattttaaatttagattttgataaatcacagcttttctttaagtaaatccataagaaaccaaaaaaacctaataatgtcgagaggattatacttaaacttgctactgacaggtgtcgacttccagtaaatgcaatttgaggatgtttagcaaataaaaaaataaccatggcaactatgccggataaaagactagggacgataaaataatgtaatgctagcgtctgtttattaggatgggaggcatctggattttctaataatatacgctgattttccaagcgtattgataattggtcattttgtgcataatcacttaatttattaaaaagttcatcgggaatttccaagtaatttttagtcatgatattcttcctagttttaatatagtgaataaattaaatttatacaatagatactttaatctatttactctgattatattttaccatttaagtccttcgactgtatactagaacgtaattcttagccataaagagtgggtaaaagaaattatttaagaatcaaaaaataataaaatagattgacttattgtgaaaatcatgttagaattaagttaataaaataaacgactaggttgggcgcaagcttcaagacattatctccaagggtgaggagattgttttgaagtttgcgtctttttttgtcgtttttaatagaaagggatgttatgaaattttatcagtaatccaaagaaaacatattgaataactataatgtcaagataagccaaggtttatcggaaactcaagttattgccaatcgtgaaagatatggtgaaaataaacttccagaagaaaaagaagatagctatctaaaagtctttttgaaaagttttaaggaaccaataattattgttttgatgggagcagtcgctttatcattttttagttcattttattcatttcaaatcgttggtgatagaaaacatggtttggaatcattatatgaagcaattgccattgcgattttgattattataaatgcatttttaggattttggcaggaaattagcgcccgtaaaaatttaaattcattaaaagaaatgaataatcgttttgtttctgtacttagaaatgggaacttagaaaaaatcgcctcaaatgagttagtagttggtgatatagtaaaagtaacagttggtgactttgtagaggcagatgtaagatggcttcaactcgatgaactccaattaattgaatcacatttgaccggggaagctgatgcagtaattaaaacatcagagataatttctgagaaagttgaaataggtgatcaaaggaatatgggcttttctggttcggttgtttcaagtggacaaggtactggaatcgttgttgcaacaggagaaaataccgagctagggaaaatctctcaactgatgaaagaagaaggcgtaagacagtctcctttacaaaaaacagttcaaaaattgactaaaacattgatgaaaatatcagcaggaattgtggtcctgacctttgtgtttggtctcataagttctggagagttttcaatcaattcgattacctcagttttctctacctctattgcattagcggtagcttctattccggatgcattgccagttgttttatctatcgttttaacaattggggcggttaaaatgtcaaaaaataaaggactgattaaaacgctaagtagtgtagaaaccttggggagtacttcttatatttgttcagataaaactggaacattgactcaaaatccttatagaaataataggtttttggaatagtccttaaaattcgattatttccggcattctatttttgaatactagcaattttttgctagtttttttattgacagaaatcaattttattcttttgtttttgaactatactgtaattataaaaataaaaggatactgtaaaatggcttttcaaaaatggttacaaaaaaatgcaaatcgcttgatgctggcatcagcgatattgattgggtttggtttcttggggaaatatgtttttgctaatgaattagcttggaatttaacaatgctcatcgcttcaattttgggtgggttaccgattggaatccacgcttatcaggctttaaaattcaaacaaatttcaattgacttgttggttacgattgcggtagtgggtgcgattttcattagagaatttgaagaatctgccattgtaactttcctatttactttcggaacttatctggaaaaaagaacgcttgaaaaaacgcggtcatcaattaaagaactgtcgcaaatggcgccgacaagagcgctttttgcggatggaagagagattgatattgacaaagtcaaagtaggcgatatgcttctgataaaaacaggaagtcaggtgcctgtagatggtcgagtttacggcggttctgcttttatcaatgaagccgccatcacaggagagtctcgagaaattgagaaaaacagtggcgagcaagtattttcagggagtattttagtaaatggaatcctctatgtgactgctgaaaaagtgggcgaagatacaacttttggaaaaatcatcgaattagttgaagaagcacaagatactaaatcacctgctgaaaaatttattgaccgttttgcaaaatattacacaccagtcgtgcttttgattgccattttaacttggctcgtgagtcaaaatttggagcttgccattacgattttggtattggggtgcccaggagccttagtgattggtgcgccggtatctaatgttgctgcgattggtaatggagcgaaaaacggtctattgattaaaggaggagaggtgatggacacttttagtcggatcgataccttactttttgataaaacaggaacactgacaaaaggtgaaacagaggttgtattagttaaagagtttggcgaaatttccgaaaatttactgacgaaaatatctacgattgaaagtcagtctaatcacccacttgcgactgcgattgtcaggtttattgggagtggtgctacaaagggaaaaattgaagagcttgatgtgattaaaggtcagggaattattgctgatgacctattgattggaaatgaaaaattactgacagcccataaaattttactgacagattctcaaaaacaaagtttgagagaagtagaagaaaaagggatgtcgatcgtgcttgttgcaaaagctggtcagctcaaattaatctacggaattgctgacgaaatccgtccagaagttaaaaaagcgctgacagccctaaggcgtaatggaatgaagaaaatggtgatgttgaccggcgataatgaagtgactgccagaaatgttgcaaaggaattgggaattgatgaagttcatgcgaatctgctgccagaagataaagcaagaattgtcagtgaatttaaatcgtcaggacataagcttgcttttattggtgatgggattaatgatagtccgtcgcttgcccttgccgatattgggattgccatgggttctggtacagatattgcgatcgaaacgtctgatgttgtattgatgaagtctagttttgctgagttagttcaggcttacggattggcaaacaatactgtgagaaatatgcgtcaaaatattgggcttgcaattgctgtcgtcatttttctacttgtcagcttgattttaggtgggacaggatttgttccaaattttgtcaatatgggtacgggaatgtttattcatgaagcgtcgattttgatggttattttaaatgggatgcgcttgatttcttataaaaataaaaagattaattgatacaaatcaattttttatgattagaatagcggtaaaataagagaaaagttaaagaaagaaggaaaaaagatgtctaaaataattatgaaacttgatgagctaagctgcccatcttgtcttgcaaaaatcgaagggtccatgactgggacaaagggagtgatttctgccaaagttttgtttaatgcctcaaaagtcaaagctgagtttgacgaaaatatcgtcaaatctgacgaattagtcactaaagttgaaaagctcggatatcccgtgcaaatctcaaaagttacgctagtttgagcaaggagggaaaaatgattgaagtaagtattgatgaaaaatatgaagcagaagtcaaaaaatctgagattgaccaccataaaccaactgctggtgcgatgttgagtcatgttttgtctaatattttttatgaaaaaataagtctgatgcaggcagggctttatgctaaaagtgcagattatcgcataaaatttcgtgaaattgccctaaaagaagacgaatggttttatcttatttctgagcagttacttgatgaaaatgaattggtcccaacgacgcttgacgaatttgtcagcaatcataaattcattgaaaatgaccccaaagccaagtattggacagatgaagcattgatagaaaactttatcaatgattttcagaaccaaaatttatttatcggacgagcgattaaactagcacaaaaggaagaaaaatttagcttagaacttgcaattcgcaagatttacggctataatttgtctattattcgctattttgcaggagaacttggaaaaacgataggcgaatttattgaggaggaagatgacgattaaagattttgatgagcatttaagtgaccaccattgtatccagctagtcccgcttttttttgacttgagtccagatgagcttgctcaagttgaagaaattgttcaacacaaaaaagtcaaaaaaggtgaaacggttatccaaccatcggcagagccacttttgacaatagttgccaaaggaagtttaaaaatatatcaaatctcatccactggaaaagaacagctattaagagtgattgaacctggtggatatgaaggagaaaaatccattttcggccttgtcaataaaaacttatttggcgaagctctatcggatagtacgatttgttttgtcagaaaatccgattttacggaactcttactcgctaaacctcaactttccctccgtcttcttgaaatgaacgctgtgaaacaaaatgaaacggagcaacaagccaagtttttgatgatggaatctgtagaaatgcgtcttgctaactatttattggatttggctaaaattactgacggatcttatgtacaaattccaatgactttgaaggatttgtcagcatttattggcacgactcctgaaacaatcagccggaaacttcgtctcttagaagagaagggattggtcgagcattacggaaaatctttcaaaattttagattatgaaagacttgaagatgaatatgcttagacaaatttctgtcagtaaatttatttactgacggaaaaaatataatcaaaaaaatactgacgaattgattctgtcagtattttatttttaatgaaaaaatgaaacctaagtaaacaatgaggattatcaacaaaagggcttgttttttgatataatggaaggagtaaactgggggattgggagaaattattatgagttttattgcactttttgagctggcacttttttttcttaatgttattttatcctttgtcattatttttagggaaagaaaatcaacagcagcaacttggtcatggctctttgtagttaatttattgccgattataggctttattttatatttactcattggtcgtggaatttcacattatcgtatttttaaagaccgtaaaaggtttcaacttggctttgaaaaacaacttgaacatgcggagaaatcatatacagatagattgtttattaaaaaaatgagaaaaaatcatgtgattggtcaactaattcacatgctttatgttgaagaaaaatcgattatttcaacaaatactggtgtcaaaatttttaatgatggacgccagaaatttaacgctttgatagaagatataaatcaagccaagcatcatgtccatatggaatattatatttttagaatggatcgaacgggtcatgaaatctacgatgccttactggcagccgcaaaacgtggagtagaggtgaaacttttaattgacgcttggggttcaaataagactaaaatgtccagctttaaagagcttcaagaagctggtggacatgtggctcaatttttccccttgattatgcccttagttaatccccgaacaaattaccgtttgcaccgtaaaatcgttgtgattgatggtgtagttggctatacaggtggattcaatgtcggtgatgaatatgtttcaattacgaaaaaatttggatattggcgtgacaatcatttgagattgactggtgatattgtttatagcttacagcatcgttttatcttagactggaattcacaacatcattttgaagtgactgagggagaaccttattttccagattctattgttgaaggacatgtagcgactcaacttgtgacttctggtccagatgaggataaagagcaaatcaaattgacttacatgaagatgatttctggtgctgaacgagaaattatcattcaaacgccctattatattccttctgatgccttgcatgagtcaataaaattggcccttttatcaggtgtacaagttaaaatgttaattcctaacaagccagaccatccgctggtttactgggcgacatatttccatgccgctgatttagttaaatatggtgccaaggtttatacttatgaaaatggatttgttcattctaaaacgttaattattgatggagagtatgcctcagttggttcggcaaatttggattatcgaagcttacaattatgttttgaagcaaatgttgttatttatgattatgatatttcacaaaaattgcgaaatgattttatgaaagacttgaagttaagccgtccattgactttagagcgttatgaagaaagatcaaagatgattcgttttaaagaaggactggctcgcttaattgcaccaatgctttgatttagaaactaagatagagcaaaaattatcatttggaatgataagatgaaaatggaggaaagagatggacaataaactcaatattgtaatcattacaggaatgtctggcgcaggcaaaacagttgcgattcaatcctttgaagatatgggttattttacagtggacaatatgccaccaaatttaattgaaaaatttgttgggctattgaatacacctgataataaaattgataaagtggccttagtcgttgatatgcgttcgcgtgctttctttgaagatattcaaagtattgtgaccgaattgacagataacacgagtgtgaactttaaattgttgtttttagatgccaacgatactgaattggtttcacgttataaagagactagacgaagccacccactggcaattgatggtcgaacactggatggaattactaaagagcgtgagattttagctgatttaaaaaatttatcagaagtagtgattgataccagtgaattaacaccaagaaatcttcgagcaagaattttgcaaaaatttgcgacaagtacagaatcaactttccgaattgaagtgatgtcttttggttttaagtacggtttgccattggatgctgatttggtttttgatgtccgttttttaccgaatccacattatatttctgaattacgtgataaaaatggaacagatcaagaagtttatgattatgtgatggaacatccgcaatctgaagaattctatcaaaatttgatgaagatgttggttccgattctccctgcttataaaaaagaagggaaatcagttttgacaattgcttttggctgtaccggaggtcaacaccgctcagtggcctttgctgaacgagtttctgctgctttaagagaaaagtggcatctaaatgttagtcatagagacaaagaccgtagaaaggaaacggtaaatcgttcatgagcaatcctaaagttgtcgttatcggtggtgggaccggaattcctgtcgttctaaaagcattacgtaaagaaaaagttgatttaacagcgattgtaaccgttgcggatgatggaggttcttctggacggattcgttcagcagtcagtatcgctcctcctggtgatttgcgaaatgtattgattgcaatgtcagacatgcctaaattttatgccgatattttacagtatcgatttgataaatctgatggagaattggcaggacaccctcttgggaatttaattattgccgcaatttctgaaatgcaaggatcaacttatcgtgcgattcaaaccttggctcaattctttcatgttgaagggaaaatttacccttcatctgatgcagcattgacattacatgccgtttttaaagatagtcatgaggtaagcggtgagagccaaattgcaggctataaaggcttgattgaccatgtttacctgactcaaactgtcaatggcgaaagcccaattgcttcacgaaatgttgttaaatcaattatggaagcagatacgattgttttgggaccgggttcacttttcacttcaattttacctaatattgttattcccgaaatctgtgaggctttatggaaaacatcggctaaaattatctatgtttgtaatattatgactcaacgtggtgaaacagagcatttcacggatgctgaccacgttcgtgttttgaatgaacatattggaacaaaagtgattgatacagttcttgtgaatattcaagaagtgccagaagaatatatgaatacaaataaatttgatgagtatttggtccaagttgatcatgattttgcatcattgaaggctgaagaagtcaatgtaatttctaataattttctggaactgcgtgatggtggtgccttccataatggagaagctgttgccaaagaaattgttgccatttctcaacgtcaagaatttagacattaaaaaattactgacaggatttgtcagtaattttaaacggataaagagtttaagaggaaggaacaagacagggttttttaacctgaatagaaaaaattatgagtttcacaagtgatgtaaaaaaagaattaacccgtaatttagccacaactggtgcccttcttgcccttgtaagaatgaatggctctgttggaatttttaatggtttaactttatcgattacgacagaaaatgctggtacggctaaatacatttatcaaatgcttcaagaactctatgaaattcatgcagagattcgtgttcatcaaaagacaacactttctaaaaatcgggtttatactgtttttatcacagagggtgctggcgaattattagatgaattgagtttggctgattcactgatgctggataatggtgtccctgaatttgttaaaaatgatgaattcattaaaaaagactatttgcgtggcgcatttttgtcggccggagctctgcataatcctgaaaaaggggagtatcaattatccatcgccaatgtttatcaggaacatgctgaggatttacaagaaatatttcgagattttggcttaaatgctcgagtgattgaacgaaaaaatcggtggattctttatttatcaaaagcagaagaaataatggattttttgactttgattggcgcaatgaaggcgagattgaaatttgaagaagctaaaattatgcgtgaaatgcggggattagctaatcgtcagtccaattttgaaaatgctaatattgctaaatccgtaatggctgctcaagaagcaattgatgctattcaatttcttaatgaaaaaaaagaattagaacaacttccaccctctttaaaagaaatcgctcgtttacgtttagaaaatccagaagcaacgattaaagaattgggcgaattactggacccaccattgggaaaatctggagtcaaccatcgattgagaaaactggttgaacgctcgaatgatttaaaaaaagttgaaagttaataaaaactggcttgataatgagccagtttttattatttccaaccattaagaaagaagcgagaaagaagttcggttttttctaaaagtctttctattgacaagcccttcattccagaattaaaaatatttatgatgaaaagaaagtcttctttagtgtattctttagaaattttttcttctttttgtcctttttcaaaaagattttcgtaaatttttgcttggggtaaaagagcatcagtatcaaaaaaatcaggactttcggagtattgagtcattagattttctgaaaaaacaggactgaacactttaagttgtttcaattcaagatcaatgatagcctgaaaagtatctgtaaaatcaaggtcaccattaatgatttcctcgatttcatcgaccatgtgctcaaaagattttagaagaacatagttcatcaaatgacttttattttgatagtatttgaaaagagttaccttagaaacaaccgcttttttagcaatttcttcgatttttatatcttttattcttttttcgtttagtaattgaaaagtgatttctaaaattgcttttttcttttgttcagtttggttcactacaaacacactttctagctgacagagtaatctgtcagtaaattttttatagaaattacatataacaaaattataactttattgttgaactatttcaaataaaagagtacaatatgaactataaaaataaaatagtttatattttgaaaagagggttgttaaaaggttattggttgtatttttagataacttttcttgaactctataaaagttaagggtaaaatatgaacaataagtataagaatagttcagagtacaaatttatcaagctaatcaaggaggaacaaaatggcgaaaattgtcgaagtcagtggacttcaaaagaatttcggaaagtttcaggccttaaaaaatgtatcttttgaggttaattctggtgaagttttgggttatattggaccaaatggtgcaggtaaatcaacaaatattcggattttacttggaattattaaagcaacaaaagggaaggctcaaatttttggtaaagaagtctggcaagattcaattgaaatccataaaaaaattgcttatgtgccaggagatgtttatctttggcccaatttatcgggtggagagacaattgatttgtttttgaaacttcatggacaaattaacaaagagaagcgggatgaactgataaaaaaatttgatttgaatccaaagaaaaaagttcgctcttattccaaaggaaatcgccaaaagattgcgcttattgcagctttagcaacggaggctgaactttatatttttgatgagccaaccagtgggttagacccattgatggaggccatttttcaaaaagaagtggaaaaattaaaaacagcgggaaaagcaatcattttgtccagtcacatcttatcagaggttgaaaagttagctgatagagttgcggttattcgaaagggtgaaatcgttgagacgggttctcttgaagatttacgacatttgacaaggtatcagtataaggttataacggaagaagttcctcatgatttagaaaaattagcttctgttcatgatttgcagattattgacagagaagcaagttttcaggctgattcagattcaattgatgaaatcttaaaaacacttttacaatatgagtacataaacttgaatcaactcctccaacgcttgaagacctctttatgcgtcattaccagtaagggggaagcttataaaacaggtgttttgtttagggccttactcaaaagagattggctaaaattacttttttggattttgggaatgcttgcatttgcagcttcaggggctggaaaatggaagtcacctcaaatccagctacggcaaatagtctttatacaatgtttgtcaaaaatccagcaatgattggcttatttggccccacacctgtaaatagtccagcaaattatagtttaggtcctatttttggtcaaacgatgactttgattacaggtatcacctttgctattatttcgattatttatgttgtcaatcgaagtagaaaagaagaagatgatggaattactgagctttttcgttcttattctatcggaaaattagcaaacacgacggccctagtaattgaacttattttcttacatctactaatggctattctactcgccttttccattcaagcgcaaaatgtaacaggcttaaatgatttgggaagtaatttactctttgctttcaccacaagcgcccaaggactactttggggaatgtttgccttacttttagggcaagttttctctgatgcgagtacaactaaaggggtgacctttggtttgtttggattgctttatatcattcgaatggggacagatgcaaccaatctttctttgggatggtttaatccactatcatgggtttatctggcctttccgtatgtcaaaggacatgaaaattggaccagtatcattttgacatttagtttatccttgattttattggtcatttcttactttttagagcttaaaagggatgtgggagctggttatttgcctgagggacaaggaagagcgcaaggtaaaaaagctttatttggttttcctggtcttattttaagtcttgaaaaaaagatgattcttggctggcttattggaagttttgtgctaggtctggtttatggttcgatgtttggtcaaatggaccaatttatttctaataataaaacagttaaagaaatttttgtgggaaatgaaaccgcggcctcggcgattagaggaaacttcatggttactttattctctattttatcgatattagttgcggcctttggagtggtattactgataaaaatggtgggtgaggaaagaagaaatcgcttagaggcactctatgctttgccactttcaagagcaaaggtctatttcacatatgtgctgacagctattttttcagttatagttgcacaatttttggctctttgagggatatttattgaacaattgggaaatgagaatgttctttcttttacagaaattatgaaatctgggatgatttggcttgttgcagtcatctttgtccttgctatccttagcttgctaatgggtcttgttcctcggttcgctgatgtgatttgggtttatctaggcttcttactctttatgacttatcttggaaaattattgaatctgccaaaatggttggagaatttgagcatttacagtcagattcccaaattaccagtggagaaaatgaatcttccaacagtcagcttgatattaatattagctcttgtattaattctgattggctataaagcttatgaaagacgtgacttaattacaggataaatttaaaagctatctaagcaagatagctttttttgtaaaatgagcaacaaaatgttgtctaaacccagaaatacagtattttttagcattctaatataatttatgatagaatgaatgagttattttataaatacgctttcaggagaaaaattacatgatgaatccggcagaaattttaactgcgaccattcaccacggtcaggaaaaaataaaacgtccttttttagaaaaagccgttcttggttttattggtggggcaatgatttcttttggctacttgctttatattcgggcgatagcttcgttagctgacgaactaggaagtcttgcaagtttgattggagcgagtgtttttccaattgggctaatcgttatcttattgggtggtggcgagctgattacttcaaacatgaccgctgtttcgacttcattttttgctaaaaaagtgactttgagtgaattactaaaaaattggttaatcattactgtatttaatgtccttggtgctatttttgtcgcttttgtttttggacatcttgtcggattgacaggtattggagcttacaaaacggagcttcttagtttagcacaatcgaaaataaatgctagttggtcccaagaatttctctcaggaatcggatgtaattggtttgttggtctggcaatgtggatgtgttatggggctaaaaatgctgctggaaaagtattagcagtttggtttccggttatggctttcgttgcgattggttttcagcatagtatagctaatgcctttgtcattccagcggcaatttttgaaaatggagcaagctggctcgattttgctcataattttctatttgtttatcttggtaatctctttggagggtcaatatttgttgctggattttatagtttaggctatcgaagacaagcaagggaacaagaagaactaaaaaataaagaaaaaagttactgacaaaaagtcagtaactatttttttaactgatgataacgattgtaccaaatttcaacgtattctttagaaaaaggccctttttcattgttaatccagtcaacaagaattttgacattttcttttagaatatgatcaatttcttttggatagtgcattttgcgtcggtggcgctcatattcttcaacatcgagtaatttcttttctccatctttgaagactttcacgtcaaggtcgtaatcaatatatttcagcgcttcgttatcgaggacgaaggggctcgctagattgcagtagtagctaacgccttcctcacgaatcatagcaatgatgttaaaccaaaactttttgtggaagtaaacaatagcaggttcgcgcgtgacccaacggcgatcgtcagattccgtcactaaagtgtgatcatttactccaataattgaattttcatttgtttttagaaccatggtatcgcgccaagtgcgatgtagattcccatcatgtttatagctttgaatcgtgatgaagtcgccttctttcggaattttcaaggctattctctctttctcaattcaaagttatcatctattaatataccattttttaaatgaaatttacagtaaaaatgtttagtttagacaataaattgctaataaatgttcggatttttaatttttatgtagtaaaagtgagtttttatactgatggctaatattagtcgtctaagtcaaaaattgtcaaagacgattgaaattccttcatcaagttttctcttcgaaatgcttgccaatcggaacttttacgaagcgcattataacgttttctcaaatgccaattttcagcaatctgatattgtggatatttggctaaaaattcattgaccatttgccattcgtaaggatatccaagaggtctcgcatggtaaagaatgttatcaatcttaaggggagttcgtctttgatgaagatgtccaaaaatgacgtccgtaacttttggaaagtggcaaaaaagttcatggaaatgctgagagcccaaataagcattaaagcgagcaaatttttcatagcgggtattaatgataaattgctgatgagggacaaaatgtgtgctgacaataattctctcaatctctggctttgctgacaattctgtcagtaaagtttctagtttctctaattcgatagctgtcgtcttgatatcatcaaattggcgatggatttttcggtcaaaataaaaggaatttttaaaagcgataattttttgaaaatcggctttttctttcataaaggaatagtcgtaccaaccatgaaaactgacaaaggcggtcgatgcaaaagttttcactttaaaattactgacagagatttcttcctcagaaagttcaaccatatcatgatttccaaggctaaaagtgactgataaatctgtcagtgattctaattgatgaaaaaaaggttcagagatattatgtaaatcattagaaatatctccagcaaaatgtaaatctgtaatttgtaaatcatttagaagggatataaaaagttcaatttcctctatagaaaagtgattactgtccaaatgaaaatctgaaattatagccaatcgtctttttttagtcatagtcaaattatagcatgtgtcagtaattctatctaatatataatttttgagattcctattataaaaaagtttaagtccattttctattgaatagcttaggttaggcttataggcggtgaatatggtataatgcaactatggaattatcagaaattagaaatttacttgaagggtatagcgagaagattaatggctttcgtgactccttagatcttaaccgtttggaagaagaaattgctttattagaaaatgatatggcgcagcctgaattttggaatgatcaagcagcggctcaaaaagtaattgacgaatcaaatgctttaaaagcaaaatacgacaattatcaagccatgaataacatgcttgaagaagctcaaaccatgcttgaaatgcttcaggaagaagctgatgaagacatgcaagtcgaattagaagagatgaccacagctcttggtcaaaaaattgaatcttacgaactcgaaatcatgcttaatcaaccctatgaccacatgaatgcggtacttgaaatccatccaggttctggtggaacagagtcgcaggactggggctcaatgctcatgcggatgtatacccgctggggtgaagcgcatggctttaaagtagaaattttggactatcaagatggagatgttgctggacttaaatcagtagccattcgttttgttgggcgaaatgcttatggttttttgcgcggcgaaaaaggagttcatcgtttagttcgcatatcgccatttgattctgctaatcgtcgtcatacttcatttacttcagtagacgtgatgccagaactggatgattcaattgaagttgaagttcgtgatgctgatgtgaaaatggataccttccgttctggaggagcaggtggacaaaatgtcaataaagtatccacaggggttcgcttgactcacgttccaacagggattgttgtccaatcaacaatggatagaacacaatatggtaaccgtgacaaggccatggctatgttgaagtcaaaactctatcaattagaaatggataaaaagcaagcagaagttgatgaacttcgaggagaccaatcagaaatctcttggggaagtcaaattcgttcttatgttttcatgccatatcagttagtcaaagacacacggactggttatgaaacaggacaaatttcaaacgttatggacggtgaaatagacggatttatcaatgcttaccttcgttggaacctctaaaattaagctggttcttggagttgttgaaataattacgaaacattaaagttattaatgaaaagattataaaataaaagtgctacctaaagcacttttattttgatataattattagtagttctgctgagggaaatttatttattactgtcagtagaatggaagagaagtcttatcgagaaataaaaaaggtacagtgctgtgcccgttttcttgttttttgataaaatcctcttaaaagcatccatagtgattaaaatatggattttactaataagttgctgactcattcgttagtaattgtcagtcaaatctaacacaggaaaggtactatgagtattataaaactaagcaacgtttccaagaaatattctaatggaacaacggctttgcgtaatatctcgctcgaaattgaagcgggagaatttacctatatcgttggaccatcaggagctgggaaatcgacctttatcaaactactttatcgtgaattaaagattgaccgtggttctggaacagttgcgcaatatgatttatctaaattaagacgtcgagacgttccgttgttacgtcgttctgtaggtgtggttttccaagactataaactcttatcaaagaaaacagtttatgaaaacattgcctatgccatggaagttattggtaaaagtccgcgcgaaatcaaaaaacgggtcaatgaagtgcttgacctcgttggattgaaacacaagattcgttcatttccaaatgaactttcaggtggggaacagcaacgtgtggcaatcgcccgctcgattgctaatgcaccaaaagtattgattgccgatgaaccgacagggaacttagaccctgaaaattcttgggaaatcatgaatttgcttgaaaaaattaatcttcaagggacgactattttgatggcgacccataatagccaaattgttaacaccttaaaacatcgtgttatcgctattgaaaacggacgaattgtccgcgaccaagaggaaggagtttacggctacgatgattagaaatttcttcaaacatattttggaatcgctcaaaaacttaaaacgtaatggttggatgacagttgctgctgtttcatcagtaacaattaccttggttttagttggacttttcctttcaattatcctgaacactcaaagattgactaagggaattgaaaacaatgtccggattgttgcctatatgaaattagacgtccatgaccaggaagtgaagattcaagatccaaaaaacaataaaaaaataattaataatcctgaccatcttaagatttatgattcaatcaaagaaattcctaatgtaaaaacagtaactttttcaagtaaagaagctcaattacaagaattgactaaggccttaggaaataactggaacctttttaaaggggatgcaaatccactttacgatgcttatatcgttgaagctgacaagccaattaatgtaaaagcagttacttctaaaatttccaaactttcaggaattgaaaaagcaacttatggtggtgccaataccgcaaaacttttccaaattgcacgaggagttcaaacttggggaactgcagcagcgattttattaatctttgtcgcggtcttcttgatctctaacaccattcgaatcactatcctatcaagacaacgtgagattcaaatcatgcgtctggttggggctaaaaatggttatattcgttggccattcttcttagagggagcttgggttggacttttaggttcaattattccaagtcttatcgttgcttgggcttatcgtcttgcttttgttagtctgacaccaagtcttcaatcacaaaaactttcgatgtatgagactagcgagttcattccagccattgttggattgatggctataattggtattttgattggttcattcggggccctcttatcaatgcgtcgtttccttaaaatttaataataacaatgaaagagaagataaatcttctctttttttgttcaaataaaaagtctgtcagtaattaagttataaacttaattactgacagactttaaaatttatttaattaaatgtcataatcttcgtcagacattgcttccacttcaccaaggaggtaagaattaccaacttgtgagaagaagtcatggtttgatgaagaagttgaaattccgttcatgacaacaggattgacatcggctgcagtatcagggaaaagtgggtcttgtccgagattcattaaggccttattagcattatagcgtaagaaagttaagacttcatcagtccaacccactttatcataaagtaaatgagagtagttttcttcattttcgtagagtttgtagaggagctcatacatccaatcacggaattcactttgctcatcttcagataattcattaaaaccaagctggaatttataaccaatataagtaccgtgtacagattcatcacgaataatcaacttgataatttctgctgagttaatcatcttattatttccaagataaagtaaaggtgtatagaatcctgaatagaagaggcaagtttcaagaaatacagaagccactttcttttgaagagcggtgccagattcataaatcttattgatgatttcagcctttgtctgcatatagacattggtatccacccagttaaagagttcttcaatttcctttttagtatttaaagttgagaaaattgtagaataagatttagcatggactgactccataaattggatattattgaaacaagcaatttcttgaggagttctcgcatcatgtttgaggacttcagctccatctactgattgtaaagtatcaaggagagtcaatccagcgaaggctttagcaaaagtatcacgctcaagctgtggcaatttacgccaatcgtccaagtcattagagacaggaacacgtgtatccaaccagaattggctagttaatttctcccaagtgtatttatcgattgaatcttcaatagaattccagtcaatcgcactataataagtggggacagtaagattttcagtttcagacatattatttctctctttttagctaccgacaattactgtcagtaaattttttatcactgacaatgtcgtcagtaaaaatagctagctcatgacaccaaaaactttcgataatttatcaaaagtttggcgtcagtaaattattttagaccctaggtcatgttgatagttatacgtcgcactttgaccgacgatttttcggaaaaatgaaacaagtaagaaagtagaaagtccgctctagcggccttcgtataaacactagattctttagcattattgtttatcttgtttacgtcgtttccattcattgacgatacttcaatgaatgaaaacaagtaagaaaatagaaagttcgctctagcggctttcgcataaacaataggtgctttagcatcattgtttatgttttattaaatgacacaactttcacattggttagcaccgacttcctcttggtcatcagtaaatgtacgaatgtaataaattgttttaattccttttttgtaagcatagttacgcaaaatagacaaatcacgtgtggtcattttattatttgcaactttccattcatacaaaccttctggtaaagttgaacgcataaataatgtgagtgacaatccttggtcaacgtgttctgtagcagccgcataaacatcaatgaccgagcgcatatcagtatcataagctgatttgtagtaaggaattgtttcagtggcaagtccagcagctggataataaattttcccaactttcttttcttggcgttcttcaatccgattgacgattgggtggatagaagaagagcagtcattgatataagaaatagaaccatttggagctacagccatacgataagaattataaagaccagaagtttttacagtatcgcgtaattcagtccaatcagcgattgttggaacggcaattcctttgaaaagttcttgaactttaggagaaacagctgcaaaataatcatgagtcaagtatttatcaaaataagaaccatcatcataggccgatttttcaaaattcttgaagctagcccctttttcaacagccaatttatttgaagccaccaaagtgtagtaattcaacaacatgaaatagacacttgtgaattcaacggcttctttactatcataatgaatttgattttgagctaagaaagaatgcaagcccattgctccaagcccaatggcatgcatttcatcgtttcctttacgaacagttggaacagtatccaagtttgaagtttcagaaatgaaagttaaagcacgaaccattgattcaacagaagttccaaattcatcactagaagtcatcatatttaagacattagttgaacctaagttacaagcaacgtcagttccaacgactttataagtttggtcatcattcaaaacagaaggtgtttgaacttgaaggatttcagaacaaaggtttgacattgaaatcaccccatcaacaggattagcttgattgaccgtatcgacattcacgatataaggataaccagattcttgttgaagttttgaaagttcttgttcaagctcacgggcattaattggtgttttacgaatttctgggttagccaccatcttgtcgtattcagctgtaatatcgacttcggcaaaaggtttaccataatatttttcaacgaagtaaggttcaaaaagatacattgtttcgccttttttaaccaattcgtagaatttatcaggaacagtaacaccaagtgagagtgttttaacacggattttttcgtccgcattttcttttttagttgataaaaattccatgatatctggatggaaaagtgataaataaactacaccagcaccttgtcgttgccccaattgattggcataagaaaaagcatcttcaaaaagtttcatgacaggcacaacaccagcggcaactccatcatatcctttgattggtgcaccagcagcacgcagattagttaaattaagaccaacaccaccaccatttttagaaagttgtaaggcagaattaatcgtccgtccaattgaattcatatcatcagtcaattgtaaaagaaaacaagaaacgaattcaccacgacgtttacgtccagcatttaagaaagttggagtagccggttgataacgacgattaatcattgcaaaagcaagattattagctaatttttcatcaccgtcagccatgtataaagcattcattaacacacggtcttcaaaatcttcaagatagagtgaaccgtcattgtttttcatggcatattgattataaaatttataagcagccataaatgaatcaaaatgaaattcaaatttactcaattctttacgaagatttgtgataaattctggcttatatttttctagaaattcagcttctaggtattcttctttaactaaccaattaagtttatcgatataagtgtcagcttcataacgattaggttcaacattctctttgaaaaaagcggtaattgcttctttatctttggcaagaggaatgctaccattcacggggatgttaatctcgttattgagcttgaaataagttacatctttaagttgttttagagacataatactccttttataaagtattcacttacttttaaaaataagtgaatctgaaatgtatgataagttcaaacttgttattataaaataaaagttaaaataaagaagcttcactcaagtagggtgaagccataaaaaatcacagcggatttttaaaggtgactttcgctccttgatcaagctgtgcagcgagtttttcaacggcagcaacatcagctggcgtaccattaaactcaaaatcatataaaagtggaatttgatattttgctgaaacttctttagcggtaaaaatatagatgccagcaaaattacgatttccagtgccgataattccacgacaatgtttataattatcattataagccataaagtcaaaaaccgggtccataacgtctattgatttagaaacggttggtgattcttcagcataagagggagttatcaaaaggaaaggctcgtccatctctaaatcatcgtcaggtgtaatttcgacattcggcaagtctgttttagaaacaaaacgacgcgtttgtccagtcacactgaaataagcaagtttcatattaagccaactttgctaattcagaaggacggaaaccagaaaaggcgaaatcatcttttgtgattacaggagcagctcgaaaacccatttcaattactttttcgacaaattcaggctgttcatcaatattgatttcgttaaatgcaatttcgtgttcagaaagccattttttgaccattttgcattgcatacaattgtttttagaataaactgtaaccattttaaatctccttttggggccaatatatttttagacgggagtaaaaagtccttgactttttctcgagtttttatagtcttattttagcgtaaaaaaaatatctagtcaaattaaagatactagatatagtgttaaattatgtaaaaaaaagaaaaaaacacaatatattgtgctatttttctttttgtcccgataagtttaaaccaaaggggacaagggattcacaatgatttttgattcttttgaggtttgttttatgtcgaaaaatgataataattgccaaagcaaaaataataatcgagaataaaagatcataggaagtgagaataaatccaaagctagggaaaataagaattccaagcagagcaaaaattgcggcgacaacacttgagaggctaatcatactaaagagccagagaacaagaatgaaaataacgagaagataaagaagaaagaatggactaaatccaaggacgacaccagcagaagtagccacagctttcccacctttaaaatggtcgaaaatagataaggtatgaccaatgacagccaacaatccaaaaattaaaggagagactccattaatatggaagataagtggaagaagagttgctaaagttcctttaagcaagtcaaaaataaagaccgcaatcccagcctttacaccaagaatacgaaaagtattggtcgttccagtatttcctgaaccataatcatgaagattttttttgaaaaaaatcttgccaatccatagtccaaaaggaattgcccctaaaagatagctggcaatgagaagaagaataataataagcataagttctccgaagtttatttcgtttaaaatcgataatctcttttaactgtacaattataccatatttttattaaagattactgacaatattgaaacttattggcttaattgaagcaaatatcttacgattagcttttgaaattctcagcagtcctttgacaaagcgttctgaacaaggtacaataatcaagatgaatattttttgtcagtaaattgcgaacaaagcgagtgatgatcttgctgataaaagatatgggctttcgatgagaggaaaatagatggtaatagatattaataattacgatgacagtgcaattcaggtccttgaaggtttggacgcggtcagaaagcgcccagggatgtatatcggatcaactgatggaacaggtttgcaccatttggtttgggaaattgtagataatgcagtcgatgaggccttatctggttttgggaataaaattacagtgaccattaatgctgatggttctttatctgtagaagatgaagggcgcggaatgcctgtcggaaaacacgcgatgggaattccaactgttgaggttattttcactattcttcatgctggtggtaaatttggtcaagggggatataaaacttctggtggattgcatggtgtaggatcttcggtggtaaatgctctttctacttggttagaagttgaaatcactcgtgatgggactgtttatcgccaacgttttgaaaatggaggacatccagcaactactttggaaaaaatagggaaagctccgaaatcaaaaacggggacaaaagtgactttcatgcccgattctactattttttcaacaactgaatttaaatataacatcatctctgagcgtttaaatgaatcggcctttcttttgaaagaagtaacgattagtcttgaagataaacgtacggatgaaaaagaagaatttcattatgaaaatggagttcaggattttgtagcctacctgaatgaagataaagatagcttaactccagttctttattttgaaggaaagcaagatggttttgaagttgaagttgccctccagtataatgatggctattcagaaaatattctttcgtttgttaataatgttcggactaaagatggcggaacgcacgaagcaggtttaaaaacagctatcactaaggcaatgaacgaatatgctcgtaaagtcaatttgcttaaagataaagataaaaatctggaagggtctgattatcgtgaaggtttaacggcagttttatctgtattaattccagaggaacatctccaatttgaaggacaaaccaaagataaattgggttcacctttggctcgtccagtggtggacagcctcgtttctgaaaaattaagtttttatttgatggaaaatggtgaattggctcaaaacctgattcgtaaagcaatcaaagcgcgtgaagcacgtgaagcagctcgtaaagcacgcgaagattctcgaaatggtaaaaaatctaaaaaagataagggtcttttgtcagggaaattaacacctgcccaaacaaaaaatccaaataaaaatgaactttatttggtcgaaggggattcagcgggtggctctgccaaacaaggacgagaccgaaaatttcaagctattttgcctttacgtgggaaagtaattaataccgaaaaagcaaaaatgcaagatattctcaaaaatgaggaaatcaataccatgatttacactattggtgctggtgttggtgcagattttactttggctgaccgtaattatgataaagtgattatcatgaccgatgcggatactgatggggcacacattcaaacacttttattgactttcttctatcgctatatgaaacctcttgtagaagctggacatgtttatattgcgcttcctccactttataaaatgagtgaaggaaaaggaaaaaaagagaagatagggtacgcttggacagatggcgagctagcagaacttcgtaagcagtttggtaaaaatgcaaatcttcaacgttataaaggactgggggaaatgaacgctgaccaactttgggaaacaacgatggacccagaaactcggacactgattcaagtaacaattgatgatgcagcgcaagcagaaaagcgtgtttccgtgctgatgggtgataaagttgaaccacgtcgtaaatggattgaaaataatgtgaaatttacgatggaagaagatacagctttctaaacaattttattcaaataattacctcgatttttcgaggttttttgctttaatttgtgataaaatgaaagaaaatctaaaagactttcttataacgaaaagataagcaatgcaaaattcagcattaattattattgatttacaagcattcattaagaaattagcaaaaaaagctgaaccttatggttgggataaaatcattgagaacaatcgagcgctgattgccgcttttgaccaagcaaatcagccggtttatttagtgacagttgagccaaaaatactttggaaatccgctaaagaagctttttctcgcatgattctacaagatgaattagataataattcaagactgcataagttggtaaaatttggcccatcagcatttaaacaatcagactatggcttagctgatgagctaaaaaaactttctgtcagtaaaatctatgttactggggtttcgttgagtaatggtgtcgtcaaaacagccaaggatggagctgaatctgcttttgagtctttcattatcgaagatgcttgcgctgacagaaagttaaaaaacttccagaaaacgctgacagaaattcctaaatttgggaaagtaattaaaacaaaagaaattattgaggaactaaataaaaatgtctgagaaatatgtcgtatttgactttgaaaccacaggattttctgcacaaaaaaatgaaattattcaaattggtgcggtaaaatatgatgaaaataatcaagaacttgccagattcaatcaattagtaaaaaaccaacgttcttatgtttcgacagaaattacccaattgactgggataaaaccagcggatttgttaaatcaaccaacgattgaagaaatcttacccgattttttagattttatcaaaggtcatttattagtggcacataacgcaccttttgatatttcattcctctatcaagcgattattgattgcgccatcaccgatgttgaagcttttcgtgtctatgatactttagcagaaagtaaaaaacttctgaccatgtcctcttatgctttggaaaatttcaaagatttactggaaatgaatgatttacgttcgcatgatgcccttaatgactgtctaattacagctaaactctatcaatatttacaaaaaattgaagaagttgagcgatcagtagaatcagaagttgctgacgaacttggtcagttagatttatttggtgacagttctgatgaaattactgacagcattcgtcgaaagttaaacttacccattaccaaggctttggtctactatcagcaaaatttggaacgaaaatgggaacggtttgaagtcctaggaatttcggttgaacgagaatattctacaggttcaagtctaaaaattcgtttacataattcagaaaaagtgaaaattcattctgattttctaaaagaaatgcaaaaagccaatttcgtcacgattatggaggaagagaaatgacagcaatttggaaattaaaaaactttaatcaattaacaacagatgagatgtatcaacttttgagtttgcgtacggctgtctttgttgtggagcaaaattgtccttaccaagaacttgacggtaaagaccaagtggcgcaacatctttggttagaaaatgacaaaggagagttgatggccctttgtcgtcttcttccacaagggatttcatttaatgaggcttcgattggtcgtgtccttgttaatcctgaatttcgtggacaaaatcttggacgtggtcttattgataaggctttggaagttctcaaagaaaatggggaagcagcagtgactatcgaggcccaatattatttacgagatttttatgcttcatttggctttgttgaaaattcagaacccttttatgaagatgatattaaacatgtaaatatgatattgaacttctaagatgaaaaaatttactgacagctttgtcagtaattttttcacttcaaattaagctgtcagtagtttttcaagagataaacaatcttatcgattttgcccaataaataatgtgtcagtttttttcgttttaattttgtggtagaataggaaaagtgattttatattctagtctgatagactagaagaactgtcagtaaaaatcattcttattataagttaataaaagaattagtataaaaattaaagaaattttctaaaaagaaagttgaaatatgtcaaacattcaaaccttaccattagaagatataatgggcgaccgatttggtcgatattcaaaatatatcattcaggagcgggcgctacccgacatccgtgatggtttaaaacccgtacagcgtcgaattctttattcgatgaacaaagacggaaatacctttgataagtcctaccgtaagtcagccaaatcggtcgggaacgtcatgggtaattttcacccacacggtgatagctcaatttatgaagcgatgattcggatgagtcaagactggaaaatgggcgaacctttaattgaaatgcacgggaataacggttcgatggatggtgatccacctgccgcaatgcgttataccgaagctcgtctttcagaaatttctggatacctgttatcagatattgagaaagataccgtaagtcaggcttggaactttgatgatacagagaaagaaccaaccgttttaccagctgcttttccaaatcttttagtcaatggttcaaccgggatatcagccggttatgccacagatattccaccccataatcttggcgaagtcattgatgcaaccattcatatgattgaccaccctaaagctgatgtagaaaaaatcatggaatttttacctggacccgattttcctactggcggaatcattcaagggaaaggtgaaatcagaaaagcttatgaaaaaggaaaagggcgcatcgttgttcgttcaaaagttgatattgaaccaatgaaaggcggccgtgagcaacttattgttactgaaattccttttgaattaaataaagcaaacttagtcaagaaaattgacgatgttcgtgtcaatgctaaagtgccaggtattgctgaagttcgtgatgaatctgaccgcgaaggattgcggattgcaattgaattaaagaaagaagcagatagtcagcttgttttgaattacttgttcaaaaatactgatttacaagtaaattataactttaacatggtcgcaattgacaacatgacacctgttcaaactggtgtcttacaaatgctccgttcttacgttaaacaccgcgaagatgtcattatcaaacgctcgcaatttgacctaaataaagcggaaaaaagacttcatattgttgaaggtctgattcgcatggtttctattttagatgaagtggtggcaacgattcgtgcttcagaaaataaagcagatgccaaagaaaatatcaaagtttcatttggatttaccgaagaacaagccgaagctattgtcactttgcaactttatcgtttgaccaatactgacattgtcactttgcaaaatgaacaagctgaattagagcaaaaaattcttgaacttaaagcgattattaatgatgaacgtaccttgtttaatttaatgaagcgcgaactgcgtgaagtgaagaaaaaatttgccaaaccacgccgtagtgaacttcaagatgaagtacaaaccattgagatagaagccagtgaattgattgtcgctgaagatactgtcgtttcagtaactcgttcaggttatatcaaacgaacatcacctcggtcatttgcttcatcagcacttgaagaaatcgggaaacgtgatgatgacgaacttctttactatgctaacgctaaaacaacacaacatctcttgattttcacaaatcttggtaatgtgatttaccgtccaattcatgaactttctgacgttcgctggaaggatattggagaacatttgtcacaaagtctttctaatttttcatctgatgaaaaagtaatttatgttcaaattgttgatgcatttgcaggtgaaaatctagtcgtggttacacgaaatggacaaattaaacaaattgaacgtgaaagtttttcaccatggcgaacttaccgctcgaagtcaactccttatgctaaacttaaaggaaatgatgatgaaattgtactcattagtcctgttcaatttactgacctcatgattatttctgaaaatggctatgcccttcgctttaatctggatgatgtcccagtcttgggtgctagagcagcaggtgtgaaggcaatgaatcttaaaaatgatgataagataaaagcagctttctttgtcaactcaaatagttggtatctgttgactcaacgggcatttattaaacgagttaaaacagaggatattccagccacatcacgagcaaatcgaggtcttcaagttttacggacattgaagacaaataaccataccgtatttgcggctggtttaatcaattcaactgctgatttatcagcattgaccgaagaattagatttgttcagtcaagctaaagcaccagcgacaaaagaaactgatgaacaagtattagaagtaatcagtgagactggcaagaaatatgatattaatttgtgcgatttatcattatcagatcgaacaagtaatggacatccaattgctgatgatcttgaaaaaattgcaagcgtaaaaataaaataaaaaaatcagcttttgctgaatttttttattgtcttcgaccaataatataacgaaagagggcagcatatagtagccaaagaatgatacaggcgccaataatccagacccaagcatctttttgatgagtgagcggaagcggaatattcattccaaaaaaaccagtaatgacggccaaaccagctaaaagaactgatacgatagttaaggtcgtcatattatcatttagattattattaaggacattattataagttccggccaactgttcaagaatttgtgcattgagctgagtcatacttgcaagctgttgggcttcgattatcgcatcttcaagctgttctttttcagtttcattgaactgtctgtaaatacttttagttttaagctgctcaagtagtaaagtattttgattggcactagacacaatgtagagcattcctgtttcaatatcagaaagtgcgagcaaatttttcttggttgttttttcacgcaatttttgattaatttcttctttagacttatcaattttttccaaataaggaaagaaagcctcggaaattaaaaataaactgataaaaagaagttgatagaccgtttgtggcctattttgtaaacaataactttttatttgattaattaagtattcattttctggatgatagagtgtaattaatcgatttttttgagctacaaaggtaacgggaactgtcttgtaatgagcttctgacttgagtaaatctaaactattaaaaataagcacaaagtcttggctgtcaggaataaattctgtatggggacgttcgtttttatcttcggcatattgaagtgtttctaggtcaatgccataagtagcaagctcagaagtatttctaagatcctcaacattaaaagaaagccaagtgagctgatcatttatttttatttcttgcatgatattatcctattgttctaatagagccattttagcaagaatcatctaaataagaccggtcaaagtaatccgaaagatgtaacatctcacataattctaagaattcatcacaataaatagacggaggtgcgggtgaatcttctgcgacccactgtaataaaatttgtataataatgcgtacatatagacgcagcagactctctcttgcaatcgacacatcagaaaggtctctctttagaaaaggacttgcacattcgacgaacccatctccaatataactaaaccaatcaccatattccgtataatgataaaaaatccgaatagcaaagcgatacttatacatcactggaatcacctctcttgcaattgcctcaaaaatcggaagatttttatcttttacaaaagcttcatccatagctttgataatatcatctgttgtctcatcccgaatcgtatcactaatttctatgacacttttaaagtgttttcgataaatggcctgtggtgtcatcctcaccttatttgcaatttcattcatcgtaattcgtgttccagaattactttcatttgctacaaccaaaaaagcatccataatttttttctgaatttctgtaatatacaatttttgctccttatttgcggaaatcatctaaaatcattataagcgcacctctacttaaatgtcaaaaagtttacattatataaataatgaaagttttgtttaagaatctttacattgcttttaaataaattagttcgtacaaaacctaatatagcactaacaaaaccaaaaataactaggaatttaaatattactaatattaaattgtcagtttattcaatataaattaattcatctttgaaacatattgttattttattgtatttttagtaaaataatcacaactacaaaatttatgtagctagaaaaaggaaggtgttttaaatatggaagataatttctccaaagggaaaaagattattgattctagaaagaatcatacccaaaacaagaatttccgaacctggaaatccaaaaaagcttggctctattcatcaagtgcattagctttactccttgccggtggaggaggacttgcaacctctgttacagtaaaagctgatgaggtggcacaagtctcaacgaaatcaactacatcagcaacgcctcctgcaacaactggtgatacctctgctactgctgcggcaacacccgcggtaacgactccaactgatgattctgctacaacacaaaccgcagcgcctcaaacagccgctaccacaagcgacgtatctaccacagcagcgacaactacatctgatagttcaactactacgccggcagcaacttcggctacggatgcttcaacagccacgccagcagcaactacttctgatagttcaactactacgccggcggctacttcagctactgacgcgtcaacagctacgacagcagctgcagctacatctgatagttcaaccacttctccagcggaaacatcagctactggtgcgtcaacagctacccaagcggctacttcggctactggtgcgacgggcgccgctggtaaagatggcgatactccgtatattggagccaacggtgactggtatattaacaataaagatactgaaatccatgctcaaggagcaactggagcaactggtaaaaatggtattactccagaaattggtgataatggcaactggtggattggttcttatgatactggcgaatcagcattaggcgcaactggggctacaggagcaactggacctacaggtgcagctggtaaagatggtgatactccttatgttggacctgatggtaactggtggattggtgatactgataccggacacagcgctaaaggagcaaccggagcaactggtcctaaaggtgatacaggtgcaacaggaacgactggggttcaaggtcgtccaggaaatgatggtgcgaccggagctacaggaaatactggtgctacgggtgcgaccggacctcaaggacctcaaggtatccaaggacctactggacctaccggtcgtcctaaaggtgatacgggtgcgactggtcctacgggagacactggcacaaccaatacacctggtgatggacaatggacaggaaatgcttcaggaatcttaactctcgatgcaactcatcctttggcagataaaccaaatcaacaagtcaatgaagttgttgctgttgctgatttacgagacggcgatggcaaaattgttacaggaaaccaagtagtaaaagtttacctctatgcaaacaacaaattgattactcaaacttctggtgtcattagcttgaacaatactggttttggtcaaattgcaattccgactacatttgatgcgactggactttctaatactacattgaccgctggtttctgtatcggtgacccaatcggaacgaatacgcctgatggtgatgtaactggtggaactcaaacgggtagtttgataatccctggtgatgataccgttgctgctacaactgtagcaagtcctacaacaatcggcacaaacacgcctgatggtagtgtaaccggtggaacgcaaacaggtagtttggtaattccggggaatagcaattctagtcaaacaactacaacagataataccgactctgctaagtcaactgactttgtaatgccaacaattactgctcctgcaaacgtgacagtaaccgttggagataactttattccatctgccggtgatgcaattgtaactgatacagactatacagcggacagtggttatcgcatgattctttcaaataatgtgaacactgcagttgctggtacatatcaagttgtctatacttacaattacatcgacccaacgacacaaggagctgctagtactactgccactcaagaagtgactgtagtcgcagctgctgctggaacaagttcttctgatactagcgttggttcaacaagtgcaacaggtgcaacttctggaattggtgcaaatactcctaacggagatttgaacaatggctcacaaactggtgatttaactgtacctggtactggtgatacaggttcaacgggagatactggatctactggagatacaggttcaactggttctacaggagacactggctcaacttctaacccttctggttctggaattggggcaaatactcctgatggcaactataacaatggttcacaaactggtgaattagaagttcccggagaacctactggtccaactaatcctactagccctactgggcctactggttctacaggaaatactggtgcgactggctcaactggggcaactggttctacaggagcgactggctcaactggccctagcggttctacaggtacaagtggtcaaaatggaacaaacggcactaatgggactaacggtcaaagcgtattaaatggtacgccacaagcacttaattaccaaacagtacctatggctccacaatcaacatcattgcctgtaactggtggatcatcacttgatgaaacatttgtcgaaattggcgcaactatgttagctttaggcgcttctattgaagttttacgtcgtaaaatgaaaaaatcataatttatttgacgaattgagtaaaacaatttaaagaagtcactcatttcattgagtgacttcttgttttggaggaaaagtgaaaactttgagtattatcatcccttttatgggaaaaacggaacagaatttagctgtcgctctagggtcaatcaatggtcaaatcggtatttatttttcggaaattacagtacatttagtaaacgatgctggtcctgaaattgattgggataaattttccatctttggaaatttggacttacagtatcatcaattgccaaacaatgttggacctggtatggcaagacaattcggaattgaccatagtgaaagccgctatattatgtttatggattcagatgatgagttgcattttgcaggagctctattagaatttttcaatgcaatcaaggattctggggaccatcaaatcttaattgcacgctacatcgagcaatttttagatgaaaaaggtggttttcgctatttggttcatcctatttatgactggaaggctgcttatgccaagtggttttcacgtgagtacctccaacaagaaaatttgagttttcatccagaattaaaacttttcgaggatacttattttgttggcttatcttgtcagctcgcaaaagatattcattatattgatagtgttgtctatagctggctttataacgaaaactcacttgtccgtcaaaatggcaaatcatttgaacatcaaacggccctttgggcaaaagaaaatcgtttgtttttacgagtgattcgggaaaaacaaccagaaaatcttaaaagagatttagaaaattacgtaattgatgtttatatgagacaacgaaaattcccacctgaaaatttaccggatttctatgtggctcatctggcgctacttattgaattttctgatgtctggtcaggatattcggaagatttacaagcgaaagtcgatagtcttcgtgatgtagctggtggtcagtggcaaggcgttgatacatctggctttcaagactttattaataatccttaaaaatattaaattagggtaaattattataattaatgtcttcatctctcggaaaacaaaaacactccattaactttttaatggggtgtttttttgatagattcaacctttaaaataaaggattatttgcaaattttatttcctatattttcagaaactggcatccatatatttattagatagcatcaccattccaaattgagtttttaacaacaacatagtcaactttagtaagtgcagacaaatcacggccaccagcataagaaattgagctttggaggtcttcttccatttcttttaaagtatcttttagtgagcctttgtgcggaagaagaattttcttgccttccacatttttatgttcacctttttgatattcggaagctgaaccaaagtattctttgaaaagttgtccgtcacgttcaactgtttgccctggagattcttcatgggcagcaaaaagagaaccaaccatgaccatcgtcgcacccatgcggattgatttagcaatgtcaccgtgtgtacggattccaccatctgcaataactggtttactagctgctttagcacaccattttaccgcagcaagctgccaaccacccgtaccaaatccagttttaactttcgtgatacaaactttaccagggccaatcccaactttagttgcatctgctccggcattttcaagctcacgaacagcttctggtgttccaacatttcctgcaatgacaaatgtttggggcatgagacgtttaattaattgaatggttttgatgacagagtctgcgtgaccatgagcaatatcaatcgtgataaattcaggaatgagagcttctgctgaaatttcacgaataaaggcatgttcgtctgctttaactccgacagaaattgaggcaatcagaccatctttgtgcatcttcttgataaaagcggctctattttctgcttcaaaacggtgcatgatgtagaaataaccttcttttgcaagcatttcagcaattttatcatcaataatcgtttgcatattcgctggtacgactggcaatttaaaagtatagttgcctagtttaacgcttgtgtctgcttctgagcgactgttaatgacacatttatttgggataagttgaatgtcttcgtagtcaaatactgagtttaggttattcattgtaatttctccttggagtgtgaataggctatttctaagtatttcttagcctatgaactcattaatgatttgatttacagaaaagaccgaccaaaccctacgggtttcactagttgagcgattataaaatctctgtttgctcaaccttccttattcattttatctcaattaaacggatttatgagtaatttaccttatttataagaaaaaacggagcgtaacgttcggaaatggaaaacaataaaaaacactgacaaacttatcagcgttttttattgaaaaagaaagttccacgacgataaattatgaaaaagcttaattcatatacgagtagaaaaatcaaaaatgtgtgcatgaagaattgttcaggtaggacactgatgattggatcagtcgccgggtcaaagagccaactattatcacgaaataatacttcatgaaaagctacaaaaaactggtcaaagccaatcaaccaagcaataattccaatcgccaaaggaaaaatcatgacaactctaatagcattatggaaaactagagaaagattttctttgataaatcggataaatattgggattaatataattgtcagaaagaaaacaagcatgaacaaattttttacttccgcaaaatgatggagtccacttgctgacgaggggaaatcaggcatagacaacttattctctaaaggattaattaaataattcatcaaaataaggaaattgtgccagatttttccaatactcatttgtactaaatcagtcaaacgataccaaaagatttcgccaaaaaacaagggaatagcgagaaaaatagttaaagttacggaaaatgcaataatccatataatacttaatccaaaaatgagtttatctcgcatagcttctcctaaagtattcaataagttactgacgaaaatatagcagaaacgcagtaaaccaaaacctgcaagaactgctgataaaatggtcaataactatcttgtaagttataaaattactgacagagttgacggtaagtttagacttcccaatcgtccaaactagacaccacataagttggtggaactggaaggtttggtacttcttcagctttggtaaatcctgtcgtcacaagtagactatcaataccattattaattcctgtatgaatatctgtcagataattatctccgaccatcaataagtctgacttaggaagtccgagtttttcaacggctttgtcagcaataattgcttcaggtttcccaataattgtcgcttcaactcgtgttgccgcttcaagcattttaatcaatgctccagcaccgggagtcaaaccacgttcatttggtaagtttaaatctggatttgttccaataaattttgcccccttatgaatggcaagcgtcgccaaaaccaacatttcataagttaaatcagtatctaaagcaacaacaacataagctggattttcacggtcttttttataaccagcttcatagattgcctcttttagtccatcttcaccaataatatagactgttttttctaaacccaaatcgttcatataatcaacagttgctagacttgcagtataaattgtttcaagtggagtctcaatattaaagtgctgactcaaacgtttttgaaccacgcgcggtgtcttagtggtgttattagtcactaaaagataaggtattttggcttcttgcagacggtgaatgaaattttcaccggcaggaatccgtttattacctaagtaaattgttccatcaaggtcaatcaagtaaccaccatattttttatttgtcatttttattctcttctaatttttatcattaaaaatctactgacagaactgtcattaaattttcccccaatgaatttcaatttgagtgcttccgtcattaaaattatgatggctaacgtcatctttccaagacatcaaagcttttatttcttcaccataaagaatttcatggttgtatttgatgaagacatgttttggttgatgttctttacggaaatcaaagtcaaccatatcagctgcccaatcataatatttagcattattaacatgaccattcatgtctaaagcagaaaatcgaacaggataaacaatttgtcgtgtttcaccaaattgctctaatttaaggaatttatgaggacgggaaatttttgacactttttcagattcataagggtcaacaatttcatccaacacacggtcaatttttcttgtttctttgtccattaaaacccaagttgaatgaatttcaactaaaacttcccctttttcatttaaaaatgagaaattacgataacaaaagaatttattataacttgttgcttctgtttcgatgataattttttcattgaactctggtagacggtgaatggttagttcatattcaataactgcccaaaaaaggccatatctttcaaaaacccaaacatcagaacgcccaagagttgtcgactgctcacctgaaatctgtaaggccacggccaaaagacttgaaattcgcatttttttaaaagcatcactttcatagaaaggaacttgataattttgttgatattttacacccattttatgataacctcgccttctattttagcaaaaaaaagagcaattttcataaattgctcatttagttggcagtgatttactaattgaaacagattatctaatcaaatcttattgcaagaaatttctaacgtgtcaatcagtaattcttcatatgggtctttggcatgatattcatcaatatatttgatttctttcacaccagcagcaacgactaatttcagacaggctagacaaggaaaaagagtagtatatagaattgcgccctcaggcgatactccatgtttggcagcttgagcaatcgcattttgttctgcatgaacagtggcaacacaatgaccgtacttgtcttctgtacatccaatatcagtacaatgaggcattccagaaacagcaccattatagccggttgaaagcagctgaccatttggactcactaataaagctccaacttgggcatggttacaagtagaacgtttcgcaaccacttgaactatttctttgaagtattcatccttgcttggtcttataaatttttcagtcatgacaactccttaattactatttgattcattataacaaatttatttgcatcagtcctgataaaaaaacttccaagagaaagcaaatcacttggaagaaaaatattatttttgatttttaaataattcattataatttgattgattattaaccatatttaaatcaacatttcctgaataaccaggcaccgttccttggtcagtaaattgttgcattttgtaacttaaacttgtctctggtgatgcgtcccatgagcctgtatttcgcccataagctgcaatccaaattgctttaaacttatcaacttttatttgattatcccgtaagaaccaatcttgtgcataaatcccaatgtttttagccccttgcttttctaattccgcgcgaaaagcttcaattccttcattcatgtttttcatattggtaacttcaacatcaagccaataataagttggtttatagggacttgcacgacgatagaagtcttttgcttgcttcttcatttctgtagtatttttaccagttacaaaagcatagactgccgttggaatccctcgctcttgaaaagccttgatatgctgtttataagcagtatcttctccatccttgcttgctgaattatcagcatgaccataagaaccattgacccgtataaccgcaccaatcacatgctgactcaaggtgttataatcaatatcttctggacgttgccaacccgaaaggtcgacaactggtttattcaaatccagcaccttctcatccaaaatatgattaacaacaatcttttcatttgctgcttttttaggaggttctatcggtcgaattcgtactaaaccaagtaaggcgatcattgcaatcatggttgctgtaaagataaaagctcccatttttttaagtttacgtctcattttaggtttcattaattatattgtaacatttttttcacaaaaattcatcactatagcattaaaaattaacatcatcgagtaaaaatttttcaaagacgttatttcctagttcaaaccctttgtcagtcatatgaattctttctcggtcatcatataataacttttgtttgatgagttctgtaatttgttctccatatagtttatcaaaagaacaattaaattttgcttcaaatttttcaaccagaactcctgattttttgcgcagacctagaaacatctcttcttcaatttgagattttttgcttaagacttcttcattcactcttttatcatttgccgccgctttaagataatgatgcactggtccataattcttatatcgaacaccagataaataacctgatgctccagcaccaattccataatactcttcattatcccaataagttatattatgcttactttcaaaacctgggcgaccaaaatttgaaacttcataatgctgataaccctgttgctctaagatatccatgatatattcatacatatctgcatttttatcttcgcttggcaagcgtaaaagaccacggcgttgacgattcataaaaacggtatggtcttctaaaatcaaactatataaagcaacatgcggaagatcaagagccaaaaatttatcaacatctgatttgaccatttccatcgtctgtccggggagtgcataaattaaatcgatggtgatattttcaaaaccagccattttcaagcgttcaattgaatcatagacttgagcttcattatgagttcgcccaattttttttaataaagtattattaaaagtttgaacaccaagcgaaattcgattgacagcagaatgagctaaaactttaatcacatcgtctgataaatctcccggatttgcctccacagtaaattcttctaaaaaatctaaatccaattggtcagctatagcagttaacaaacgctcgagctgttgagctgacaaaacactcggtgttcctccaccgatatagaccgttttcaatttttttattttaagactttggaattcttcaatgattgcctcaatataagcatcaacaggttgccctgtcatcaaaaccttagcaaagtcgcaataataacagatatgagaacaaaaaggaatatgaaaatatgctgagttcggtttttgaaacattaatacttcccttcaaaagttttttcctactcaatgaaatataatggaaaataatttctccaatgtaaatcataaatacttgccctattatatcacacctgagaaaagctacttcttttttaaaacagaaatattttttctgtttttttcagaaataaaaaatagggtagctttcgctcctctatttaatcattcttcgctatcccattcccaagatcttgaaaaatctcctcctttaaacaaagaggccaaaccactcaattgctttaatcttagtaattcttctttatccatcccaatatttgtgattatccaacggtcactcaatcccgcttcaaaaccaattgttgaacgattttcgtcattaattcaatagaatgagtccctctagcacgattgtggcgaatggtactcgcaattctgtcttctaagggacggtcaatgattgacactggtaagcagttatgttctctttgagcaatttctggcgaatttttcatgactagatatcgatgaaaaccatccactatctcatagatatctttttctttatcataataacaaacgattggcatcgtatagccatcttctaagatagagcgctctaatagtttgaactctgatggtgcagtcttgtttggattatatgagttagctctgattttctcaattggaacacgttgcacttgataagctgggcttataaaaagctctcccattttttcatggcctcctttttcttttgcaattcatctttggtttgaccaaaacccatgtactggcaagaagtatcattttttaaaattgtgatacacattctcttataagaaggaaccagcctaaagtttttgattggaacatcatcggggtattttttgaaacgtataaccttatgttcctgtttataatttcgattatttttcggatttcccaggttttcaaattgtaagtctgtctcttcaagttcacgaactacttttaagggccccaccgtttttggtccaataagtcaatgaactttgaaattttttaagataaacttgccgcatttctttcgaaagagttttaagaaggaaattgacatagctttcccaagtgtgtcctttaggcagggtgactccccgataaccaagagcgaccgtccctccatagagagccgcaaaatttgctccattgacacgccccattagtttcccccaagtctcaggctctaaagcttgatagagttttagagaggcgactccacactgatgaaatggattggcaactctcatacttttaaagggaacaccagcttgaaaatataaatcatataaatgattatagtcaaagccaaattttgcatttgctacccaacatcctcaaatagccaatcatacattggataaaaattgaagacattatgaaaaatacgatgactataattggtcatgccaaatcgtgaaaaagtttcctcacgagtcacagcattaaaacgattcaaactttcctgagctctaattccaacaagaacagccgttctttctgcttttgtttcttgatgaagccactggcaaaacttactttgaaaatcatagtctgacattccaacttgaaaaaaggggaaattatgattttgaagatgaattgctcctttgggaatgggatttaaccagagttctggatgttccggatcccaaggcaaccaagttgattgagacattgatatgccacaagaagctgaaactggcatacagatgtgataatagtcaaaactaggatattttcccattgaacgctcaatatagtcttttgtttcttgataatttccttcgtaatcaagataataaacagaaactttaactccttttgcctctaattcgttttcttcgtagtaacgatgaacgagttctaacatcactccggagtcctttcctcccgaaaaggaaacgattaaatgatcaaaataattgcatatgtagtctaatcgcttattaaaagcctcatatacattttcctcttgatattttctcactagttcatcccctttgaatagtttccatttagataatattttcccgatttaatatttaattcttataatttatctaaaattccttatcaactaagtctattttacttaaactattgatttttttcaaggatataccaaaacaaacatattaattacattttattgtgttcatattatcttagatgaatcctttaatctactgcttagaaagctcaaaaaatgtgactgaattaattataattatttatgtcatctataacaatcaaatcaattcattttatgcacttcgttttaattttactgtcaaattaactaaaaaaagtactcattagagtacttttttacgctttaaataatttcttctgccttcaattagaaacatcattgtcaaactaaggataatgagataaatcggaaaagcaacttctgtaagtttccactgatgaacttctgtaaaacttgtacttgcggaaaagagacttcctaagaacaagaatccattttcggtttctgggaagttccaacctttaatcagagttggaagtgccgctaaagcatctgagagaatcgctaacaaaatagcaacatttgggttcttagtcatataccaagcaactaaagccaagattgatacaaaaccacaaatataatcaatttttcccattttccaataagcagccttattgaaacaagcaacagtaaatactaagattggcccaaaaccggccataaacactggtaaactcgcccaagaaactcctgttgataatgatgcagctgtgctaattagtggagcaataccccatattaaccaggtaattttattgggtttaacacgaccacgaatgctggcaacaagataagtgcttgtaaaggacaacgaaatgagcgcccctaatataacaataaaatgcattaatttctcctattaatcttgctttattatagcaaaattttaggactagagttcttctgggaatcgatagacttgaacgcttaaatcctcataagtctgtaaataaagtcttcgactcgtcacctcaactgcacttcgatagacagtataagtccctgagcggccctctgatttaggaacagtcaccccatttaaaatatgccaagcttcaataatattttgctgttcatttttaggataaatggctctttctttatagatagcggcccggataaatcgggaagtcggtgtaaatccaccaggaaatactggtttaccattaaaactcccagtcgaaatctgattgggattattattttttactgatggttctgtcagtatattaagatccatataagtggttaatttttcaacttctctttcaaatttgggagcattggtgaccacacctatcgagttatttgaaatgatcagacgtccaccatgtggttcgatatttatcatttgaccactcgaatccgttgccgaaaaatgcaaatcatttcggccaaatttgaaagttgaattttcatcggtcattaattggacagtatcaatcttctgacgaacttcttcaattgaacgacagtttcctaataaccaaagtaaaaattcaaaagcagcgagttgaattttcccagcttctccttcgctagcataatctgactgattcgaaaaggttaatttttgagcagctaagccatattcattgaccccgtcagaaatatcagcatgttgacgcatttcactatttcaaacaccaagaattgcataaggatttgtcattttttcccattgtaaacacttgtccattcataattcttaggcagaaccagtgcttctgccttaaatggatgccaatccattgttcttgcaaaaactaggccaccatcacttgattttagttgaaaactagtacacattttttctccccttaaatagatgtcatctatttattttatcaaaaaatttactgatagaggtactagcatatctgtaaaatgctatcctatgacaaaggttcaaaaaagttccaaaaaagtactgacagaattgtcagtactttcattcaacccataatttaaaaattatttgtacatttcaagcaatgcaaggaagctatcagcttcaagtgaagctccaccaacgagggcaccgtcgatgttttctttagccatcaatccttcgattgtttcaggttttactgatccaccgtattggatacgtacagcttctgaaacttcttttccgtaaagtttttcaactgttgaacgtacaacaccacaagtttcgtcagcaatttcgtttgtcgcagttttaccagttccaattgcccagattggttcgtaagcgataactaagtttgaaacttgttcagcagtcaatcctgcaagaccagcttcgatttgacctgaaacccattcagctgttttaccagcttcaaaagtttccaaagtttcaccacaacaaaggattggagttgctccagcagcgaagattgcttttgcttttttgttgatgtcttcgtcagtttcgtggaaatattcacgacgttcgctgtgaccgatgatgatgtattcaacaccaaggtcaacgattgcagctgggctgttttcaccagtgaatgctccagcattttcgaagtagctattttcagcagcaagtttcaattctgaaccttgacgaaggtaagccataggagcgaggaaaagagcaggtgcaccgataactgattcaacattatcagatgaaggcaagttatttttaacagcttcaacaaaagcttgtgcttctgacaaagttttattcattttccagttaccagcgataattggtttacgtgacattctaattctccttatagggccttttaagcctcttaaattttggacttttaatccatcttttacatggtctattttatcacattgtgaaaaaaattgcagaaatcaactcatcatcagtaaatttcggctctatcatttttcttccaataatttaattgcatctcgtgtcttttctaacttatcatagctctcggtaaaatgttctgatacaaacatatagaaaagaatgtccacaacataaagttgtgccatcaaactcatggtggcagccgtacgcatttgataatcttctccagaaactgaatgaaggatataatctgacatctgtccgagtgtcgattcttctcttgaagtgatagcaataattggaattttcatcccttttacgactcgtgcaagttcaattacttcctttgtttctcccttcatcgaaatgccaataaaaattgtttttctatccgaaatcgaaagagatgaaacaaataaatgagcatcttgaataaagaaaacttgctttccaattcgactaaacttttgaaaaatatcctgagcaaccatagatgatgctccaataccaaatacaaaaatactttctgcttcatcaattaaagcgacagccgccatgatttcatcatctgataaggctgcattggtcgtttccaccatatgattaacccgaacttttagtttattcttgattgaggacggtgtttcagagtcatttacttctttataataatcttcatcatcttcatgaacagcataggaggcactcaatttttgtttaagttgtgagaatccatcataacccaactttctggaaaatcttactaaagccgccgaagaacttccaatttcactcgctacctcttgcgcacttttttctaacattttttctccgacttcaaaaatatagtcggctatttttttctcaactgttgtaaagttagaataattttgcctgatgataagtaaagtatccatgtatcctctccattcttatttcattataacaaagaggttggtataaaccaacctctaacttttatgcttttactgtgaaaatttcttgacctttacttattgttgcaccatgtgtaatgataatttctctgtaagtatccgaattagtaataacaactggtgtaattgtagacaagcctgcttcttttattttttcaaaatcagctcgaactaataaatcaccttttctaacacgatcattttgcttaacaaaactttcaaatccttcaccatttaaagcaacagtatccatgccgatatgaattaatatttctaccccttcatcactggtcaaacctatagcatgtttagtcggaaagacagttgagactactccgttaactggagacacaatttctccattcgttggttcaattgccactcctttacccaacattccgcttgagaaaacttcatcctcaattgaagaaagttcttttacattaccatcaagtggtgaactgattactgagctataaaattctggcgtcgttacgacacgtaatgtaggttggagagtttccatttgtacggattttccataattatccgctttttccttagcatctttaggaatcccaaagagataagttgcgataaatccacccacataagcacccaagagaccgagaagatatacccaccatttcccattggcaataagtggaaggagagcaagacctgaaggcccaatagcaatggcacctgcttgacctaaagaaccaataatgggctcaccaatccctccaccaatacaggccgtaataaagggacgaccaagaggaagcgtaattccataaattaaaggttcaccaatacctaatattccaactggcaaagccccttttacgagttcaacaaattctttatcttttctcaaacgaagccaaagtgcaatcgcagcaccgacttgaccagcaccagccatggctagaattggcaataattgagttgagccagttttggaaatcatttctaaatgaatcggagtcaaaatttggtgcaaaccaaacataaccattggtaaaaagagaacgccaagtacaaaaccagaaatgccaccaccaacttgaagaataaaattaattgctcctaccaaacttgaagaaatgacgcctgctattggcataatagcaaagatttctgcaaacccaatcactaataaaccaatcgtaggtgtaacaataatatcaattgaatcaggaataaatttacgcaattgtttttctaaaattgataatagccaaactgcaaaaattacaccaataatcccaccttgaccggatgaaagagcacttccgttaaaaatattctttagaggaagctctggattcatacctgttagtagagaaacagcaccgatgaccccaccaagagctggagtcgcaccaaattcttgagctgagtttattccgacataaatagccaaataagagaagattccagattgaataatcttaagaacagtaataaattgtgtccaagttgctgcatctaaagttccagcagtgaccaagttacctaatacagaggctaatcctccaattaaaccagcaccaacaaaggctggaatcaagggaacgaatattttagaaattgtatttaatactgccttaaattttgagggtttattatacttttctttagcttccgattttgtttttgccattaaatcgtcgattgactgaccttctgcatttggaaaagcttctcccaatcttacgccaactgtgtcgaccattgcttgtgcaactttatttactgttccaggtcctataacaacttgaagtgtttcatcttcaacaacgcccattaccccgtcaatcgcttttaggcctgcgagattaactttagaatcgtcaataatggtcatccgaacacgagtcatgcaatgaatcaattttttgacattctgtgttccgccaacattttcataaatctctcttgcaatacgagctattttttcttccgccatttttgctcctttttctaccttaaaagggtgaattcttaattcagagtatttttcacaaaaccatttgctttaactagttttgtctttccttcttctgccgcacagtcagttagaagcattataatcgccagtttgacatcttgatttgcttcattgaatttttcttcggcttcttcataagtacaatctgttgcttgcataatgattcgtttgctacgctcaactaatttttcgttagttggcttaacatcaaccatcaaattattataaactttcccgattccaatcattgaaattgttgaaatcatattcaaaattaatttttgagctgtccctgatttcaagcgagtagaaccagttaaaaattctggaccacagtcaacttcaatcggaaattcagcatgttttgaaatttcagcattaagattacaagaaagactggctcttttagcaccaatttcttttgcatagtctaaagcaccaatcacataaggtgttcgtccacttgcagcaattcctaaaactagatcattttctgacaaatttaagtcaattaaatcttgtctacctagttctaaactatcctcagctccttcaactgcgactgtcattgccttgtctcctccagcgattaaaccaacgacttgcgttgctggcacaccaaaagttgggatacattcagccgcatcaagaacccccagacgaccacttgttccagctcccatataaatcaaacgtccacctttgttaaaagcttctattgctgatgaaataactggttcaatatttggtaatgcttcttctaccgcataagctactttcttatcttcattgttcattttgacaagtgcttcttttacggtcatttgatcaaggttaaatgtttcgtcatttcgtcgttctgttgttagtgttgataaatcaatcattatttttctctttttctattttaaatttttgtcctgaaccaatgaaagtaatgagtggtctgtcttcagcgattatcttgcctacgacattgactttctcatctgctgctaaatcatttttgacaatttgaatttcacccatataacggccatagtcacaattatcaatagtgattgagcctctacttcgctcacttgtgttttctgggataatttctggaatttccttgaagcgcgcttgagcgctcctaattatatctctggcatcatcttgtctattttcatgttgacctaagacataactaaaggaagttgttgtttgactagctctcactgacaatacattttcttgaaaataacctttaatctgtttaagggtatagtctttcaaacctccatcgccgacgtaaatatgttcaacattcattgattccatatctagtaaacaagccagagggtgtttgaatctgtgctcttcaagagttggtaatccttgatacagaggatgccgtaaagaatcatcgcctggaataaatgccatcacttgaaaagaatgatttttcagaaactcattctttttaagaaaaccttcacgggaaagtcctgtttcacgtcttggatagtaattatgccatgcttcaagtttgctaaagtttgctttatgttcttttaactcatcaatgtcttttggtgtaatagtactagcgtttagacttactgtcagttcctgactcactttagcaattgtttcattgctaatatgataatccatcctaagaccagttacacctaaatctttaagctctttaaggcgattaatagaaaagccagctttctctagagcatttgctgagatatcaaccatgagttttaaatgattctcttttgctctcttccctaaatccatcagcctttttttataaaggctcacttcatcttccggaatgtgcatagacgtaaaaatccctttaaaaccttggtttgccattttgtcaatatatgaataagttttttcatctaagtctttattcatgaaaattgaaaaaccgtacattttttatcctttcgaaatatcatttcttgataacgtattcattatatcgtaaacgaattattatttcaagcattaattttatttttttatttaagaaatattatttcgtttaattaaataaaaaaagggataattatctatcccttattttataatgtgcatttttccttgatggattcaaagttctcttttaagagtgctgcagaatgttcaaatttaccttgctcttctgctgttaattccaattctaaaacagctcgaacgcctgtccggtcgattattgctggactacctgtatatagttcagcttgtccgtactgacctgtcaaatgagctgaaacaggtaaaatgacgctctcatttcggaaaattgctcttgttaaacgcgctaatgaagctgcgattccgtatgatgtatttcctttttgcatgaaaatatctaagccaacttcgcgaatttcttgatcaatttcatcaaatgtcggaaaatctggattcggatatttttcaagccatgttgttaatggaattgcaccaacagtaacattggaccaagcggcaaaactagatttcccatgttcagctaaaacataaccatgaatacttttagggttaatttgaagtttctcagctacaatttgtcgcattcgacttgtttcaagcaaggttcctgttccaataatacggtgtttaggtaagccagaaacttcagcaactacttgagcaagtacgtctacggggtttgaagctactaagaaaataccgtcaaagccagcgtccattgtttttcgcgtgatatcgcgaatcatttcaacattattttctagtaattgaagacggtctggatttttaccaaaggtagctgacggagcattagcggataaaacaacgatatcggcgtcagcaacatcagcgtagtctgctgcataaatatttttaggagctgagtttaaataaggcagagcatgaagtaagtccaaactattggcagaagccttacttttattagtattgataatggcgatttcatctgctaaatcatcaacgaccaaattatgagcataagtactccctactgctccagctcccacaattacaacttttttattattaattttcatctcttttttcacaaaaaaacaagtgagttaactattgactcacaacgttttttggctccctttccaaatctcttttcctagtttcttacgctttaaaatctcgagcgatttgttcatcttctttcatctggtcaatcaattgatcaataccttcaaattttatcatatcgcgaattttatctaaccataacacggtcaaattttcaccatagatttctccattaaaatcaaagatatgaacttctaccgttttctcagtgccattaaaggtgtcattatagccaattgaagcaaaacctcgatgacgttcacccgcaaagagtacatcacaggtataaactcccacagcaggcagatgaacataatctttaatgaccaagtttgctgttggataacctaactgtcttcctctagcaaaaccatgtacaacaagcccagttgtttcataagaatagcctagtagttgattagcttgagcaatatctcctgcttcaactgcttttctaatccgagttgaagaaattttcccttgctcatcagctttttctggcataataacaacccgatagtcttctgttgactctagattcttcatatcagaacccgttgtataatcaaaaccagtaataacgactttaggattaaatctcatgactacacttttagcaaattctgttgaagtttgatgcgcaaacttagaggtaaagtctttaaaaacaagataatcaaccccattttcagcaaacagttctgctctttttttatctgaggttaattttaaaagcatatctggctcaaatttattaaatgttaaagttggtttttctggaaatgtaaaaacagcaatttttaaatttaatactgcagcaattttttttgcttcagcaaagaggctttgatgtcctcggtgtaagccgtcaaaataaccgaggacaagaattagttcttcatcaaattttagttcatcagtaaattctaatatttccatttttctcacttttaacttcatgtgcttagaatcagaccaatactttattgggtttccagattccttctttttcaggatgtttcatatagacagcaactaatttatcattataaaaagccgcaaatttttctgttgtcagtaacgacaagtctgtcagtaaatattcttgctgctttgtcttgttgacagagctgtcagcagtttctacttcatttgtccaatcactttgagcaaatttcttgccaacacgcgccatatcaaactgaacagtagtcaaattaaccctaggcaaatcactgacagcatattctgctggatacaatatagtagaaagctttcctgattcttgtatttcttcaatttttgacaatttaatagcatctttaatcagtaagccattacttgccgtccgttgtaattttgacatatgtcctgcataaccaagactgtccgccaaatcaaccgctaaagtccgaacataagtccctttactacactcaactttgaaagaaaaagtgactaagccttcttccttattccaatcaatcgggcttgtccttacaaaagattttattgtaatctctcttgctgggcgttcaatcgtctgacccgctctagcatattcatataactttttcccattgatttttactgccgaatacattggcggaatctgttttattttcccgacaaagcgcgacatagcagaatcaatttcactctcagttaaattattttttactggcgtttgatttacaattgcaccatcagcatcctcagtttcagttgaaaacccaatcgtcacttgaccttcgtaaattttacctgctgcttccatatattctaataatcgtgttgattttccaacagcaataggtaaaacaccggttactgatgggtctaaagtcccaccatgtccaattttttttgtttttaaaatacaacgaagtttggcgacgacatcaaaagatgtccaaccagcttctttatagacatttaaaatgccgttcaaattttcattcatcctgaaaattatagcattttttgtctaaaaaatcacttacagtctctatcagtcatcgttgccaatccaaaaacactgacagaatagtcagtactttaatttcacaaaaaaagactgacaaaagtcagtctacttcttatcaatttcctgttggaactggtgtggcatttattgatttaatttgtgaacttccactattgagtgaagtatctgaaccatatttggctgcaagttgtgcacctgtcagtgtttctttagtttgccaattgaccaacggccaaggattctgtgccattcttaagcctgtttggcttgggtctggaacttgcaaataatatgttccatttgcgttaatttgaacacgtgctgtattctgaatcacatcaactgggtcattataagatgagactccgtttgctcctacattgactaaataaatccgataagcttccccagtatatacatcgaatttgccttgtgagttattaacccattgggcatatactgcatcttgctgtgtgcttgttaagtcagtccaattcgccggagtacttgtactttggctacttgatgaacttgctgaagtcgttgaagtagtcgatgtcgatgaactcgatgtcgatgcttgagttgaatcactggatgtgctactactttttgatttacttgcagtgctcttacttacctttgttgagcttgtttgtgcaaatgatgctgctttatcagaggttttatgaggataaaaaacttgataagcgatgactccgagagcaacaattaaaatgactgctaaactgataattgcaattatttttttattgttttttaaactcgcttttgaatgttttgccatgaaaagcctccttaataaagctaaaaaaatcagttattccctttacattataacataccctatcaatgagggtcaataaatgacgataaggcctaaaaattagccaacttctcaatacagacccattcattccaaatttcatctgattatttttaaagtttgctaaatctataaatgtagaaatcctccaactattttttgatgatatttggagttgttaattcccaagaagcattcaacttataacttcccgttctttttacataaccatccgcacgattcgtatggaactttaactccacatctgttttataaaactgcatacttgaagttggctaaacttcagtccaattggaatcaaccgaattatcaggttcagtacttagtactagcattgtttgttctcctgttgccttgagtgagcccaaatttacaaaagcgcccggtaaccaagtatcatctgtatcactgacaagattatataattgagcattaaaatccgttgcgctatctaacaacaatggattattttgaatttcagtcgtggtattttttacaagtaatttccaatccaaataataaggattctctacattaatttgacctttcgcaactctaaactcattatttgctaatcctgaggtccccaattgataagtcccaaaatcaaatatcttaggataattgaccaaaaggtctccatgtacttcgagtgtatagacagccattgtattagaatacttcttatcaatttcttcttgactcatcgttgataagtcatcttcttttcttgcaacaataaatgaaaatttatttctatgtaataaatgctgaccaatgaatgctttttgttgaccatccacatcataagaagcatcaatttgacctccatcatataaggtctgatcaatcataattatcttttccatcagcagtttttaaatcttctgtgacgtcagcaattgagagttgggtagtctgagcactatcttggtcattagctgcgattgcttctttttcatattttttccattgtccgtcattcatacgcgaccacagattgctcgaactattggctggttgctaaatattaaatgtattttttacttttctgccatctaatcggtgcatcgtttgggattctgggtctacctggatattattgtttaaagaaaattcaaatttctaatgagtcgtcgcattttctgggctaaaactaacattgtcaggtaaatcaattgatagaatacgcggtggtgtatttgcatcaggttctaaatcgctggtaccgggaaaatcaccatcgctgttaaaatttgccgagaaggcattgtcagcggtgatatcactcaataagtaaagactgcgtcccgttactatatttcctgcgaacccttgagttgtggtactgtttacggaaatattagtgtgaggggctagtaaggttcctaaaaatgaaaaaccatcatctgttttatcattattgatttgaatcgttgagtcctctccaccggtaattgtattgaaattattaataatatgtgaagcggtattatatctctgcgcgttatcctttgttgaggataaatttagacggtcatcttttaaataaaattgatttacatctggcttatcacgtttcacttgttcacttgtataagcacttactctgaaaattgaagtgttctcaaaattaaattgattaaaattatggtaattcaaaatgatataaggaattttttgcttactagaatcatagtttaacaaatttattgatacttcttctgaattttgaaaaataccattatttgccttaccgtcaatatcaaccgcaacaaccccagtattcgttttagtttcatccatatttatatttatttggataaggcttggcgaagtccagatagggtctttgaccatttggctattgactgttacagattttttattgcatcattaaagaccgctaatttataaccagttatatttccctcagaatcataggtactcgcagtcaaattatcataataatcactgacagttgttacattttgaattcccgaactttgattgactacaccattatctttaaaataatcaatatcttcaagatgagccgtttctccattagatttcttgtaagctttattcgtaaaagctgtcttatattcattattattaaaaatactgtttaattgattgtcagtaaattcatcagctttggttgcccccatcacgtaatggtaggtctccccttgatttcctcgcaaactctgtgtctcagcaagtgactttgtgatagctggagaaaatgccgtgggcgaaataaacattggatccagattattggacaacttacctgtatatttacttaaatcattgatacttccaggtccaagttcagtttttccatcactttataaacttgttcctgaataaaagtgacctgcataaaactccccattggttggatagttagtgttaataaccatattctcccctgcatagaaagttgccattgttgccgctcctaaaggatatttgtcactcggtctaacaattccttttgtatctgcctgaactccttgcgataaaagcaccaataaaatggcgaatatgacaatctcacttatataatacaaaaaacatttacttcttttcaattaatccccttaataccacactttcagaaggttgttttgtaatgttgtaatttatatactacatcaatgcaaaacaatctcctttatgtttttaaaaactattaagtattatatcattttaatgttagtttttttggttacaatgtgttacgatattgtagttctaaaaatccactaacttaatgagatataaaaatgaaaaaaataaaccttgctttattaaccctagctactctaatgggagtctcataaacagccgttgtatttgctgatgacgctacttctacaggaactctagaaattactgatggtgatgttacacttaatagtattgatagccttgactttggttcattccaatataataatagtgatatttcagttcttttgaaagatagtactaatacaactggtaaagaagctgtacacgtcactgatacaagagccaacccaacaggttggacagtttcaggtagcactcaagatactggagctaacttaacaataaatggtgtaacattgaccagcttaagtggtgctgtgttcactaaagcggctgataatgaaaactttggacaagagtctttaaatattgataaagatagtacaaatattgccttaactaaagctcaagcaaaagctaccgctggtaaatctatcacattaaatgttgattggacaatctcaaaaacagtcacaaaagctagtgacttcaactaatttataggcaaccctcacagcgtgagggttgttattaataattttcccaaaaggaactcttatgaacaaactcttcctccttttatcatttattttcggtagtcttttactgacacaactccctgtacaggcagatgccaatttttcaattaagaaaaatgaaaatcagtaccagacaaaagacgcatcattttatgatttgctgattccaactgattctacagctcaactctccttaacaatttctaataacgaaagtcaaactaataaattcaaagtttctttatataatggtttgacaaataatttagggcaaatatcttatgcagccccttctagagctactcttcctttccctagtacttcaacaactcttagccaattaaatgctgagactacagaagtcgaaattgctgaaaatcaaagtaaagaagttcttcttaatttgacccgaccttccgtttcatcacctggaatcattttaggcgctattcatgtctcaaaagttccaaataatgtagaacaagaagaaaataaaaatcaaaaaatcgttaatcattatagtgcagaaatccccgtggtcattcgaacacagccaagctcaacagctcagctagatttacaattgaccgaagtgacagcaggagttaccaataaaaataaatcaggcattctggctaaactggctaatccaacaagctgggtaatgccacacctgtctatatccactaaagtttatcagcaagataataataaacttttatatcaatctactgatgaaaatcttgatatggcccctcattctacttttgattatagtgttcccgcaaagactaagcttaaagcaggacattactatttagatttggtagccaaatctggtaaaaatacttggcattttactgagaaatttactgttagcagtaaacaagtcaaagaaattgcgaacaattctgttcaaaagaaaaactcttattggtggttattgtggttcttactcttaattcctatttttgttattttactttatctctaccgtcgtcggaagaaaaaaactaaagaaaataattagcatgtccgaattttctcaataaaagaaaaagacaaatttaaacattttgtctttttttatttttatatttgattgtttatttcgcgtttttttaatgacagaacttagccatttttttacgtcagtcatgaacaattttatcaatcaatttcatcaacttttcttcatttccccttttccagtccatcatacttggaaacatgtaaataaagcaagggtataaaattgctgccttaaaacgttcttcaaagtcttttaattccaaagaaaagcctctttctataagtgctttatgatataagatagcctcatcagcagaaaaataatctacaaggtcaatataaaaaggagcatagcttgaaaatccaaaatcaataatataaggatttccttgaatattatagacatggtttccctcaacattttgtaaatcgccatgtgtcaaggttaaccactcttcttcctgagagatttctatcatattcttcgcaaataaagcggccttttcttttactttcggtaaatagccttcaaattgctgagcaaatctataatcatcagaaattgctttttcaaaatggtccaccgatagttgacctactattttattccaatattcagcatcagcaggcgtgagccacgccatttcttttcctcggttcatattatttccatgaatttcagcaagagcagccgcaactttattcaaccattgcaaacgattagaaggtgcactaagttgtttacctaaatcttcttcaaccatccattgggcttcatctgatgttaaattctcgcaataagctgctggcgtatgatgatgaccttgttctgtcagcgttcgcatcaccattctctcctttaaatctgctttcttaccaataaaactcccttgctgtccatcagcaaaaaggactttgagtcgaagtaaactagccccagaaaatccttgctcataaggctccattttttgtacttgggcactgacaatatttcctctattcaaaatgtgagataactcatttgcttcttctgtcaatagttgaatatcattatccattatcatctagcccttttctatacaaacttattattagtatactataaaaatgtaaaatagcggggccacgtcgtattctttagacagctgggtgacggattgaccagaatgatagaaggcgataagggtttctttaaattcttttgagtagcgtttttgcatgtttttgtcctttgtctaaattatacaatagtgactctaagatttaaggataacatcatcctaactaaagatggagtgttatggaattctacattggaagaattagaaacaataaaaaataataaagtggatatgtttggagttaacttttaccatcccaatcgtgcgcaacgtccgcattattcgccagatagtttgactgttgattggttaccgaataaatattttgatgattataaaatggtgggagcgcgaatgaatgtagataaaggttgggaaatttatccgcaaacactatacaatattgctaaaaatatccaaaaaaattatggaaatataccttggtttgtgtctgaatgtgggataggagttagtaatgaggaccgttatttaaatcgtgacggtctgattgaagatgattataggattcaatttgttcaggagcatctctattggttgcataaggtaatagacgagggcgcaaactgctatggttttcatctatggacacctattgattgtttcagttggcgtaattcttatcgaaatcgttatggcttgatatcggttaatattcatactcagaaaaagtgtttgaaaaaatcggcatatttctttaaaaatttagcagaaaaatcgatattagagctttctgaggaaatctataataaatttaattaaacatttcttttttacggcaaatagtgctataattcgagtaataaatagaagattttgaaaggagaattacttgaataaatatgccaaaattcgaaatgatgtaagaaataaaatcatttcaggaaaatataaacctggaactttgctccctaaagaatcggaaatgatcttgaaatacaatgcttcaaaactaacggtaaaaaaagcaatggatgaacttgttaatgagggattgatcatcaaaaggagagggagcggaacttttgttaaagggctgagcacagaggatattaaaaaattaaaagtagtcaaccaatttcaaggttccagtgctttttttgcagataaggttgttgaaagtcgggttttggtatttgaagtggtaaaatctgaacccgaaattatggaaagactgggattaagtgagataagtgatttatatcatgtcgttcggacccgtttgattgatggagacccttatgtcattgagagtacttatatgccagtcgatttaattaaaaatttaacttttgaaatttgttctggttcgatttatgaatatattgaagatgaacttggtttgactattgggagcgctcatcgcagaattgaagcacgaaaaggaactgacgaaggattagtagaattgggtggaaaatctggggacccagttgttctagtatcacaagttggatatttgtctgatggcaggacttttgaggcttccatgaatgttcatcgctacgataaatatgcgtttgaaacagtattaatgcataaaaattgaaaaattatttttatataatttataatttgtcctcgaaaaagttaagacttgcattttatgagatttatagatataatagacaagttataactttcgtacagataacataaattatgttgaattatacagaggcgaaattattattctagaataataatttcgtctctttttgtttagttttaggagattttattgcatgaataaaaacaaccatttccacttattaggggcagtgattgctacaggtattttgtcgttttctggtgttctgattgaaaccgcgatgaatgtgactttcccaacgctcattcatgagtttggactttctacatcaaaaatacaatgggtaacgacgatttatcttcttgtgattgcgattacgattcctctctcttcttattttaatgagcgcttttcggcaagaaagcttttcttgattgccaaccttttctttttagttggagtcttaaccaactgtttctcagcgaattttgctatgcttttgtttggccgccttttacaagggattgggacagggattggtttacctctgatgttccatcttatattaactaaggcacctcttcataaaagaggaatgatgatgggaattggaactctaacaacctctattgcgccagctattggcccaacttatgggggaattattgctcatgcgcttgattggcgctatatctacatctttttacttcctttagttatcatttccttatttcttggtttagctgcccttccaagagaaattgcaaaaacaccaaaaaaattggcctttcgtcaagttattgccttgtcaattatgttctttgcctttatttcggctttgagtgcagaacatttgcttactttcgcacttttgttcgtcatcgaaatgattggagcagtcatgtttgttcgtttcaatcgtaaagaaacgttaattgatttgggaatcatgaaaaatcgtcgcttcgtagccttaatttttagtcttttagtttatcaagctttattattaggtttatcatttattttgccaagttttcttcaagtatcagcaggatttagttcatctgttgccggaatatttatgtttcctggagctttgataggggctgttttggctccgatttctggtaaaatcttagaccaaattggggcaagaaagccgattacgacaggtttagttttagcggctttggggctcgttttgctttttgtatttttaccgaccaagagtctcgctctccttttgattgcgcacattgttttgatgttaggtttgggaatttcttatagtaatttgatgacttgcagtttgggtaccttgtcaacggaggagctttctgatggaaatgctttggtcaatactttacaacaatttatcggagcggtcgcaacagcagtagttgcaacaaccctttcactcttccaaggtcttaatggtttcaaaactggaacaagccaaggaacttcaattattttagctttatttttcatcttaattattgtcagtttgattgtaagtttcccaaatttgaaaaaaataaacgcaaatcattaaaaaaatctttgacgaatgacacttttttcgttataatattttaaaacctttaactaagtccagagaggcttgcaaggatacggaaaatttatcttggattactgacaaactaaggatgaacttcttttttagcgtatttgtctgtcagtaaatgaccaattttttagtacacttgtaagttctcttacaagtgtgtttttttattatataatttatagcattttatcggtaaataaaagaatggagaaataatgtcccaattacaagagatgatgactgttgtcagccaacgtgaggtcgcctacaatatttttgagatggtgcttaaaggaacgttagtagatgaaatggatttgcccggacaatttctccatctggctgtttctaatggagccatgttattacgtcgaccaatttcaatttcgagttgggataaaagggcaaaaacttgtacgattctttatcggattggagatgaaacgactggaacctatgaactttcaaaattggaacctggtgcaaaagtggatatcatgggtcctttgggaaatggttttcccgtagcggaggtgacttcgactgataaaattttgattatcggtggtggaattggggttccccctctttatgaactggcaaaacaactagagaaaaccggttgtcaaatgaccatattacttggatttgcttccgagaatgtcaaaattttagaaaatgaattttttaatttgaaaaatgtgacactgaaaattgctaccgatgatggctcttatggtacaaaaggacatgtgggtatgttaatgaatgaaattgatttcgaggcggatgccctttatacttgtggtgcgccagccatgcttaaagcagttgccaaaaaatatgaccaactagagcgcctttatatttcaatggaaagtcgaatggcttgtgggattggcgcctgttatgcctgcgtcgaacatgataaagaagatgaaagccatgccctcaaggtctgcgaagatggaccggtctttttagggaaacagctttcattgtaattgaaatgttctatcaataggatatcagcaattaaacgaactgacagagaatctgccagctctgtcagtaaaatgcgaccgaatagggagtattttagttgcggataaaagaattgttagtgcaactgatgattctgtcagtaaaatgcaattaatatgagcattttatcggtggataaaagaattgtcagcacagttgatgattctcatattaaattaggagagaaataatgactgaaaacaatcgtctgtcagtaaaattacctggacttgactttaaaaatccaattatcccagcatcaggttgttttggttttggcgaagaatatgcgaaatattatgatttgaacaaattgggttcaatcatggttaaggcgacgactcttcatcctcgttttggaaatccaacaccacgtgtggctgaaacagcgagtggcatgcttaatgccattgggctgcaaaatccgggattagaagtcataatgtcagaaaaacttccttggctcaacgaaaattttccagagttaccaattattgccaatgtagcaggttctgaagaagctgattatgtggctgtatgtgccaaaattggtgatgcagcaaatgttaaagccatcgaattaaatatttcatgtccaaatgtcaagcatggtgggcaagcctttggaattgacccagaagttgcggcggatctagttaaagcttgtaaagcggtaagtaaggtgcctttgtatgtgaaactttcacctaatgtgactgatattgttccgattgcaaaagcagtagaggcagcgggtgctgatggtctaaccatgattaatacactcatgggcgtacgttttgatttgaaaactcgtcagccgattttagccaatatcacaggaggcttatcagggccagccatcaaaccagttgcactcaaacttattcatcaagtggagcaggtcgttgatattccaatcattggaatgggcggtgtggccaacgctcaagatgttttagaaatgtatatggctggagcgtcagctgttgcggtgggtactgcgaattttgctgacccatttgtttgtcccaaaattattgataaattaccagagcttatggaccagtacgggattgaaagtttagaaagcttgattcaagaagtaaaagaaggcagaaaataattctctacggacctgatgattctatcaagcgtcatcgattaaaaattgagcattttatcattaaataaaagaaccgtcagtaaatctggcagttctgtcaataaatattaagaaaagaaagaagaaaaaatgcaagaaaatagacctgttattgccctagatttcccagaattctcagatgtgaaagatttccttgaaaaatttgacccgtctgaaaaactctacatcaaacttggtatggaacttttttataccgccggcccacaagtagtatattatgtgaaatcgctcggtcatagcgttttccttgatttaaaacttcatgatattccaaatacagttgaatcatccatgcgtgttttagcccgtttgggagttgatatggtcaatgttcacgctgctggcggggttgagatgatggttgcagctaaacgcggtttagaagcagggactccaactggacgtcaaagaccaaaactaattgccgttacgcaattaacctcgacttctgaggaaattatgcaaaatgaccaaaaaattatgaccagtcttgaagaatctgtcattaactacgcacaaaaaacagcccaagccggacttgatggtgtcgtttgctccgctcatgaagttgaaaaaattaaagcggcaacatcaaaagaattcatttgtttaacaccgggaattcgtccagaaggagcaagtaaaggcgaccaaaaacgagtaatgacaccaaaagaagcaagaacaattggttcagattacattgttgttggtcgaccaattacacaagcaaaagaccctgtttcagcttatcatgcgataaaggaagaatggaatcaataatatgaaaagaatttcgcattttttcattgttttaattggaatttgtactgcacttgtccttggatatatcttcacggtcatttatactgaggttgaaaatgcgctattagtccatgatagtaaaacaattacactttataaagttttaacagaaatcaattttagttcaattgcagtcgcttttggtatggcttttgcttatatgctcttgttagatttgctgacggtacttgcgatccattcttggcatcgagttcaaaacaagaaaaaatcgaaataccagtcaaaaattgctcatttttggtttcgttatcggacgatacatcttacctttattttactttcagtcttcattaccttatcgcttactgcaccagcaatgattatgaatagctttacggccattgtttcaatctcagtgcttattagcaacttgaccaaaaaaatcggcaatgattagccgattttttattttattggacttttagcaggagtgcctgctttacgtggatatttctttggtgtttcttttttcttttcaatgacggcaatgtggcgttcatcgccattaggcaattcataagcgatttccttgatgaattttccacccagaattgcaatggcttttttagcatctgttaattcttcttcaaattgagctgcttttaatgacaataaattaccatttttcttgagaaaaggaattgtaaattctgataggacggagagtctagcaactgcacgggcagtcacaaaatcaaacgttgcgcgataattagaatcttgtccaaaatcttcagctcgtccgtgaagcaaggtaacattttcaaggcctaattcctctgtaagtagactcaaaaaattaattcgtttgtttaaagagtcaatgattgttacctctagttcaggaaaaataatcttcattggtaagctaggaaaaccagctccagccccaatatctaaaatgctgacgggctggtcagtaattaatccatacaaaattggcgcaaccgagtcataaaaatgttttaaatagacttcgtttttttcggtaattgctgtcagattaattttttcattccattcaaccaaaagttcaaagtagcgttcaaactgtttgatttgtttatcagagagttgaatatcaaattctgtcagtgctgacaaaaattcatcaggggtcataaagttcgctccaaaagttttctagtaatttcagcaatcagctcacgatttttaccttttggtaatttatcaattaaatttaatgctgaaagggtgtaagatttcgcaagtgctttggttttttcaagggcatcagaagttttgataaaatcataaacttcatcgaatttttcatttttaattaagtcagaaactaaagcattattttcctgcaaagcaaagaggacaggagccgaatagatgccttgtttgatgtcttcaaggactggtttaccaagggtttgagccgttgaagcatagtccaaataatcgtccatgatttggaaagaaattccaatattcatcccgattttgtaggctcgttttgtcagagcattattattggaaatcaaaggagcaacagaagcagatagtgcaaaaagttctcccgtttttcctgaaatgttttcaatataatcatccaaagtttgttgaagattaaaatgatgattaagttgacccaattcgccacctaacaaacgctcaattgacccaatgtttttagttaaatttgacaattctaatgagtgttcagacattaaacgaatgacagcaataaagagatagtctccggcataaacagcaatttcaggcccatattttgctgacaaggtggcaactccacgtcgggtatcagcatgatcaatcacatcatcatgtactaaagttgccgtgtgcatcatttcgacagaagcagcaagagccaatcgctcgctctccgaaaggtcagtgaatcctgaaaatagaagcagataagcagggcgtaacattttcccacctgcgtcaaaaatatcaaaaatagccgatttgacatcagaatttttgatggtaacatggcttttcattaattgatgcacttgagctaattccttctcaagtgctggatagtctttccaaaagttattttttaagtccattgtttactctctttgataaatagttcctgtatgggtttaacccgtgaaattaattgattctcggcaataccaatcgcaaaaccagctagtattccaaaaaaggcaagccatggcaaatatagcatgacagaagttgttttcgctaaaagtgaagccatagctaactgtccaaaattatggaaaaatccaccaacggttgaaataccaatcagtgagactagctttggtccaaattgcttcattaagtacatggctaataaagataaaataccgccagcaaaagaatagagaaagacagaaaatccagtaaaaagtgctgtaattaaaagacgaagaatttgcatgacccaaacctgttgccatttcaaagtgaagacagcaataatcatgactaaattggccaatcctaccttagctccaggagcaaaagcaaaaaaaggcggcagtgtgctttcaataattcccatgactactgcagcagcagttaataaggaaacataaacgtattctttgatattcataccttataatctacctgttcgtctttttgaccactcatcacttcaatcactaaattgtgaggtaaacaaacgattgtttcccctgttttagaaataaagcctcgttggacatcaatttggtctttacaattcgcttcaacaacagcaatttcgccgtttttcacctctattttgttatagtcgccatctttatcacggtaagtccaagtttgattttttttcaaatcaaatgtttttatgactttcccgctaatccgaagctcggctttggctccagtagaaccagtagcaaaaaggaatattgttgaaaaggaagcaagaaataacacgaaaatgataacaaaatcaagcggtttcgtttttattgtttttaaaaaaattatcgtgtttttaaagaagttcattaagattaattatagcagaattaatgaaaaaattcacgaaatcaaaaagaaaaagccaataggctctttcttatttttttgtattttgttttggttcatctttagaaagttctttagctttttcgatgatataatttctcaaattgtcaccgatttgtgggtgttctaaaccatactcgattgttgtttccacaaaaccaagtttatcaccaacatcataacgttttccagtaaattcatgagcaaagacacgttgtgttttattcaaacgttcaatcgcatcagttaattgaatttcatttccagcaccaggtacttgtgtttctaaaacatcaaaaatttctggagtcaagaggtaacgaccgataattgcaaggtctgaaggagcttcctcaacttttggtttttcaacaaaacgttcaacattgtaaagacctttagaaacttcaccatttgggtcgattactccgtatttgtcaacatcttcatgaggcactttcattacagcgattgttgaagcatgagttttttcataatcattaatcaagtctttagtcaaaggagtttcattgcctgtgatattcatcaaatcatcaccaagcataactacaaaaggttcgttgctaacaaaagctttggcttgaagaacagcgtgtcccaaaccttttggatgagattggcggataaaatgaagattgatatctgttgtttcttctacaagtttaagtaattctgtttttcctttttcaagcaaattttgttcaagctcaatatttgagtcaaaatggtcttcaattggacgttttgctttaccagttacaatcaaaatgtcttcgattccagatttcaaagcttcttcaacgatgaattggatagtaggtttatcaacaattggcaacatttctttggcaatggctttagttgctggtaaaaagcgagttccaagaccagcagcaggaataacagctttacgaacttttctggctttgttaggtatagtagtttgtttcatgataaataactcctttatttaattagtaaaatcgaatttttttatttattaatattaatgaattcattttcagcacgagtttcgcggcgcatgatatcaagaattccagattttgcatcaagattttcataaagaactttgtaaattgtttcagtgataggcatgtcaatttcaagtcgttgagcaagctcataagctgctttagtcgttgaaactccttcaataaccattcccatattcttttcgatatctgctattttttcaccgcgaccaagagcatcacctgccctccaatttcgtgaatgaatggacgtccctgttacaataaggtcgccgactccggaaagaccactgtaagttaaaggttcagctcccatggcaacgcctaatcgagtaatctcagcaagaccacgagtaataattgctgctttagcattgtcaccaaaaccaagaccgtgtaatgcccctgctccaaccgcgataatgtttttaagagcaccagctgtctcaactccaatcacatcagtattagtataaagacggaaatagtcattactaaaaatggattgagcatattttgcttcatcatgatcgttagaagctgcagaaatcaaagtgatgtcacgaacaatcgtttcctcagcatgagaaggaccagaaacgacaacgatttcaccgcgaagttgagctggaatttcttcttcaagaattgtcgaaattcggtcatgtgtcccttgttcaagcccttttgaagcatgtaggatatgaactttatgtttaaggacttgggcaacttgttttgcaaccaatcgtgtaactttcgttggcacaacaaatagaatggcatcaacattttccaaagctaaatctaaacgactatatgcctttattttttcatctaagacaacatctttaaagtagcgtgtgttcgtatgtttttcattaatctcggccatttgttccaggttgtttccccagatacgaacttcatgaccattatcattaagaacttgtgaaagagcagttccccatgagcctggacctaaaactgcaattttttgtggattcatagaaatgatcctttctttcgtttggtttcctttacattttaacataagtaagaataaaaatcagccctaagtatgatttagggtttaaatattatgataaaatagagatatatccgaaaggttattcttaaaattgaaatttaaaaattagaaacttgtgaaaacaggacacaagcgggaggaaaaaatatgccagtcagtttatttatgaatcatcatgggatgatgtttggttatggtcatctaggaatcgtgaatgtgatttttggtttagttctctttttcttaataataaaaatgattataggtatcagttttatgcgcaaaaattcgactgaaaaagaagaaaggtatcaggacaaaggaatgagtaaaaaagaaaatattgaacgttaccacgaagcaggactttctgatacagacatcaaaatatttcgtgaaaatttatctgaagccaaagaaaacatcaaaacttgggaaaaattgttgaaaaaagaagatgacttacaagttgttgaatcagtaacaggtggcttagacgctagtaagcatactttcaaatatattgttcaaaatccacaagaacttactaaacaaaatgagtttctttataaagacttgccaaatatggtcaaattgtcagagaaatttatcgagatgaagaaacaatcagtaagaaccgaagatattaatcgtgatttagatgagactctattattgataaaaacattgtctaattcgatttctaaaaattaccacgaaatactgatggatgatgtgaatgtcattaaacatcaagttgattttgacaaataaatttactgacaagattaaatgatttttgtcagtaaaaactgacgattctgtcaataaaagtcgaatattcctgtcaattttggcaggaatcatttataatataaagtaagtaatcgaagactagtaaaggaaaataaagatatggacaacccaattttagatgatttgatgacgaatgataaagtcatcaaagaagcagaccaattagatgagcaacaaaaatcagaaattgtaaaaatgcatcaaaatgcctcattggcagctgtagaagtcctttctactgacgaattagaaaaagcaaaagaattatctaaacaattggatgaatcaagtgcccaatctgtcattaattatggagcgagtgctcaagataaaatttcagcattttcacaaagtgtcttaaataaagttcaagcccaagatttaggtgaagtcggctcatcactaacagacttgatgttcaatttgcaacaagctaatcccaacgaattggttgctgaaaacaaatggatttttaccaaaatgtttggtaaagttaaacgctcgatttttgaagtgactcaaaaatatcaaaaaatcggagctggaattgacaaaatttcggccaaattaaataatgaacaacaagggcttttgcaagataatgaaatgcttgacaaactctatgatgaaaacctgaattatttcaaagccttaaatgtttatattgcaggggccgaattaaaagttcaagaattggacaatgaaatattacctcaagcacgcaaggaagcgcaagaatctactgacaatgccttaattgttcaaaaagtgaatgatttagaatcatataaaaatcgtttagaaaaacgagcccatgatttacggcttgctcgtcagctgaccatccaacaagccccacaaatccgtttgattcaaaataccaaccaagaattggctgaaaaaattcaaacttccataaatactgcgattcctctttggaagaaccaagtggcgattgctttgactttgttgaaacaaaaagatgcattgactagccaacggattgtttctgaaacaaccaatgatttgttgcgtaagaattcagaaatgcttaaagcttcaacaattgaagccgcaacagaaaatgaacgtggcttagttgatattgaaacgttgaaattaactcaacaaaacctagtggatactatccaagaaaccatgcgtattcaagccgaaggacgtcaaaaacgtcaacaaggtgaagttgaactttctaagatggaagaagaaattaaagaaaaattgttacaattatcaaataataaacaattaaattaaattttaaaattactgacagaaattgaccagcattcttatccgccaacgtgtgatagataagctctgacgaagctgtcagtaatttttttattctgataattggtatatactgtttattgacaaaaaagataaagggtgctaaaattaaagaaaaagaagaggagatatttatgacttactatattaaagcagatcaatttttctacgcttatgaaacaaaaaaaggtggtttcttagaaattactgatggaaaatttggagagtggacagaagaagcaccagcaggagctgaaatcttagattattcaggacaatctattgccccaggattagttgaaacacatattcatggtttcggtggtgcagatgcccaagatgctgaagtagaaggaatcatggggacaatgtcagaaggattattgtcagcaggagttacttcatttttgccaagtcctttaacagatgaccatgaaggcttgaaagcggtctgtacagttgtaggagaacactaccaagaagcacgcggagctaaagtacgtggtattttctttgaaggtcctttctttacagaagaaaagaaaggggctcaaaatcctaaatacatgcgtgatgctaaaatgtgggagcttgaagattggcaagaagctgcacatggaatgcttaagaaaattggtcttgcaccagaacgcgaaggttcagaagactttattcgtaaagcgactgaatcaggggttgtcattgccttaggtcattcaaacgcgacatacaagcaagcagttgccggtgttcaagctggagcatctgtatgggttcacacattcaatgggatgtcaggaatgactcaccaagaaccagggatggttggagcaattttaaatactccaaatacttacgctgaattaatttgtgatggtcaccatgttcgtccagaagccgctgaaattgttgtgaaaatgagaggcgctgaccatgttgttttgattacagactcaatgcgtgccgcaggacttcctgatggtccttatatgcttggagaatacgaagtagaagtgcgcgatggcgctgcttggcttccaacaggtcgcccagccgcttcaattttaacacttaaaacagccgttaaaaatgtgattgactgggggattgctacaccagcagaagcagttatgatggcttcgttaacgccagcaaaatcagtaaatattgatgatgtttgtggacaaatcaaaccaggacttgcagccgatttcatcgtattagacaatgaatatgatttagttgcgacttatcttgatggtgaaaaacgttacgaagcttaatcttgaaaatgaatttcgaaaggaattcattttttttatgaaaataatttcaattttcaaaatgaataattagaaaaataaacaaaaaagtaaaagattctttacttttttgttaaaatataaaagaatagaatggctaatattgtgtcatattatagaagaataagaagcaaatgaagtctaaaaaaattatttgaaaatgctagaaaacccttgcaaaataaggcttagaaaaaaagaaataatgaaaacgtttcatacagtttgtaaagagatttttttataaatacgtgatataatgaactagacaacaaatgaacatggtaaaaatattaataacgtttacgtatttttgctgtgtatctcaatttcggaggacagatttaaatgaaacgcattgcagttttgacttctggtggtgatgccccagggatgaatgcggctattcgtgcagttgttcgcaaagcaatttctgaaggtatcgaagtttacggtatcaatcacggatatgcgggcatggttgcgggagacattttcccgcttacgtcagcttcagttggtgataaaatcggtcgtggtggtacattcttgtactcagcacgttacccagaatttgctcaagtagaaggacaacttgctgggattgagcaacttaaaaaattcggtatcgaaggtgtcgttgtaatcggtggtgacggatcttaccatggagctatgcgtcttacagaacatggtttcccagctgttggacttccaggcacaatcgataacgatatcgtaggaactgattttacaattggttttgatacagctgtttcgacagtcgtagatgccttggataaaatccgtgatacttcatcatcacataaccgtactttcgttgtagaagtaatgggacgtaatgctggagatatcgctttgaatgctggtatcgctgctggtgcagatgatatttgtattccagaaaaagaatttaagtttgaaaacgtagttaacaacattaacaaaggctacgaaaaaggtaaaaatcaccacatcatcgttcttgctgaaggcgttatgactggtgaagaatttgctacaaaacttaaagaagctggttataaaggagaccttcgtgtttctgttcttggacacatccaacgtggtggttcaccaacagctcgtgaccgtgttcttgcttcacgtatgggagctcgtgccgttgaattgcttcgtgatggaatcggtggcgtagccgttggtatccgtaatgaagaaattgtagaaagtccaattctcggaactgctgaagaaggagcactctttagtttgactactgaaggtggcatcaaagtaaacaacccgcataaagcaggtcttgaactttaccgtcttaactcagcactcaacaatcttaaccttaactaagttactgcaaatctgtttctagttaagtgttaaacgcataattagggcagagatatataattaatcattataggagaaaaacacaaaatgaataaacgtgtaaaaatcgtctcaactcttggaccagctgtcgaaattcgtggtggcaaaaaatttggtgaaagcggctattggggagaatctcttgacgtcgaagcatcagcaaaaaacattgcagctttgattgaggaaggcgctaatgtcttccgtttcaacttctcacacggtgaccatcctgaacaaggtgctcgtatggcaactgttcaccgcgctgaagaaatcgctggtcacaaagtaggtttcttgcttgatactaaaggtcctgaaatgcgtacagaactcttcactgacggtgctgattcaatcagcgttgttactggagataaattccgtgttgcaactaaacaaggtcttaaatcaactcctgaattgattgccttgaacgtagctggcggacttgacatctttgatgatgttgaaatcggtcaaactatcttgattgatgatggtaaacttggtttgtcattgactggtaaagatgcagcaactcgtgaattcgaagttgaagcacaaaatgatggtgttatcggtaaacaaaaaggtgttaacattcctaacactaaaattcctttcccagcccttgctgaacgtgacgatgcagatatccgtttcggtctttcacaacctggtggaattaactttatcgctatctcattcgtacgtactgcaaatgacgttaaagaagtacgtcgtatttgtgaagaaactggtaatccacacgtacaactcttggctaaaattgaaaaccaacaagggattgaaaaccttgatgaaatcatcgaagcagctgatggtatcatgattgcacgtggtgacatgggtatcgaagttccatttgaaatggttccagtttaccaaaaattgattatcagcaaagttaacaaagcaggtaaaattgttgtaactgcaacaaacatgcttgaatcaatgacttacaacccacgtgctacacgttcagaaatttcagacgtatttaacgctgttattgacggaactgatgctacaatgctttcaggtgagtctgctaatggtaaatacccacgcgaatcagttcgtacgatggctactgttaacaaaaacgctcaaacaatgttgaaagaatacggacgtcttcacccagaacgttacgataaatcaactgtaacagaagttgttgctgcatcagttaaaaatgctgcagaagctatgaatgttaaattgatcgttgctttgactgaatctggtaacacagctcgtttgatttctaaacaccgtccagatgctgatatcttggctatcacatttgacgaaaaagttgaacgtggattgatgatcaactggggtgttatcccaatgatgactgaaaaacctgcatctactgatgacatgtttgaagttgctgaaaaagttgcattggcttctggtttggttgaagctggcgacaatatcatcatcgttgctggtgttccagttggtactggtcgcactaatacaatgcgtatccgcactgttaaataatttgtcaattaatgatcttaaaacaatacagactgccgctatcgacaggccctattgttgaaaagattatattttataaaatgctcgtttataatttgaaaggaattaaagaaaatcatggctgataaacaacgtaagaaagttatccttgttggtgacggtgctgtaggttcatcatacgcttttgcccttgttaaccaaggaattgcacaagaattaggtattgttgacctttttaaagaaaaaactcaaggggatgcagaagacctttctcatgccttggcatttacatcacctaaaaagatttactctgcagactactctgatgcaagcgacgctgacctcgttgtcttgacttctggtgctccacaaaaaccaggtgaaactcgtcttgaccttgttgaaaaaaatcttcgtattactaaagatgttgtaactaaaattgttgcttcaggattcaaaggaatcttcctcgttgctgctaacccagttgacatcttgacatacgcaacttggaaattctctggtttccctaaaaaccgtgttgtaggttcaggtacttcacttgatactgcacgttttcgtcaagcattggctgaaaaagttgacgttgatgctcgttcaatccacgcatacatcatgggtgaacatggtgactcagaatttgctgtttggtcacacgctaacgttgctggtgttaaattggaacaatggttccaagaaaatgactaccttaacgaagcagaaatcgttgaattgtttgaatctgtacgtgatgcagcttactcaatcatcgctaaaaaaggtgcaacattctacggtgtggctgtagcccttgctcgtattactaaagcaattcttgatgatgaacatgcagtacttcctgtatcagtattccaagatggacaatatggcgtaagcgactgctaccttggtcaaccagctgtagttggtgctgaaggtgttgttaacccaattcacattccattgaacgatgctgaaatgcaaaaaatggaagcttctggagctcaattgaaagctatcatcgatgaggcttttgctaaagaagaatttgcttctgcagttaaaaactaaaaataaaaaagagttagtagaaattttcaactaactctttttttatatttaaaagtttgctttaaactataataaaaaagtctgttcatcgacagacttttttatttttataaatttatttcgatttgatatagtttaccccgtcagctttaggcgcaattgcttttccaaggaagagtgccaagacaataattgtaaagacataaggtgccatttgtaggaatgaagaaggaatttctttgattcctgggatttgaccaccgacaacggccagtgaagtaaagagtccaaagagaagtgatgatagcattgctccaattggattccatttaccaaaaatcatggctgcaagcgaaatgaaaccttgtcctgcaatagttgaaactgagaagttaccagaaattgcttgagcatagattgctccaccaactcctccgagaacaccagagagaagtacccctgcccaacgataggcataaacgttaatcccaagggtgtcagctgcttgaggattttcaccaacagaacgaaggcgaagaccaaagcgagttttaaataggacgtaccaagcgagaattgcaacaactattgcaaggaaacctgggagtgaagtttgagtaaagaagattttaccaatgacaggaatattagaaagtaaaggaacattccaataaccaatttgttcattgatattaatttgaccttgttggtagaaaacttgaagtaggaatactccaagtgctggagccatcaagttaagtacggtcccagatacgatatggtctgctcttaggttgacggtagcaaccgcgtgtagagaagagaagagcgcaccgattaaagctccaaagaggattgagagccaaggagtcatgcttccaaacatcccggcagtagttaagttgaagacaacggaactaaaggccccgatagtcattattccttcgagactgacattgacgattccgcctcgttcggagaagacaccaccaatacttgtaaagattagaggtgttgaatagatgagcatattagcgacaataatctgtaaagtgtttacgacgttcatgctttttctcctttcttcttagtgacttctgaagctttgattgctttagcttttggtagcatgacttcgataatgaatttcactgcgatgaagaatataattgcagcagtgacaactttaacgatttctggtggaataccatcgtttgtcataccaggtgcacctgtttgaagaacagagaaaagaagagcggcaaagagaataccgataggactattaccgccaagaagggcgacagccatcccattaaatccgatatcaagggatgccgattgagagacaaagttttgcatatacccaaacccataaacaacaccaccaagtccagcgagggctccggcgacaaccatagataagataagagtacgttttgctgagataccagcatattctgaagcgtcaggatttaaaccaactgctttaatttcaaatccaagagttgtcttagtgaagataatggccataatcgcaagggcaattaatgcaatgattagtccgatattcaaggttgaattatctgttaatgaggacatccaattggttctaaaagaagcatttgcactaattaattttgtttggtcagttgtattgtccatcaaaatgtttttttggaacatactgtgtatcataaatgttgagaagaacaacataatatagttcagcataattgttgtgataacttctgaagttccaagtagagctcgaagaataccgggtatgaatcccataaatgctccaaagaccattccgataattacaactaaaggaatcatcagtaagcgggggatatctgggaaacttaaagcaaaccacatggaactaatccaaccagctaatgcttgacctgacatcccgatattgaagaggccgactttcatggcaactgcaaaggataaagcagtcaaaatcaaaggtcccatagtttgtagggtttcaccaatggatcttgcacttcctaaagcagaaataaaaaggtcttcgtaaccccaaatcgggttatagccaaaggctagcatgataatcgcacctaacaggaaaccaaaaacaatggcaatgagaggaacgaggacttttcttgttttattattcattaatgttacctccaaccattaaaataccgagttcttgttttgtggttgtttcagggcttacaattccctgaatttgaccatcgtgaattacagcgattcggtcagagacattaagaatttcatcaagttcaaaagaaataacaaggactgcttttccttcatcacgagcttggattaaacgtttatgaatatattcaatcgctccaacgtcaagaccacgtgtgggttgggaaacgataagtaagtcagggttacggtcaatttcacgagcaataattgctttttgctgattaccaccagaaagagatgaggcagaaacccattcaccagctccacggacgtcaaattcttccataagttcacgagcatgactgttgattttattgtaatctagaaaaccatatttgctcattggtggtttgtagtaggtttgcaaggcaatattttcagcgactgtcatttccaaaacgagtccgtcacgatgtctgtcctctggaacgtgtccaactgattgctcagttatttttcgagggcgttgattagtaatgtccttattgtgaagtttgatagaacctgaatccacttttgttaaaccagtgattgcttttactaattctgtctctccattaccatcaattccggctactcctacgatttcaccggcacggacatctaaagagaggcctttaactttaagggagccacgactctctttgatattaaggtctttaatttctaagacgacatctttaggttgggcagcagctttttcagtaatgaatgagacagagcgtccgaccatgagttctgcaagctcttgattggttttgtcgccaagctcaacggtatcaatagattttccgcgtcgaattacagtgatacggtcagctacggcacgaatttcatccaacttatgggtgatgagaatgattgacttaccttctttaatcaagtttttcatgatttgcatcaattctgtaatttcagcaggagtcaaaacggcagttggttcatcaaaaattaagatatctgccccgcgataaagtgtttttaaaatctcaacacgttgctgttgaccgacggaaatatcacggataagtgcatctggttcaacagaaagtccataacgctcagaaagttcaagaatttttttcttcgctgtctttaaatcgagattgattcctttggttacttcattaccaaggatgatattttcagtaactgtgaaggcgtcaactaacatgaagtgttggtgaaccattccgataccgaggtttgctgctttagagggggaatcgatgttttcgagctttcccttgacgtggacttcgccttcgctaggctcgaggagtcctgagaggatgttcatcaaggttgacttaccggctccattttcgccgagcaatgcatgaatctcacctttcttcaactcaagattgaccttgtcgtttgcgacaaaatcaccaaaacgtttggtgacatcaatcatttgaatgacagtttcatttgccatagtggctccttcttataaaatattataataataatgtaaattgtaaaaattacaaatttaattataccaaatttgtctaagatatgaaagccccgtcatagcaataaacgcgtggcttttccttaaaaatgcattttgaaaaagattactaaaaagttgattatttttcgattaaaaaaagttatttttgtcgctttaatacatcaatttcaatactgattgttacttctaaagcttcaaactttttgagattttcaattccctctggtttgattttccaataatgaggggtcatcagtagtaagcttaataaatcttctgtggattggattgtcacttgataagaataattttcttgctcaactaaaaagccagggaaagttttaatagaagaggctttaactttttcatgaatttcaggatagataatattttttaattcaatgaggtggtcgctagcggctctgacgatgataatatttccttcgtcagtcagaattcggtcaatttctgggacagaatattctgcgaacatggataaaatagtactgacggacttgtcagtaaaagggagattggcaaaattggctactaaccattgaatcgttgtgttttttttagcagccatccgaatcccgagcttagaaatatccattccataaagcttagtggattctggtgccatttctttttggaaacgtgaaagatagtaaccttccccacaaccaatgtcgacaatggtttggttggttgaagataaattgtttaagcgttgattgactcggtcggatagtttttcataataaccttttgcgagaaaatcacgtctggctgccatcatttcttttgagtcgccagaagtttttttggcatttaaaagaaggttaagatagccttctttagccaaatcaaaagtatgattattctcacatttaaaagtatttccttcttttgaaagtaaatgattgcaaacaggacattttataatttcagacatggattctccaaatttttaaaattaattttcgtcagtaaactttacttactgatcttacgtgatttaatgacagcttcatcaggagtgacacgaatcgttttttcacgatcataggtcacaaatcctggagctgttccggtcggtttgtgtaattttttgacatccaaaacgtctacttgaacaagatttgaataacgggccttgctgaaataggcggctaattctccggcgaaagtaattgtttcatcagatggatttgaatttccagtaatcaaaacatgacttcctggaatatccttaacgtgaaaccaaagatcgcctcgacgagaaagtttgaaactgacttgttcattttgtaaattattttttccaaccaaaataattgttccatcttcagcttgatatttttctggcggcagcattttttgtttcttattgcgatatttttgtttgatatagccagtttgaattaattcttcacgaatatcagcaatttcaggaacatcagcattttcaagattggactcaacggactctaaataatggattgtttctttagttttggcgatttgttctcccaaaaatttgacagcttgtttcaatttttgataacggtggaaatagcgttgagcattttgagcggggcttagtgcggggtttaaagcgatgtctaagggttcgtttgtatagtaattttctaaggtcacacttgttttatcgtttggtacttgatttaagaaagtgttaagtaactcacctttttgacggaaaatttcagcattgtcagtagccaataattctcgttcttgtttctttaatttatcacgatttttcttcaattcattttggatttttttaatgacagaagcagcaacttgtttgacacggtcacgttcagctttgtcagcataataaacatccagcatttcagataagctatcgaagcttacaaaatcatcagtaagttgaatactagaaaaattatcagtaggataaattgatggcttaactgtcagtaatttttctttgaattcttttactgacagaccagtcaatgcgattttagaatcgcgcccaatcccttggaatttttgttgtaattgttcagtttgtaacgcatcaaaaatttcttcatcagttgctttaaaggggtcagtagcattagaagcaggtggtgcgatataggttgagccaggcaaaatcgtccgatattgattttgcgaaaagccaatatgtttgattgattcaatgattttttgtgaggttttttcaagcaaaataatattgctgtgtttccccataatttcagcgattaaagcaatttttaggctgtcaccaatctcatctttagtagaaatgtgaaaaataatttggcggtcattttcaacttgttcgattttttcaaggaaagcccccgctaaatatttccgtaaaatcatcacaaagttattggggttttgaggattttgaaaatcagttttcgtcagttggacccgtccaaatacagggtgagctgaaagtagaagtttatgagatttaccagctgaccgaattgttaaaataagttcttggtcaaaaggttgattaattttttgaatacgtccaccaacaagcggttgcaattcagccgtcatgtggtgtaaaaaaataccatcaaaggacattatgtgcctctttcgttttatagattataaaaacagctttcactgtttatttaggagccttttatttttcaatttgctgacaaaggcctgtcagtaaaatatgagaaaattaataactatttctaagccaattttaccaaaaaaacgttaatttttcttgtatttttcaagtaattgtttatgatttcataaaaagctaagaatgcagcttgattagcatatcgacttttatcaataaaaaatgttaaaatgaaaagaggattaaactcaggaaagttattaaattagaaatataggatgttaaatgaataaaatagttagtatatttcagcggattttgcgaattgtcatgtttattgttgcagtggcaatgcttttcggggctctgtttttacttggtatccatcagacaaataaaagtttagaaaaaacagctgtttctggaaaaattatttatggtacagatgtgaaagcaattcatgaagtatcctataaatacgacggaaaagaatatcaaaaacgtcccttggatgtttattttagaagattaggtgatgaaggcgataaaattacagtttatgttgctcaggatcatccgacacgaattttcatttcaaggacagggcgaccactaatcgattctgcaggattaattggaggttggagtctggttttactcttgattttatttggagaacatcaacttttgcgaagaatgaaaatactggaagaaaatgcaaataaataaactacaaaatcatttttagttctgaataaaaatacaaccctaataaaaatattgataaaaagagaaatcgctaacattggcgatttttttttgttgttaaaaactagtggttgaaagctgtgaaaagctaaacaaagggtatttatggactttcttattttgacacaagtgcttgctaaagtcagcaatggtcaagcaaaaactagagtatttttatgtttttttattaagaaatggtgtataaagaatgtatacaataaattactttatggaagctgtcaaacaatttcttgtgtctgatcatcataagatattgccaacatgatttaggaggattggaaaaaatggaaatgcagaaaaaaaaggcaccacgtaaaaaaggtaaagtaataaccaagcgtaaagtactgtcagcgaccatgtctgggacgttattgatgacttcggtaattatcccaacagcttatagcttgttatcaaatcagatcactgcaaaagctgctgctttaaatattgatctcttgcaaaatattacttcaagcaataatagtgggacaactacaagcaatcgctgggctagtggttcaggaactcgaaatgttgattttacaattgccggaggtgcattggctaatgtcgcccttctttcagggcctcgttatgctgttttgacaattccgcaagagcttcgtggctatgttgctgctaacgggaatacttcggttacaacgaatatcacgattgactttaataaagttgcactcatcaatgcaattgttagtgctggagatacttttgttgcgggagtagccacaatcttaggcaataatcctttagccagtattaatttaacagaagtgacgactcagcttaatctattaaagggaagtcaaaatattggcggtgggacatttacatcagccacgacccttaatggaaattcagtgctgagtgcgcctttaaatgatgggatgggagcaattttagctcaaaatgtcagaactattctagaaaatttacgaacggcagttagtaatctttctgcaacagggttagcagcacctgccgctaataccgcccttgctttgatcaagcctgcactgataacagccatagataatgttttagttccattagtaaatggaacaggtggaattttagatcttcttttaaatgcttcggcacttgggaatacaagaattaccattcctacaaaaattactgccccaccaagtattcaaagtaacctcgatgcgcgttttgtaggttctgctgttcaaaccaacttattagatgttgatgttctaagtggtgctgatggagcttcttatgtgtatttagctggagatgttaatttaacgctggtcgctccaacaggaaatctaacagcgacaacctcagcagttggtgcaagtaatgcaactgcgacgattccaaccaccttaaaaaataatgcaggtactgatgttccagtcacctcagtcattactaattcctcggggactccagtgaccaacggtcaattatcagcgggtacttacactgtcacctattcagccgcaggctatgcaaatgtaacgcaaactttagtggttactgacccagctgatacgacccctcctgcagctcctattgtgagtggcgtcacaggaaatatcaccaatggctataccgttacaggaactgccgaacctaattcgactattactattaaaaatggttctggtacaacagtcggaacaggaacaacagacggaagtggaaattacacagtgactctcccaggctcagttggtcctaatgcgccattaaatgttacagcgacagatagttcggggaatgttagtacgccaacaccaacgaaaacccccgcagacccagttagtccagtactggtagctccaacaggaaatctaacagcaacgacctcagcagttggtgcaagtaatgcaactgcgacgattccaactacattaaaaaatagtgcaggagccgatgtagcggtcacctcggttattaccaattcctcaggaactgcagtgaccaatggtaacttatcagcgggtacctacaccgtcacttatacggctgcaggatatgaagatgtgacccaaacgctggttgtctctgacccagcagatacaaccgccccagatgctccagtagttggaagtgtcacaggaaatagcaccaatggttacaccgtcacagggactgccgaacctaattcgaccatcacaattaaaaataataatggcgatacggtcggaaccggaacgacagacggcagtggaaattacacagttaccctcccaggctcagttggttctaatgctccactaaatgtcacagcgacagatagttcaggcaatgtcagtgatccaacctcagcgacaacaccagcagatccagttagtccagttttagtagctccaacaggtaatttaactacgaccacttctaaaaaaggtgcagctgacgcaacagctagtctacctgctacacttaaagatagtgatggtaaaactgtaccggttactcatgtaattaccaattcaacaggaacggaagtaccgaatggcaaactgtccgcaggtacttacacagtaatttattcagcagagggatatgcaaatgtaactcaaaccttagtggtcagtgatccaagcaacccaactagtccagttttagtagctccaacaggtaatttaactacgaccacttctaaaaaaggtgcagctgacgcaacagttagtctacctgctacacttaaagatagtgatggtaaaactgtaccggttactcatgtaattaccaattcaacaggaacggaagtaccgaatagcaaactgtccgcaggtacttacacagtaacttattcagcagagggatatgcaaatgtaacccaaaccttagtggtcagtgatccatcgtctaacactgatacgacggctccaaacgctccaactgtagatagtgtaactggggattctggtagtggatatacggtaaatggtaaaggtgaacctggttccactattactgttaaaaatccggcaacaggcgaagttttaggcactgctgtagcgggagtggatggaagttatacacttaaacttcctcttggaattaacccaggaacacaggtttctgttactgcaacagatgcatctggaaataccagcgaaccaacgctctttactacaccgccaacaacaatgaatggagggatgataaatggaaatatgagtacaaatataggtggaaaacatttttcaacagctgatttacctgcaacaggtgaagcaaatgcaggttggttgagtatggttggaactgttcttctctctctatttggagcaatgttcttctactttttattctccataatgaaaaatgtgtgaagggatagatccatttgtcttatagctcaaaagtgctttgtcagcgtcgcgtttttcttttattacacttacatactctggtttagcatcaaaattttgataatcttcattatcaaggattagtattttagaagtcgcgctatattctcctaaaacgatgtaatctttactcttagaagcaattgttttaccactatcatcggtcacagaagtatccgttttagaagtccacaaagcaggttctgctgatagttttttgactttcttaaaactagccttttccccttttttcgtaacatgattaaatgccccttgattcattaatttattagctgcttgtgtgttcaagactaatgtatctgattttgaactgtattttccctctacagttaggcttttctctatattctttttattagtttctaacttagagtccatttcttctttattatcactgtatatgataatcccgtgtacgtgagctatatttttttgaaaatagttatatccgaaaaatccggtgatggcaattggtaccaaaattactagcgctattaatatttttttcatttatatctttcctttagtgatattttttttatagattttctctactttttaattctaacatcagttcttttgattactacttacatttttgtaatataaagcagatataatattttctggttgtttgctctcacttttctacctttcttagactcaaagcgcagcaatggaagaatcattgaaccaataaaaaaatactcacttaagttataagtgagtatttttttcaaaccaaattcatgtaaagaattggatagggctgcccttgttcatcaatagcttctcttttgtaaattttaaatcccatatactcataaaaagctcttgcctggggattttgttcatttactgtaagttctcttactaaataatggctgatcgcttcttcaagtaattttctgcctaatcctttattcatatcgtctggattcagaaatagcatctcaagtttttgctcataaattcccataaaggcgattggttttccttttttgtctgattcaatgataagatgtttaatctcttttagagcttgtggaacatatttttttatttcacttatttcttcagttgataaaaataaatgactgacttcaacagatttttcccaaagtactactaattcttcaattaaggcgggtgttcttcttgattgactgatttcttccattttttctttctattttgtttgaccttttatttttacttaaaatatttttttagaagtgaatcaaagtttctaaatagtgattcagaaaagagagagagaagggcaactagaacaaaactatctaatgaaattttactgatagaaaagagagaattaaaaataaagcctgaaagaataatcccaacaatattaaaaataattatccccattttaaaacgattcagtggagcactaatttttgttaaaatcatgaaacctacaacggctaataaaatgacggccgatgtcgatatttctgatgcggtcaatttaaaggcggctccagcaataacaacccctaagacggccgttatttctgttagactggctggcagtgcttttaggattacatttttaataaagtctttttcaatccgtttatcattttcttctaaagagagtaagaatcctggaatcccaatggtgaataaactaatgagtgaaagttgtgaggcttgtaagggataagtgaagacaaagattgctgagataatcgctaagatgattgaaaagagatttttcacaaggaaaaggatggctgagcgctgaacattattgaccacacgacgcccttcagtgacaacttgggtcatgtgaccaaaatctgaatcgagtaaaaccacttgtgcaacttgggtcgcagcatcacttcctgaagccatagcaatactacaatcagcactcttcattgctaaaatatcgttaacgccatctccggtcatcgcaactgtatgaccttttcgtttgagggcctgtacaagtcggcgcttttgatcaggagtcactcgtccaaaaacagtatagctttctatcgcttggtctaaatcttcctcggtcttcaaaagattagcatcaataaaatgttcagctctcataattcctgctcttttagcaacagcggatacggtctgcggattatcacctgaaatcactttgatattcacaccttgttgtgcaaaataattgaaggtttctctagcattttctcttataggatttgctagaacaacataacctaaagcttgagttcctaaattaagttgttcatagtttttttcttctgttcttgctaagactagaacacgaaatccttcttttaagagatgattaatttcagaactaattttttcataatttttccctaaaacaatttctggtgctcctaaaagataactttcattttcaaaacaaaccgcactatattttacttttgatgagaatggaataatctttttgacgccggttatttgattttgaaggtcaccttttgcaagcataaattctcgaatcgccttcatggtgtcattgtcatcactatttgctgaaatatagttagataaaacgcccataaacttttgttcattcatctcactactaggactgacaaatacttgctcaactgacattcttggttctgtgattgttcctgttttatcgacacataaaacatcaacacgcgccaaggattcaatacttttcatattgtgtaatagcacttgattacgggccaatttcacactactgagggttaaagcgatagtagttaaaaaataaagtccttctggaatcattccgatgacggctgctaccattgccacgacactagtttgtaaggtattgtgattgacaaaataattttgagtaaataagatgaccgcaattggcagaataatgaaactgactcattttaataatttattgagtgctcgaagcatttcggaatcttcgccatgactgaccaactttgcttgctctgttaatttagaaatgtaggaatctttcccaactttttctaaaattactctggcttctcctgacacaacaaaacttcctgacagaagtttgtcatcaacatttttttcaatttcgtcagcttcccctgttaaaagggattcattgacaaagatgcttccctcaacaatacgagcatcagcaacaatttgatttcctgttttaagaataataatatcttcttcaaccaaatcatctgaggcaatcttttcttgtttacgatttcttatcactgtggactgcggcgcgtgtagaagtgtcatttcgtcaagatatctctttgccctaatctcttgataaattccgaccactgtattgatgacaataattggcaagaaaatcagttgattccatgcctgaactaaactgattaagacagctattactgcaaaaattaaattaaaaaatgtaaaggtattgcgttttacaatttcccagaccggacggtctgtttcagctaaatttttatttatttttccttggcgaattcgttcttcgacctcaagactcgttaatccttttaaagacatatttttactctctatttcgtgaatgatttttttaatgattaagtactgtaaaaatactttgttctatcttaacatagttctgagaagtcctgcaaacggtaaaaatattatttttgattgtttaggtttttttctatttaattatggtaaaatatggtcataatctatagaaaagagaatttattatgccatatgtccatgttgaattatttgaaggtcgtacagtagagcaaaaagctgcgattgccaaagagattactgaaacaatctcaaaacatgctggagcacctacttctggaattcatgtcatttttaatgaccttccagaaggaatgctttatcaaggtggggaaatgaaaaaaaagaaataagctttcttttaagtcaataaaagctgtcagtaaatgatggcttttttatatcagctgtcagtaatttttttagtaaataaacttctcttgaaaaaacatttttaataggataaaatgaaagcaactctaaaagaaactggtgaaaaatgaaagttttgattacttctggtggaacaacagaaccaattgatgaggttcgaggcatcagtaattttgcgacaggaagtcttggtaaattagccgccgaaaaatttttacaggccggtcatgaagtctttttattggctggattacaggcagttctcccagaaaatgctgctcttcttactcatattccaattgaaggaaccaaagacctttatcagcaaatggaaaaattagttcctaaaatggatgtggttatccacagtatggctgtcagtgactatcgaccagtatacatgactggacttgaaaatttttctggaagcctctctgtagatgaacttcttgattaccgtcctgagcaggttgggaaaatttcttctaaatctgatcatcaaatcatgctcttagaaaaaacgccaaagattatttcttatatcaaaaaatggaatcctaaagttttactttttggctttaaattgttggtggatgtggaaaattctgaacttcttcatgttgctagagaaaaattactgacaacagaggctgattttatccttgctaatgacttaaaaaatattgaaggtcaaaagcacaaagcacttttggtcagtaaaaatgaagtaactgctttagatacaaagtcagaaattgctgacagtcttttaaaaatatcggaggaattaaaaaatgactaaaattacacttgcggtaacaggttcaattgcagcttataaagcggctgatttgacttcattactgacaaaagagggacataatgtgactgtcttaatgaccagaagtgctacccagttcatcacccccttaactttgcaagttctgtcaaaaaataaagttcatttagatattatggacgaggaacgtcctgaattggttaatcatattgatttagctaaaaacactgaacttttccttgttgcgccagcaacggctgatacaattagtcgtttggctcaagggcgtgctgatgacattgtgacttctgtcgcccttgcacttgaaccctctgttccaaaatattttgcgccagccatgaatactaaaatgtatcaacatcctctaactcaaaaaaacattgagattcttaaaaaaatagattataatatgattcaaccgaaaaaatctatactcgcttgtggagattttggtgagggagctctcgccgacttacctgacattatctcggatttaaaaaattctttataaaataaatgaggtatttatgaaaaaatcaaaagcgtctgatgtggcaattttagccatttttattgcgattatggttgttgtccagctttttactcagtttgtgattaacgtctggccctttccggtaaaaccaacgcttctacatcttcccgtaatcattggctcaatcattttaggttggcgtaaaggcgcctttcttggtttggtctggggtttaatctcttttgttacggcaacgattgtgaccactccaacaagtttcttatttagcccatttcagcctgtgattggaacacatcatggctcgccctggggcttattcatcgcttttattcctcgaattttagtaggtatcctcccttattttgtttataaaatagcaaataatcgtttgggtgctggcttggctgcttttgccggaactgctactaataccattcttgttttgacatcgattttcttattctttggctcaactctaaaatggtctttgagttacctcttaggtgccattgttgcaacaaattcactgacagaagtgattattgctgtgattttaaccactgctattgtccctgctctcactaaggctcgcaataattcatgatttcaaaaagcaatctattttgattagattgttttttttattaaaaaaatgttataatgtaagcgttgataagaaaataaataggagaaaacttatgaaaaaaatattaagtttcgacattgataacacactcaatgaaccaaaaatgccgattttccctgaaatggctgaattgttggcgactttgtctcaaaaatatattatcgctccaatttcagggcaaaaatatgatcaatttttgattcaaattataaataacttgcctgaatctgcaaatttggataatttccatttgtttgttgctcaaggaactcaatattatgctcacaaagctggtgaatggaaacaagtcttcaattatgctttaactgacgaacaagccaatgccattatgggagcacttgaaaaagcagctaaagaacttggccattgggacgaatctgttcttcttcctggtgatgaaattaatgaaaatcgtgaatcaatgattgcttactcagcaattggtcaaaaagctggggttgaagctaaacaagcttgggacccagacatgacaaaacgtaatgaaatcgctaaattggctagccaatatgctccagagtttgaatttgaagttgccggaacaacaacaattaacggttttgttcctggtcaaaataaagaatttggaatgaatcatttgatggaagaactcaacgtaactaaagaagaaatcctctactttggtgacatgactcaacctggtggaaatgattatccagttgtccaaatgggaattgaaacaatcactgttcgtgactggaaagaaactgctgctatcctcaaagcaattattgcaatggaagaagcttaattttcgattgataaaaagttgtcattaatgacagcttttttcttttctatcagaaagtactttcagaaatttaaaaaagacagaataggttttcattctttagtcctattgaaattaacaaagaatttaggtaaaataggtaagtatgtttaatttatagaaggtgaacttatattgaaaaatttgaaaaagaaattaacattgactggtttaatgacatccggattgttactcctttctggttgtgtgcaaacacacgttgttgatggagtccgtgttccaacggaagcggctactcatgggattacttacaatcttttggttcgtcccatgtctgcttttgttgacctattcgccaataatttacatcttggttatggttggggaatcattttcgtcactttgattatccgtttcctcattttgccattaggtttgaatcaagcttacaaatcaacttatatgcaagaaaaaatggcttacctcgctcccgtgtttgctcctttacaagaacgattgaaaaaagcccaaacgcctgaagaaaaaatggcagcgcaacaagccttgatggctgcccaaaaggataatggcattaatatgctttcatctatcggttgcttaccaatgcttattcagtggcctttcttcattgctctctacaatgcagcagcttacacaacaggaatctcaagttcaacattttatggtattcctttaggacatcctagtattgtcttggtaattatttctggtgtactctacttcattcaaacatggatttcaaccttgtcaatgactcctgaacaaaagaaatcaggaatggccatgttgattatgagtccagcaatgattgttgtcttctcattcatgtcacctgcaggtgttgcactttactgggcagttggtggttttgtaattgtgattcaacaagtcatcattacctttatcatgaaaccaagaatgcgccgtcgtattgatgaagaatttactaaaaatcctccaaaaattaatgacgaaggcatcaaagatgttacccctacttctgttcaagaaaatttcaaagctatcacaagtgaacgcaatgaaaaagaacgtaaatctggtggacgaaatgctggtaaacaaaatcgtaagtaagttttactgacagatataaaaaaattactgatagaatttctgtcagtattttttatttctctattcaatatttttttgtttgtcaaaatgatgaaaataaattgaacaatggctcttaattcttggctagtaaaagatataaaaaaatactgacagaaattctgtcagtattttttatatttgtcttatgttaaatgaacccctttatcaacataaacaatatcaccaattacacctgaagcaagtgggctaacaaggaaggcagctgtttgaccaacttcttcaattgtcacaccaacaccgtcagctgtccggctgtcagattctttaatcaaatctttgtaacctgaaactcctgaaacagcaagtgttttaattgctcctgcagagattccgttaacatgaacacccacatgtgccatttcagcagcaagatagcgaacagtagattcaagggcagctttagcaattcccataacattgtagttaggaatggcacgaactgaacccatgtaagtcaaggttacgataccagaaccttttttaagcaaaggtttcgctgctttagcaactgcaagtaagctataagctgaaatatcttgagcaagtgcataaccatcacgagagatatctgtgacatttccaccaagatcttcttttttagagtaagcaactgcatgaacaagcccgtcaattttaccaacacgcgcttcgattgtcccaaaagcacgacgaatagattcatcagaagtcacatcacattcgatgagcaaatcttctggttcagccaatttggccaattgtttttccattcgttcgttttggtaagtataaatcaatgttgcgccttgatctttcattgctttggcacagccccaagcaatagatttattgttagcaacgcccatgataacaatttttttaccttctaaaaacataaataaaataagtccttttctttaaaataataaggtttcagcgactaataaataaaaaaaagaaaaatttaatctctttacctttgcaactcatataaaaaagttgacactctcacaagaaattgataatattaattgtaaaaggttttgcatatcaaaatacttgatacataaaattttaacttaaaaatcttgaactgtcaagttagagtgacgcctcttttcgcctgattactcgggcttttcattaatttttaagaagaaaaggaataaaaaatgactaaaaaatacgctatgactgctacagaagtgatggaagttattccgaaccgctatcctattatgttcattgactacgttgatgaaatttctgaaaataaaattgttgccactaaaaatgtaacaatcaatgaagaagttttcaatggacatttcccaggaaatccaaccttccctggcgttttgattcttgaatcactcgctcaagcaggttcaattttgattcttaaaaaagaagaattccaagggaaaatggcttacattggagcaattgataaggcaaaattccgccaaaaagtgactcctggtgatgtcatgaaacttgaatttgaaattacaaagttccgtggaaaagtaggaactgctgatgccgcagcttatgttgatggtaaaaaagtaaccacttgtcagttcacctttatcgttgatgaagcagctgaacaaactaactaaaaaaattactgacagaacttgtcagtaatttttttagttaaaacggctctgtcagtagatttcttgcatttttttgatgaatgattgtaaaatttcaatatgcttctctagcttttccaatagaatatactcattagtaatatgacattggtcatgctgaccaggcccaaaaacaactgttctgattccaacattttcaaaaaatccttggtcattagagcctgaggccctgtcgtttgcgctcctgataagtcagtcagcaattggataaagggggcttgattatccgtcaaagttgataaaacaggtgtaacaatatcctcgtaagtgaaatgatatttgtccgctaaatcagtcattacttgttcaaaaactaactccagttcaggtgtcaatcggcagtcaacaaccagatctgcaaaatcagctgttttattgggagacttctcatcaccggcataaatagatgtcacaacaaaagtcggcacatgtagctgactatttttataagtcttcaactcttcaaaaatctgttcaatatttgccaaaaaataagtaacatcacctaaagcactttcttgaaaatgctcttgtaccgaagcatgaccagcctttccaaaaaaatgcagcttcataaaatgatttccacgtgtccaatataaatcttctctaaatcagtaggttctgcaataacgcaaagagcagactcataagagcaattttgactgaaatatcgagcaaaatcttccgaacccttcccgtcgagctcttcgttagccgtcccaacgacccagatatcttgacttaaatcttgaccgataaaacttgcagcagcaagtaaattcccaacatcgccgcccttcatgtcactagcaccaagtccaaagagtttcccctctttcacttgagcatcagtagggggaaatttccaatcgcacaaattcccggcaactacagtatcaacatgaccagctaggataatggcttcttttttttgtccattattaacaattgccttaatctgtccagcaacaaacgtttcctcacgaacaacaaaatcaaagccttctttaatcaaccacttttcaagatagattaagatttctgattcatttcctgaacttgatggaatatcaaccaaactttttaacaattctaccgctttttccataaatttccaccaaactatttgttattttcagaaagagtatagttcttttgaatatctttattaatttgtccattctttaattcttctttaatcacagaattgacaacctttgttaattcatctgatcctttagggagtgcaactgctgaaccataactatcttttggtgttttaacttcaacattcgcaatcgccaaatctgaattagccgcaacataacttttggcaatcaaattttcaataactgctccttgaacctgtccacctttaacttcattgatttcatcaccgatttgaggtaaagcaatctctgttgttcctttaaattgactggttacaattccttcttgaatggaacctttttgagcggctactttttttcctttaaagtcatctactgaactatatttacctaaatcagatttttttactactaaataattgcttgctgtataatagacatcagaaaaattaacagatttttcacgactaggttcttttgaaatacctgaaatagcaatatctgcttttcctgtatttaaactagctaaaacattattaaagtccatactttcaatcttaactttaacacctaactttttaccaattgcattagctaaatccacatcagaacccacgacagtattcttaccatctttaataatttggaattcaaagggtggataatctggggataaagcgacttttaatacaccagctttttttactttatccacttgattagtagccgattttccatttccacaagctgctaatgttgctaccgcagccaaaccaactaatcccaatgtcattttcttcacgttcttgttcatccttaaacctcttttataaatagaataagtataattatacaatttatttttgttttgtcaagaattattgcatatttattttataattatttaaaaaggacgatcaaacagggaaaaacctgtactattatactttatataaaacaaaaattcacttttaaagtgaatttttattagttttttaatccattgctcttaattctaaaaccatatcacgtaattgagctgctccttcaaaatcaagcgcagctgctgcttgttgcatttctttttcaagttttttgactaaagctttgcgttctttcttattcatcgcacttgcatcaacttcttccagctcaccagaatctgttttcttagtaatagcaatcaaatcacgaatttcttttttgatggtttgaggtgtaattccatgttcttcattatacgccatttgaatgtcacgacgtcttgccgtttcatccattgcatgtttcatcgaacgtgtaattttatatttttgcccctcgtattctgtataataaccactatctaagatttctttatctgccggatcattttcgtcaagggctttagccatgtcagaataaagaataacatgaccttcactattacgcgccgcacggccaattgtttgaatcaaaccacgttcatttcgcaaaaatccttctttgtccgcgtccaaaatcgctactaaagaaacttcgggaacgtcaatcccttcacgaagcaaattaattcccaccagaacatcaaacactcctaaacgtaaatcgcgaataatttcggttcgttctaaggttttgatatctgagtgcatatatttgactttaatccccatttctttgaagtaggcagtcaaatcttcagacatttttttagtcaaagtcgtgacaaaaactcgctcatttttctcagctcgtttatgaatttcaaccactaaatcgtcaatttgtcccatcattggtcgaacttctacgacagggtccaacaagcctgtcgggcgaataatttgttcaacaatagtgtcggtctgttccatttcataatcgccaggagtcgctgaaacataaacaatttggtgaacatggctttcaaattcttcacgttttaaaggacggttatcaagggctgaaggcagacggaatccatagttacagagcatttctttacgagctctgtcaccattatacattcctttaacttgtcccattgtcatgtgtgattcatcaatcataatcatgaaatcatcagggaagaaatcaagcaaggtataaggaggttcgccttcctcacgtccgtccatatgacgtgaatagttttctaccccattacaataacccatttcacgaagcatttcaatatcatagttagttctttgttctaaacgttgagcttcaagaagctttccttctgaacggaaaacttttaattgtgcttctaattccgcttctatcttggcaatggactcttccatacggtcatcatttgtcatgaaatgtgtcgctgggaaaattgccaaatggtccacttcacctaaaacttgtccagtcaatacttcaatttcacgaatgcgatcaatttcatcaccgaaaaattcaacacggaaggcatgctcatcacgagaggctggaaaaacttctacaacatccccacgaacccggaaacagccccgttgaaagtcaatatcattgcgctcaaattgaatccctaccaaatcgtttaaaagttggtctcgagaaatttcttgtcctggtcgcaatgaaacgactgaatcttgatactctttgggtgaacctaaaccataaatacaagaaacagaggccacaacaatgacgtcattacgctctaataggcttgaagttgcgctatgacgcaatttatcaatttcatcattgaccgaactgtctttttcaatatatgtgtcagaacttggaacataggcttctggttgatagtaatcataataggatacaaaatattcaaccgcattatttgggaaaaattctttaaattcgctgtataattgaccagccagtgttttattatgagccatgaccagagtcggttttcccgtttgagcaatgacctgactcatcgtataggtttttcctgtcccagttgccccacgcaaaatttgcgctttttctccattttcaatattttctacgagttcactaatcgcttgaccttggtcaccagctgggtcatattttgaaaccagttcaaatttattatctgttattctttctattgccattctttttcctttaattcttttctatgatatttgaaaaataatctaatgcttgatgataaacctagcttttaaagccaaaatctatttttaaaatctcagttaaggataaaaattgatagcttgaaaactcaatttcttcaggatggctttcaaggtcaatttttgcttgctcatctaatctaacaagaaaatagtgctgttcttgacctgcgtaagtccatgttggaaatttcatgtctttaggaaaatcatattttaatgttcctggatattgtccaataatttcaaagtttttcgtgccaatttcttctgaaagttctcggataatggcactttcaggattttctcctgcttcaattccgccttgaggaaagccccaattcattccgtctgctcgcttggctaaccagattttgttttctttattgagaataatggctgcgacgttttgtctgtattctttcatttttatcttctttttatttattttagtgttgaattctatagatataaaaaatcatttcattattaatcttctaatacaattttaccattttcacagctaaaaatatgctataattgaattatattcaaaaaaagataaggaagttttattaataatgaatcgcgatgaaattcaagcaaatttaattaaagcaagtcacatgattagcatggacgatattattcgtgaaggatacccaaccttacgtgaagtcgcaaatgatgtgaccttgccattatcagatgaagacatcatcttaggggaaaaaatgttgcaattcttgcacaattctcaagaccctgttatggctgaaaaaatgggacttcgtggcggagtgggccttgctgcaaaccaacttggtttgctcaaaaaagtcattgttgttttgattcctaatgaacctgaagtcgatgaagaaggaaatgaaattccacctaaagaagcttacaaaatgcgtgaaatcatgtataattcaaaagtggttagccattctgtacaagatgcggccgttgaaggtggcgaaggttgtctttctgttgaccgtgaagttccaggttacgtcgttcgtcatgctcgtgtaactgtggaatactacaacaaagaaggcgaaaagaaaaaaattcgcttaaaagattttccagccatttgtgttcaacacgaaattgaccacactaatggtgtcatgttctacgaccacatcaatatgaatgacccttgggaaattaaagatggcatgattattgttaaataatcagcaaattcactgatgaatttgtcatcaaaaatgaaaaataaagtaaaaattactgacaagcttctgtcagtaatttttttatccacagctttaacgtttactgtgttcacattaaataatcttagattatccttacttgccttagcagtttacgaaatcccaaagcttttgtcagcaatttctactgacaaattcttcaggaaataataatcataaatttttatttagcaattttggcaaaatattcaagggtacgaattaattgagcagtgaaactcatttcattgtcataccaagcagcagttttaactaattgtccaccgtcttttaagtcagtcacttcagtcaatgtcgcatcaaagagtgaaccgtaagccatgccgataatgtcagatgacacaatttcatcaacattatagccaaagctttcatcagcaacagctttcattgcttcgttgatttcatcaacagtgacatgtttttcaagcactgtaacgagttcagtaattgatcctgttggagttgaaacacgttgagcatgtcctttcatcaaaccagaaagctcaggcaaaacaagaccaattgctttagccgctccacttgatgctggaacaatattttcagctgcagcacgcgcacggcggaaatctccaccatgatgtggaccatcaagtgtcatttggtcaccagtgtatgagtggacagtagtcattgtcccacctttaacaccaaagtttttgtttaatgcgtctgccattggtgctaaactatttgtagtacaagaaccggcagaaataactgtttcacttccatcaagaattgtgtgatttgtgttgaagacaacagttttaacatcatttccaccaggtgctgtaatcaaaactttcttagctccaccaggatgcaaatgtttttcagatttttctttagtcgcaaagaaacctgtcgcttcaagaacaatttccaccccagaatcagcccattgaatatcttctggattacgttcagcagtgactttcacaaattttccgttgacatcaaaaccatcttctttgacctcaactgttcctttaaaacgtccttgactcgtatcatatttaagtaaatgcgcaagcattgctgggtctgtcaaatcattgatgtgcgctacttcaactccttcgacttcttgaattcgacgtaatgccaaacgtccaatacgaccaaaaccgttaataccaactttaactaccatgatgtagtcctccgtttttttatttagatgatgagaatttctctttttctactacgaatatcactcttcgtaatacgaaacattgtttcaggtcaactgctgtggtataatataaataatgaatttatagttattagagacatctcttatctctaatataaatgatactactttttttatttagtgtcaattttttttactaaaaatgtttaaggagtttttattatgaaattatcatctggttgggaacaatctgtttacgttttacttattttggcaagacttcctgaaaatcggacgatgtcatccattgcacttgctaatcgtctcaaagtttcaccctcttatctcaagaaaataatcaaatcgctcgttgatgaaggacttttacgctcaacaactggaaaaaatggcggcttctctctcaataaagatcttcttgatattagtttttatgatgtcttcttggccattgagggccgtggacgaatttttcaaagtcaaggactcttacaaaattttattggtgcagaatctggtaaagcacaacattgtgcgattacaactgcgcttgatgagattgaaaatactcttgtcagaaccttgtcaaatgtatcgctagcgcaagttgctgacgaaacccaatataattacaatctcggctatcttgatgagtggattgacgaaatggattgaaaaatttactgacagaatttctggcagttcattgtgaatagaaaaattgctgacattaatctcgtcagcaattttttcattgtttcatttttctgtcactaatactattttactgacagaattttttattcggcaggaacttcttcatcagtggtttctgctgtttcttgggtttgattagaaatgacaattttatcatcaatcaaatcagctaccaattgtttatattcaggatgttcaatgtagaaatcagcaattgaatcttcaatattttcttgaattgttctacgaagaggtcttgcacccattgcagggttatatcctaagtccactaatttttctttagcggcttgagtgacactaagatgaatatcattacgtccaatttgttcattgacttcatcaagcattaaatcaacaattttaaggagattttctttgcttaaagcagagaattcaataattccgtcaaaacggttcatgaattcagggctaaagaaatcaccaagttgaccaagcactgatttagttcgtccttcgcgggctgcaccaaatccaacagaagcttcaactttaccagttccggcatttgaagtcatgataatcaaactatctttgaaggatactgtccgtccttgtgcatctgtcagacggccatcttcaagaatttgtaagaacatgtgcatgacatcaggatgagctttttcaatttcatcaagcaaaatcaaactgtatggattacgacgaacacgttcggtcaattgacccgcttcttcataacctacatatcctggaggcgcaccaatcaatttggccaccgaatgtttttccatgtattccgacatatcaaaacgaatcatgctctcacttgagccaaataattctttagccaattgtttagcaagttcggttttacctacacctgttggaccaacaaaaaggaaagaaccaattggacggttaggtttgccaagacctacacgtgagcgacgaattgcttttgatattttatctactgcttcatcttgaccaatcacatgtgctttcaaatcatcagccaaattaatcaactgagtttgttctttttctttcaaatccccaactggaatttgtgttttttgttcaacaatttgttcaatatctttttcagtgatgactggcatatcttcgtcagtaacttcttgtttttgcaattcacgaagtttactgatttggtcacggaaatgagcggctttttcaaaatcttcagccttagttgcttcatttttcttactttccgcatcagcaattcgacgattgatatcctcagggtcaacaaatttcaaagtcagatttttcttagaaccagattcatctaaaaggtcgatggctttatctggtaagaatcggtcttgaatgtaacgatttgacaaatgagcagctgcttcaatagcctcatcagtgtatttcacatgatgataatcttcataacgtgcttgaatgcctcgcaaaatcgtaattgtttcatcaactgatggttcatctactttgaccggttgcatccgacgttcaagtgccgcatctttttcaataatacgatattcgttgagtgttgttgctccaaccaattgaagctcaccacgtgcaagagccggttttaggatattacctgcatccatattgccgtcgccagcagaaccagcaccgacaatttcatgaatttcatcaataaacataatgacatcattacgttttctgatttcatccattaatttttgcatccgttcttcaaattgtccacgaattcctgttccttgaacaagagaaaccacgtcaagacgaataacttctttattttgcagtttttgtggcacatcgccatcgactattttttgtgctaaaccttcaacaactgctgttttaccaacaccaggttcaccaattagcactggattattcttagttctgcgatttaaaatctcaataacacgtttgatttcttcatcacgcccaatcactgggtcaatttcgccacgacgagctgattcggtgatattaataccgaattcttctagcatccctttaggttgttttgcccgaggattttgtggaccacgcggaccacgcccacccgtttgtgttgggggagtttgattacttgctgccccattaaaatcttgaccttgcaaagcactgaagatatcgttaaacggattaaagggttcatcagaatttccatttgaggcatttcctgcgccaaataaagcttcttgaccaccagatttcataatttgataacagttttggcacaaatcaatttgttttttctgaccatttacacttgtgtaaaggtgaatcgtcgcttcattaatattacaattttgacaaagcatcgctttcctcctcttaattctcagtaatcagttttaaattaatttttatcttccacttacgaaagaatttaatctaaaatcgggaccaacttcgatgtaaagctttttatatttgaaattatttgtggtaatgactagaactcgattattattacggacatcccaaaactcattttcgccgttttctctgaaccacccaccatagtaccaggcattagttcccgctacttttttataaaatttgggctttttcaagtcagaaataagctggacattctccactttttcaggttcaatcctgatatgttttcttaaagaaagaacttttcttgcccctttaagttcaatatcaatgccaccatctttttcaaaataaacagtagtcgtcattttctctccttaatttgtaatttaagtgataacgtttacttttattttacatcaaatttaaaaaatcaataaatcatttctccctttttaatataaaaagtttgaccatatttgaccattgataaatttattataatcattttggaaaaatttatcaagtcttttgaactttttcgggttaatttttaataaaaaatagttctatcaggatcgatagaactattttttttaatttaattttgtagcactagaataatcagatttgagttggtcaactgctgcctgctctgatgacgaactaccacctttatatttgttatttcctgttaaatcactcacatcaacttttccattattcaaggttaaccctgtataaccatagctataataacttgtactgtcatttttagtatctgtatcactgttataatgagaaacaattttataaatagttacaacagaaaactcacccttatcgctatcatcactagagctatatccccatgagctgatattagttccaacaaaataggaatccatgcgtgtcacggtataagttgttccaaaatccccagtgctgctttcattatctgcgcgaacaactgtatcttcttgcgttaataaatcatttaagtttgatattttgggactactttccaagtctgcaaccgtcaatgttttacttgctgtacctgacaatatttttccattgcttttttgttgattaatataatcttgtgaaagtctaacgataatctgttcgctatttgtcaaatctgtcggtgcagaattatcattattcactgtgaacttatcatcatcaaatttgactgaaccaaaatgattgaaaccagtaaagctgacaggattgtctttcaaaacactctcaatcgtgtaagttgttgcttttttcaaatttttgactgtataagttttcgtttcttccttgattggattgtcttttaatgttgttgtgatttttaaagtcactttttgtccgttggatagattttgcgaatggctaatatttatccttgtatcttcaaaatattttgcaaatttttgccattctgttgagttatttgtcgttgagttgaaaaatgaaaaaatattactgtcctctgcttttttgacctctgatgatggcagtccaacttttgcaccaataatttcaatttcttttttctgataatctcctaaaagctccactgttccttggctattgtaaccagaaaagttgacctttaaagcatttaagatacttttaggttgggcgttgatataagcaaaaacacctcctatgatgataaaaatcgctattacagcaccaatgattccaatcctttttttatttactggacgtttttctttcgtttctgcttctttattctctggttggttgatagtcattgactgaccacagtttgcgcaaaatgcagcatcttttttattttctgtgccacaatgtgggcaaaattttgtgttgtttttcatcattatctcctataatataccgccggttgcattgctaatgagtgtcgcaatttctgagcccataattgcaaaaacaatcaaaaatgccaatcctagaatcgcactattagcaagccatgcaagaagtttgatgtaaaatgtatccattttccgctgatgaatggtgttgatataagtaaaaaatgaaataaatccccaaagcataagtgctaaataaattataaaaatcgctagagcattgataccaatgagcgcaaatagaaaacttacaaagttcaatgcaaataaaagaacataaaaacgtccataataattaagcatttttttgaatgtaaaagttttatcgccaagaattgcaaaatttgctagccatccacctaaaatggttgctgcatgaagaataatgaaactaataataatcggaaaaatcatctgtccaaaaacatgattggcagtgtttgctactgtatttccaacattttgattataaagacttcccagtgaattatttgccgaaccaagtgcattcccgacagaagtactggtatttgtaataatatttaccagtatttttcccaaggcaagcgctccaaaaatagctgtcaaagtaattgataaccaactaaaccagaggggagtattttcttgtacgttttttgttggtgcctttacagcactaactatccattcccaaaggtttgtcgcaccatttttcaaaatttccctttgttcttcagtaataaaaggtttgaccgagtttgctgtacttgtttcattggctggctcattctccatttttgttccacagtttgtacaaaatacacttcctgcttcaatctctttgccacagtttgggcaaaaggttggttggttttccattttctatctcctattatgataaaattacaatctaatcataatataaaagctttattgtttcaaaaatttgtctatacgttatccaataattactctatggcttcaaagaataccatctattaaaaaaattactgacaaaattgtcagtaatttttttattctgcaatctcagcagcattatcaattttcttatacaatttattttgatgaatcaagatatagattgaagccaaaatggcaatgcccgcaaaagcataaacaatgatatttccagctgaccagccataagattgaacaacccatccaatgaccaaggttgccgtcacttcgccgataatgtactgacagaatcccattgttcctgttgacattccattggcaaatttcggtacggcttcattgaccatcaaaccgacaatcgtcgccggtgcatagataaatgttcccataattaataagacaatgataatcaaagtgtggtttgttgccgcaaaataagtaattagacaagcaagcatggcgatcagtgaaatcaaaaccataatggcccgacatcctttgagcaaatcagtaataaatccaatgataataacaccagggatagccgccagttcaaaaattcctgtcagccattttgccgttgaattatcaaatcctttgacattgaccaagtagttgggaatccaactcatgatgccataacgcaccacgtaaattgacagtgaagtcaaaatgactgcccaaacgagtttatttttgacaatgtattcaaagaatatcttaaagacattttcgtcagaaacatcaccttcgacaacttctccatctttaatgaccactttatcgccggaatattcttcaatcgtaggcaatccctttgttgttggacgatcagagccaagaaataatacgataacagcaatgacaatcgagacaattgatgctgtccaaaaactccattgaagcgaagcgccgaaaaacaaagcagataaattaatgatagccacacacatgaaagctcctgcattatgagccgatgaccagatggaaaatgccgttccacgcgccataattgagcctttccctttgcgaccaaaccataagccgaccaaacgctgacaggccgtagcccccatgccttgcatgactgagttgagcaacatcagaaaaacaatcattccaaaactttgagtcgtcccataaagggcattgatgattgatgaaacaatcaatcctgtcgccacataacgatttggattggcacggtcagctagcgttcccatgatgagctttgaaatctcatagccaattccaaacatggagagaattgtcccgatttgccccattgaaaagccataagcttttgagatatcattttgctgaacggtgaaaatcaatcgaataatataataaccaatataaaccattgctgtcgaaattagaacccgaatttgccaaattttatataaacggggaactttttcctctgagattttttgctctgcatctggagctggttttaagaatccaagcatgttgaatcccctttcattttgataaattaattataacttactctccattgaaataaattcctgattttactataatttcaggaatttattcttaaataataaaaaatttactgacagactctaataagaaattcctactagaatctgtcagtaaaattcaaaccatcaaacaatcctcccctgttctttatattctgtataaagttgaatcaaaaggtgaataataagttctagtgggagcatattattataatcaactggaatttttccagaagcctttttttgataagcaaacaaagataaatcgctttgttgagctaatctactttcataatttccggtaatagccaaaacttttttaccctctctttttgctttgagggctgtcgcgacaatcaattctgtttcaccagacaaactcagtccaacaagaaaagtattttcaggcaatttactaagataattctgcatattgtcttgataaagacttaccgccttgacatctaaaaattgcaaatctctggcaaacgaatcggctattctcactgataaaccacgagagataactacgacagaatctgcctgataaatattttcaaggactttagctaaggttttcactctctagtagcctcaccgttcttaacaattcctctatcgtttcagagacaacttgattggcactttctgataagccgtgaatccatttgtttgtattcatttttatttttgctgtatttttgtattcagaaaaaccagaaaattttttctttttcaaagttcgaatgattgatgaaggactgacatgagcagattcagcaatctgagcaactgtcatttggataacttttgtcttattttcttctaagtaattccaaatataaatttccacactggttaaatgattcataaaactcctctgaataaaaattgttgactcttaatagctataatttctaaaaaaatataaaaaaacttactgacaattgtatcagtaagtttttaaattacataaagtcacgcaatggtttagaacgacgtgggtgacgaagttttttgattgcttttgcttcaatttgacgaatacgttcacgagtcactttgaattgttttccaacatcttccaaagtatgcatccgtccatcatcaagaccaaatcgcattctcaaaacattttcttcacggtcagtcaaagtatccatcacttcatctaactgttcacgtaaaagaatacggtttgtataatcaacaggtgattcgatgacatcatcctcaatgaagtcaccaagatgagaatcatcttcttcaccaataggcgtttcgagtgatactggttcttgagcaattttcagaacttcacgaactttatctggcgccatgtgcaactctttaccaatttcttcaggtgaagggtcgcgtccgagttcttgcaaaagattacgttgaacacgaatcaatttattgattgtttcaaccatatgcactggaatacgaattgtgcgggcttggtcagcaattgcacgtgtaatcgcttggcgaatccaccaagtggcataggtagagaacttgaatcctttcgtgtggtcaaacttatccacagctttcatcaagcccatatttccttcttgaatcagatccaaaaattgcattccacgtccagaataacgttttgcaattgaaacaaccaaacgcaagttggcttcggcaagcatttgtttcgcaaattctgccccttcaccaccagcaataattgcttcagcaagtttcgtttcttcatcaagagaaatcaatggataacgaccaatttctttaagatacatacgaacaggatcatcaatacgaacattcgtaacgatttcatccattgcagtatctgaaacttcttctttttcaatttcatcagttacaagagccaaaggacttggatttccatctttatccacaattgaaattcctgcatcttgaatttgtttgaacaaatcttcaagagcatcatccacaattccaaatttaacagaaagctcatccatgatttcttcatcaagcgcttcacccaaaggtttacgtttggtaatatagcctttaactgctttttcataagcttttacattaaaagtatcaccattttctttgatttcaactctcgctaatgttttaggactatccatcttttcaacaacaacaggtttaacatttaatgcttcaagaagacgacgttcctcaccaggtccaactgaacttgaatgtgattttacaagtaagccaatttcttgggctttctcaaccaagacacggttttgaactcctgtttctttcgaaatttgacttattctttttttatttgctgccaattcgatcctcctctttgggtaaaactactgacaaaactgtcattaaatagactagccaattgtcagtaaaaaaatactataattttttcttttgattaataatctgaagggttaactctaacatacgttctttatttcctgctttttctgcagttgctaattgttgctgaagttcttcaaattttatttgttccatttcatttgaaaaaatggaaaccaagtcattaatttcctgacttgatgcagtctctggtaaatctaaacttataatctgataaaagagactacgctgatcctctgacaactcacttgccaaatgggattcatcaatctgctcataaaccattgcctcaagtaatatcttttcaaatatatcctgataacgtttatggacaaatctaaaattatcatcctgagaaaattttttcaaaacagatgaatgataaatcattcgatgaaggagcatctcctcagctctttctgaacgagacaatttaggaacctgaatcgttggttgaaaaacttgagctggttcatttcttctatcagctacttgaggttgaatattattttcataaaagatttcttcaaaatcaataggtatggccgaatcaagattagaataatctctctcgtcagtaaaattttcaactagatttgaagccccataatcactaacagaatggtcagtaatattcatattttcacggcgcaaatttacagcctgctccacttgattatactcgaaatcaggcaaaatctcaactaattttcttatataagcatcctgagccgttatcgattgtagctttgcaatcattggcgcaatctgctcaataaaatctaactgaacctgcaaattagccaaattttcaggtcttaaaaaatcaatcaagaactcaatgggctgaatccgcccagtttccatcaatgctgatagacctgttagaccatatgttttagaatactcatccggatctaacccttcaggcaccttgacaatctgtacatcagattcaccaaccaaattaagggccttatagatggcgttttgtccggcagaatctccatcatatactaatacgaattttttagcaatttgtttcaaacggcgaacatgcttctccgtcaaagccgttcccattgaggcaacaacattatttattcccgctttatgagccgcaataacatccatgaaaccttccattaaataaacttcacgccgcttagaaatagttggttttgctttatctaaattccacaattcataagatttatcaaaaattgtcgttgctgatgtattgatatattttgcttttgaatcatcattttcttgccattttcgtccagaaaaaccaatcgtttgaccgtattcattggtaattggaaacatgattcgattcgtaaaagcatcaaaaaccctattatttgaaaaatgaaatagtcctgagttagccataacttcttcatcaaatttatttgataagtttttaaaaataaaatcattttcctcaggagccaaaccaatattaaatcttttgattacatcatcagtaatcccccgttcagcgaggtagtctctggctcgttcccctagttctgttgacatcaacagaatattatataaacgagcagcctgattattgatttcatagagtggcgcattaggattgtttttttcttctctgtcattagaaatatcaagagtgaccccggcgaaattagccaactctttaacagcatcaataaagcccacttgattatattcttttaagaactcaatagcatctccagacctaccacaaccaaaacaatgataaaatcctttttctgcattcacattaaaagaaggagttttttcgccatgaaaagggcataagccaatataatttttaccggtgcgacttaaggcaacatattgtaaaatcaaatcagcaatattaacctttgactttaagtcattcacaacttcagtatctactgaaaccattcgctactccccctttcatcttgactatgaacattcaaataagtaatcacaacttaagtataacacttaggaaagagtctggtttattattcattcacaaaataaaatcgattctttcaaatttttatcattttctatctctttaaagtctaaaagacgcctatttagcaatagacgtcaaacaaaggggggtaagggattcgaaccctcgcgccggtttcccgacctaacgatttagcaaaccgtcctcttcagcctcttgagtaaccccccataggcttattaacaatgaatagataccttacatatccattatgggaattccaggattcgaacctgggacccctgcgttatcaacacagtgctctaaccaactgagctaaactcccataaaatgttttcaaatgaaaactaagcggatgacgagaatcgaactcgcgtagccagcttggaaggctggggttctaccattaaactacatccgctaacaaagaatggcgcgagacggaatcgaaccgccgacacatggagcttcaatccattgctctaccaactgagctaccgagccaaagatatggatcttgctggattcgaaccagcgaccgatcggttatgagccgatagctctaaccaactgagctaaagatccagctgataattatagcggcgaaggggatcgaacccccgacctctcgggtatgaaccgaacgctctagccagctgagctacaccgccatgtttgacctaagtcaaattgatgtaaaaacatcaatcgggaagacaggattcgaacctgcgacaccttggtcccaaaccaagtactctaccaagctgagctacttcccgttatatgcaagcggtaggattcgaacctacaaccgcctgattcgtagtcaggtactctatccagttgagccacgcctgcaaataactttttataaataactagtaataatactagtagaatttcttttactttcgttcgtttttaacgaactttgatagcgttttatcgcgtgctaccactggcttagagaaaataaaaaaataagtcaaaaaatgacttatttttttatcagtgaatccaaatactcatcaacattaccattcctaaacctactactgcgataattgtttctaagactgtccatgtttttaaggtttgtttcacatctaaatcaaaatactctttaaacatccagaatccagcatcattaacatgtgaagctgcaattgaaccggcacctatcgccaaaaccatcaaagctgctgtatttggagatgctgtagcaaggaactagacctgctgctgttagggcagccactgtcgctgatcccaatgcaacccttaagataactgtgataatccaagcaagcaataaaggagaaaggggtgaatctttaaacatattagcgatttgaactgagattccaccatcaataagaatttgtttgagcgctgctcctccaccaatgactaataaaagcatggcaattgatttaactgaatccgcaattgaagaagcaatttcagaatttttcttacggcgcatccaacccatagtaactaaggcaaagagcagggaaataatcattgctgacactggatttccgatgaacatcatcacattttcaacaatacttgaaggataagtcgtcgtcgtaactactttaccagctttcatcgcacttgtcgttactgcggcaaagggtttcccatcattagtcgcaatagaataaactgtactaattgccattaaaattactggcataagagctgtcaagatagatattccaaagcctggtgtttcttcaagtttccactcttttatttcaccaaaagcagagagtttattttttacaacaaaagcttctggtacccattttctagcaatttttgtgaaaactggaccggcaataataactgtaggaatcgccgcgattatcccgtaaagtagaactgtcccgggatttgcaccaagtacaccagcaatagcaataggtgctggatgcggtggcaagaagccatgcgtaactgaaagccctgcagccatcggaatcccaagataaatcaaaggtacactggcttccaaggcaacggcaaagacaatcggaatcaatagaaccatacctacttcaaagaagatagcaatttcaatgataaaactggcaaccatgatggcccattgaattctctttttaccaaaactattaatgagagttttggaaattcggtaggcaccgccagcgtcagcaattaaacgcccaagcatcgcaccaaaaccaaagacgattgctaattctcctaatgatcctcctattccgttttggatggaaacaggaatttgtcctaggggcatcccaagacccaacccaactagaaccgctacaacaattagtgatacaaaggtgttaatcttaaatttgataatcatcaacagaagaattaacactccaattaaaagtacaagtaaatcaatcatttgttttttcctttcaaaaatcttgaagacattgtgtaaacatcagttgcttgcgcttacaatttgcatttaaaatttaactcaatacttgctttatcttaagtatagtaggtattgagttttttagaatctaaatttagtctttttcaaattttctttgaaaattcgcgatattttcatattctgctaaaaacgagcgagaaagtcggataaatattggacttatttctcgataaatactgaaattttctggattgggttggtaagtttggttagtccctaccatcttttcaatttcactaatgtcgtcaatgagccctaatgctttctcagccataataactgctgctaaacaaccagcttctcgactttcaggaacattaatcggttgttcaaagatatctgcaagaatttgtgtccataattcagaacttgtgaatcctcctgttgcttgaatcatgttgaagtcacccactacttcaacaagactaagagcaaccatatagatattaaaaataactccttcaagaacgctacgcgccatgtgacttcggttatgaccataattcaagccaaaaaatgaacctctggcattagcatcccaaatcggtgcccgttctccaccgaggtaaggatggaaaagcagaccgtcagctcctggtgaaatgtttgctgcaagctcagtgacttcatcaaaagtgatttttccatcaaaaatctggtcacgagcccatcggaaaacatcacctccagaattaactggaccacccactacccaatgctctctgtctaaagcatatgtaaaggtacgtcctttttcatctgtttttggtctgtcggtcaccactcgaatggccccagatgttccaatagttatggctgcaacacccggtttgatgacattgactcctaagtttgataaaggtccgtcagctgctccccaaataaattttgtgctactttgaatccccattttttttgcatattcgtgcggaagattttcttcaatttcataaggctcaaccacgtttggtaactgactttccttaatcccagtcatttccagcgcttctttatcccactgaagttcaaaaatattgaaaacaccggttcctgttgccgttgataagtcaattttattagttccgaaaagtcgctgaaaaatgtaacctttcaactccaagtaatgagctgctttttgatagatacttgggtattccgcttgtaaccacataaatttagataaaggagccatcggatgaagaggggttcctgttctccgataaatatcgaatccttttttagaggctttgatttgttctgtgtatttcacagccctcgtgtctgcccaagtaattagtcttgtaagtggttgccaattttcatcaaaagcaatcagtgagtgcatttgtgtactaaaggaaactactaggagttcgtcttcgtcttctaaattaattgaaacttctcgaatggttactaagactgcttcaaaaatttcttcgagtgattcttctgccattccgctagcatcacgatgaagagggtaggcttgactactacttgcaataatcttaccatctttttcaaaaagcactgccttggtcgccgttgtccctaaatctacgcctattaaatattgcattggcgctccttttcttctatatatatttgctgacaggtccaagttcaaattataaactggaacttaccacccaagaagcttaagcacttaaacgcctgtcttctatggaatttctgtcagttgattattttgttactgacgtcgataagagccttatcgcctgcttcatttcggtagattttaagaaacctagtgcaatgaacaagccgtcagaggataaccatacacaaagcttttatggacctactcaacttttcgtcagtaacttatttttgttctacttcatgtccaccaaaaccattacgtaaagcagcaacgactttaccagtcattgtgtcttcttgtaatgaacgttggcgcatcatcagggataaggcgataaccggagccggaacgcctaaatctaaactttcttcaatggtccactttccttctcctgaggattgtacgcggccaataatttggtcaagtttagggtctttggaaaattgatcttgtgcaagctccatcaaccagcttcggatgactgacccgtgattccataattttgccacggcttcataatcataatcaaatggtgattgttctaaaatttcaaaaccctcagcaatggcttgcatcatgccatactcgattccattgtgaatcatctttaagtaatgaccacttccaagttttcctgtataaagataaccattttctgttgaaattgctttgaagataggctcaatcactgaccaagaattttcatcgtcgccacctatcataaagttaccaccttgacgagccccagccattccaccagaggttccaacatcaaaaaatttgattcctttttctgtcagtaatttattttgttctaagttgtctttgtaattagaatttccaccatcaataaggatatcagctgctgacagcttctctgatagtaattcaattgttgaatttgttgctttcccagctggaagcatcaaccaaataatttttggctctgacaactctgccagtaattcgtcaatgcttttaactgctgtaattttttctgaataattcccagcctcttccacagcctcagcattaacatcgtaggctacaacttctatctcgtgatcaactgcatttttcacaagattcattcccattttccctaaaccaatcataccaaatttcatcactttttcctccgtggtatcgctttctttttgctaactttagtataagtaatttttttcatttgtcaacaatattttttgtaaaatattttctgatttgtcaaaacaatttcaagtgactaattcggaatttcttataaatcggggaatcgtatttatggtataagtatcactgcttataacacgctaaagcgtgaacgcgcagacggaagtcgctatagcgagcttcctagataccttattactcactcagcggaaaattatcgttttcgcatcgttcggtcataataagatgatagccagtacacgaaatattgtttcgtgttactggctatggtataatgtagtcaattagaaggaggcttgatatgtcgcgtactttaatcagccgaatccgaagttattatgataacctcagtaaatcagaccaggcaatttctgactatttaattgcaaatattgatagcgctgcgatgctgtcaattcaagaatttgctcagaaaacccaagtctcaaccgctacaatttccagattttccaaaaaaatcggctttaattctttccaagaattgaagctggccattcacgccactgattcaacgcgagatgatgaattttttagcgaactttcacctactgatgattataaagaaatactgacaaaaaacttcaacggcaatatttcatcactaaattcaactttaaatcttattagtaacagacaacttgaccaaacaatggaaatattactcaaagctaatacttgtggtttttttggtttaggtggttcaaacgctgtcgctttgattgcttttcataaatttttgagaatgcctctacactgtgtctatcatcaggatttccattttcaacaaatgcaagccgcaaaattgacaagcgaagattgtgcttttgtgatttcacatacaggaaaaaacaaagatacgatgcatttagtcgaaattttgaaaagtcggggtgtgccaattattgcactaacctcctttgccagctctcctttagcaaaggctgctgatgtggcgctcatttctatttctgaagaaatttctttccgacccgaggcagtagcttcgaccgtttctcaaattagtttactcgatgctcttttcatgatgtatggaatgaaaatgaaagatgtttccgagggaactttatctgaaatccgaaaagtaattagcgattcacgtatttcttagaatttatccatttcattttagagaaaggatgtgattttatggcattttctaacactagacgacgctacgcaagttttgataccgtcgcgtctattcctggagaagtaatcgatgctttttggttcattattgaccatcacttaaaaggcgtttttccgatggaaaccattattaattttgacttagtcaactctgataatttactttcgattcgtttctctcaagataatagcccaaccactgttctagttgattttggctatccatttaatcctgattggccacttcattatcgagcagtggacaatatgggacgtgaaacaatcatgactgcacgagaaatgtaatgacagaaaactcaatccatctgtcagtaatttcaaaaataaaaaaaactgtcaaaattactgacagtttttttaaatttcataatagacaatttctggcggcaccccaaaacgaatgggtaagaaagtcaagccaatcccacggttcacatataattttgtccgttcattcagttgatacaatccaccatcagcactacttgaacccttgttatgtagtcgccaatttccaatccgaatttgtccaccatggctatgccccgataaaatcaaatcaaattgattgattgtttccatatctaaaacagtatcaggttcatgaagtgctaaaagcgaaaaagacgcctcaagcggataaagctccaagtcgggttgcccctcgcgccagtcatcaacaccggaaacagataatgtcctttgagcattatccactaatactgatctattttttaaaagagtaaatccagctttttctaaaaacccttcaacaaagccagaagatttttcatcatcaaaatcatgattaccaagtatcgcaaattttcctaaaggagcgttaagccctgacaatatcaccagtaactcactccaattcttatcttttgcccaagcaaccttatcaaacaaatcaccagaaaaaataattaagtctggtttttcgtcagcaatatttcgagcaaattttataaatcgtcgactacttgtatgccaagcaaaatgcgtatcggtaaaatgagcaatttttatattttgtttttgagcgatttttacatgtcttactttcatgacatgtggttctataaaaacaccataaattaacaaaatcaagagcaatgctcctattatcaatccaatcatttgtctattctatcataaatttactgacaaaaacatagcattaattaaaaaaatgctgacaaaatcatttgagtaaagctgtcagtaaattttgtataaaaaaagactaccaaagtagtcttttcatttattagttttggtcttcagctacgaatggaagcaaagccattacgcgcgcgcgtttgattgcattaaccactttacgttggtttttagcagatgtaccagttacgcgacgtggcaagattttaccacgttctgagatgaaacgtttcaaaagttcagtgtctttgtagtcaacgacttcgattttgtttgcagcgatgaagtcaacttttttacggcgtttgaagccgccacgacgttgttgtgccattttatttctccttatattattttttagatgcctgtttaaagttttctaggtacgacgttattatgaaaagccgattctgcttttcataataactaataagaggactaggaaatccgccatagcggtttccgtgaaataattaggcgctttagcgtcaattattccgccctattagaatggaaggtcatcatccgagatttccataggtgagctaccaaatgggtcagcatcacgaccgaaattcggtgttgcactattattattcgtttgtggacgtggagtattatttgtagattggcttggtgcagaatatgaaccggcagaagctccgcctcccataccatcgcgagcagatctactttccaacatttggaaactatcagccacaacctcagtcacataaacgcgttgaccttgttgattttcataattacgtgtttgaattcgaccagttacaccgatcaaagctccttttttagcccaatttgccaaattttcagcttgttggcgccaaataacgcagttaatgaaatcagcctcacgttcaccgttagcatttttaaattgacgatttacagccaatgaaaaagtagcaacagcttgattttgaggggtgtaacgaagttcaggatcgcgagtaatgcgtcccactaatacaacattgttaatcataatgaacttctccttagaaataaaagctcttaagcttcaactttaacgatcatatgacgaagaatgtcaaggttgatcttagcaagacggtcaaattcgctcaaagcttctgaagttgtttcagcttcaaaagttgcgatgtggtagataccttcgcggaaatcattgatttcgtaagcaagtttgcgtttttcccagtctttagactcaagatttgcagctccgttttcagtcaagatagcatcgaaacgttcaacgagggcagtttttgcttcttcatcaatgtttgggcgaataatataaagaatttcgtatttagtcattgatttttcctccttttggactaatgacgcaggttgagtcctgcgcaagttgtgagtttttcccacagagttatattctatcacttttttttgtttttcgcaagaatagatttaaaactattgggcagtaactattatctatttaaaaagaaaaacagcctccagaaaatggttactgttatctttttaacttttatcctaaaaaggctttaaaggctgcataaataaggagaacaatccctaggacaatacgatatttcccaaagaaagtaaaatcgtgttttttcacataatccgtcaagaacttaatagcaatcattgataccccaaaggcaaccagacaggcaaccagtaagacgccaaattgctcaagatttaaagagtttccatttttaaagaagtgaagaattttgataaaacttgctccaaacatgactggaattcctaggaaaaaggtaaattctgcagaaacttcacgacttactccaattaacaaggcacccacaatagtcgcgccagaacgtgaagttcccggaagcaaagataacacttggaacaaaccaatataaagggccgcacgatatggcaagcggtcaatgtccatcacggaaaattcatgattcggtacccaacgtcgttcaataacaatgaaggctaccccatagataattaacataaaggcaaccggaacaaagtgataaaaatgcttatctaaccaatcattaagtggcaatccaataattgctgccggtaaagcggcaatcaaaactttcaaccacaaacgccaagttaattgaatttcacgtggtgtcttttgtttgtcagcgggatttaacttattaaatggattcaacttatgaaaatataaaacaacgaccgacaaaatcgctcccaattgaatcacaacatcaaacatttctttaaaagcagctgattgattaagccgaatgaactcatcagcgataatcaaatgccccgttgaagaaataggtaaccactcagtgatcccttcaataatacctaaaataatggcacgaataaaatccatattttgctcctagaaaatttcagtaaaaagactgatttttatcgactgacagagcagtcttactttctaagtatatcatataaaggggaatgaataaacttacaaaaaaactgattacttgtaactaattttacattctcatccttgacatcattccaaaattgcgctagaattacaactaacacatcgatagaggtcgcaactgatatgaatctacgccgagttggagcacaacaaagacgcgtattagagggggagaagttgccgaaagaattttgacgctcagcaaagttcttgggctagtgaggaaaactcactagactgtcgcaaatggttaagaaccatgcggagggctattcgttcaagaaaatttttaaaattttgtcggacctttagcaatctattctatctagtaggattgctttttttgtttttctcagacttttctaaactaaacaggagtgagggtaagtctgagtctaacaagtcggtgtagaataaattttattagggagagaattttggaaaattcttcaaactcaactactgagacgcaagtaaaacgcggcttaaaatcacgtcatgtatccatgattgcccttggtgggacaatcggaactggtttatttctcacttcaggcgatgtcattcacacggcaggaccatttggggcactgactgcctatgttcttatcggagcaatggtttacttcctcatgacttcactcggcgaaatggccacttatctaccaacgtctggttctttttcagactatggaacacgttatgttgatccagcatttggttttgctctaggttggaattattggttaaactgggcaattacagtagcagttgatttaaccgccgttgctctttgtatcaaattctggttacctgatgttccaagttggattttttcactgattgctttgattatcgtcttttcaatcaatgccttatcagttaaaacttttggtgaaacagagtattggttgtcagccattaaaattaccgtcgttgttttattcttgattattggcttcttatctatttttggaattatgggcggacatattgatgtcgctaaaaatctttcagttggtaatcatggatttgtcggaggacttggtagcttcacgactggtggaggaattcttggtgttctcttagttgctggtttctctttccaaggaacagagctactcggaattactgctggtgaagccgaaaatccagaaaaatcaattcccaaagccatgaactcgattttctggcgtatccttgtcttttatattttatcgatatttgtaatggcagcaatcattccattcacagacccacatttggtcggtggtaattcggcagctcaaagtccgttcacaattgtatttgaacgtgttggattttctatcgcagcctctatcatgaatgccgttgttttaacatctgttgtttctgcggccaattctggaatgtacgcctctactcgaatgctttattctttggctaaagatggtggtgcaccaaaaatcttctcaaaaacttctaaaaacgggattcctttcatcgccttgttggcaacaaccgctgttgcattgctcacattcttaacttcaatttatggggtcagcttctttactttcctagcctctgcttctggtttaactggtttcattgcttggattggaattgcgattagccatttccgcttccgtcgggcttatgttgctcaaggaaaagacgtgaaaaaacttccttatcatgctaaactcttcccatttggtccgattttagctctcattatgaccgttttagtaacgttaggtcaagacccaatgttattgtttggaaaaacttgggtgcaaggggtggtcatgtatgccgcaattccactcttctttattctttacttaggttataaatttaaaaacaaaacaaaacttattccactaaaagatgtagatttaagtcgtcataaagattaaaaaaagtcgctcaatgagcggcttttttatttattaatcattaatttcaacaactttctcaccaaaaagctctttagctaatgtaactgtttcatctattttttcgtcttcttgctcttcatcttcttgggggctctctgattttagattagacacatattctgctcgaacttcttgccaatcttgttcagcaagcgaaattatttctggagcaaaaccaataatcgaacttaagagattaccacaaaaattttgcaactcttcgttttcactgactctttttgcaagattttcatgaggaaaggtcacaacaacaaagttctctgaggcagcgactggagaggtattattaagtaaagctcggtctgccggtttagtcaccgaggcaacaagttcaggccaagcgcttaatgcagcctttctagcctcatttgttgcttcagccagagctttataaattaaatctttattaatctgtcgttttttaggcgctaccgcttttggacgttctctaacttctcgtgttaaaggattattttgagaatctgaactttcttgaacttgacctgttgaaatctgagctttcaactgattgatttctgcttttagggcagcaatttcagcacctatttcattaggaacttctgcttgcgaagctgtcagcaaatgtgtttgacccacttcggccaaacgcatagtcatgacatctgccgcaatcttcgtttgtgttgtttcctttatcgttttcaagctctcaatcgcaatatctatccaagaaaaaatttgattgcgttcatattgagcattcttatccaaaagcaaatcgcgaagataggcaagtaaatcttctgtaaaacgaagcatatttttaccttcggcaaaaatcttatccagttctgtcagcgctttttcttcgtcattttcaaaaagtgctgagacataactcactaaagcatccgccgcaattgagcctgtgacaagcaaggcgtcttcttcttccaattttcctgctgaaaaagataaggcttggtctagcaaggacaaagcatctcgcatcccgccctcagctgctttagcaatcacatcaagggctttatcttcaaattcaaccccttcgtccccaagaatttttcctaaataagtccgaatatcggccgtcgtgattgatttaaaggcaaagcgttgaactcttgagatgatggttgctggaattttttgcaattcagtcgtagccaaaacgaaaaccacattttctgtaggttcttcaagggttttcaaaagtgcattaaaggcgcctgtcgaaagcatatgcacttcatcaatgatataaactttataagttgcttgacttgccgcataagttgacttgtcgcgaatttcacgaatttcatccaccccattatttgaagcagcatcaagttcaataacatcatctaagcttccttttgtgattgaatcacaaataaaacaattattacaaggttctccatccacttgattagggcagttaattgccttggcaaaaattttagctgcagaggttttccctgttcctcttggaccagaaaaaagataagcatgtgaaatttgatgattgacaatcgcatttttaagcgtcgtcgctacaacttcttgtcccaccatttcatcaaatctctgacttcgatattttctatataatgcttgatatgccatttttctcttccaattttttacttactattctttttaaatcgccgtttagtacaaatcttgtccgaggctataatttaaatctttcaaaatttctgtcgaggcatcacgagattgaatcaattcatcaatatcttgtgactgatagtttcttaacgcctgtctgagtgcaaacattctcgctctatcaatcgttgcttgatctgcttcagcagatgcaaaaaatattttacgacttttttcgtcaaaaattgtccaggcaatcgccaaatcatatgctggatcaccactaacagctttgtcagtaatttttacattaactaattttccgtcagaaacaattaaattttgcggaatcaattcgcctaaaacccagacgggcgcttttgtccattttgtttttgcagcaaaatcgaacttttcttgcaataaatcggcagggactactttttgataaagtttcaaaagctctatcatttctgcttcaaagaaaatcaagtcagaaccagcaaaagcatttccaaaattaggtactcccgcctcttttgttggtagatgatgcaattgatacaaaaaacttcctaattcttgtgcaaattcacgagaatcaccaatgttatctggatttacagaaaatcctttttttccatcaaagcggtcagcaataaactttttaactatttcactcatttttctctccgatattcttcaaatttttgacttaacctacttcgaaaaatttaaaatcggtcatgtcacataaaatactagcaaattcttcaaggtatttttggtcaatttcatcataaaaaccaacctcagagctgtccaaatcaagaactcccaccaagttgccatctttaaccattggtaccacaatttcagacatcgcacgtccgtcacaggaaatataatttttgtgtttttttacatcttcaacaatcattgtttgacgagtttgagctgcttctccacaaactcctttacccatcacaatttcaacacaagaaactgaaccttgaaagggtcctaaaattagtttatccccattatatagataaaaaccagtgtagacttgctcaggcaagaagctccaaagcaaactacttgcatttgctaaattcgagagtgtataattttgttcactcaacagtgcttttagttgcaaattaagcaactcataaccttcgattttttcttgtttattcatcttgttgctcctcaaaaataatataactcattatatcattttttaaaggcaaattttagattagttttgatataataaaaaccatgaataaactagaagaacttcgaaacaatattgatcaagtggaccaagaaatcgttcgacttcttgaaaaacgtatgacaattgttcaagaaattagccaagaaaaacaaaagcaagaaattactattttagatgcttcacgcgaacaagccgttttggatttagcgcgaaaaaatactgaaaatcctgcttatcaagaaacaattattaatacatataaagatataatgaaaaattctcgtctctatcaaaaagaaaaacgagaaaaataaaaagttactgacaaaaattcgtcagtaatttttttataatttaaattgtccagctaaactgtctcgcaacatcatatattctaattgtggtaaatcaagtaaaatcaatttactattttctaaaaggccctgttctttcaaagcatttaaaaatcccttgatttcagtcgttcctaaataaagacactcaaccaaaacaatgtgtttttccttagtcatttgaccaataaagtgagcaaagtcttctgtcgttaaagcacggtcaatatctgagcgcccaactaccactaaatcttcatctttatccttaactattgcagccaattctttaaaaactcctgaatcgacctttgaatcatctttagtttctgcttcaatcgactcctcaatttccgcatatgcccctcggtcaatcattgcaactgtagcaatttcaccatatttcaaagtagtcagtgaatctttcaaattattaagttccatattttcctatgcaaacctactttttatcaaaagtattaggattcgcttcctttctccttttaaattcataaaacctatctcaagtttacactgactttgtgaaattttcaaaaaatctggctctttttgtaacttcaaacctgatgtaaagttttatcaataaaaaataagggccatttgctataataaaactatataacaagagagagctataaagccctttgtaacaagcgttccactgaataaaactatctttttttacgctttttactacgttcggctaaaaaaatcacaatgcttttaagatattgctgaacttttcggcagtctcttttttcttgtccttggcaaggtggctatatatatctaaggttgttgttattttagaatgtcccaaccgctcttgtatttctttagggttcacatcattattcatcaacaaactagcgtgagtgtgtctgaaaccatgcaatccgatatttgggagccttgctgattccaagtgagaagaaagacgcgctctttcgctctcataaatcaatctttgaccgtcataagaaaatactacactatcagacaaacctatcactttattatggttattttggaatttacgccaattggctaaaatttgtaaagtggtattatcaagcgaaataattctattacttcctttagttttgggactatcttgtacttctctgctctgtaaagttgtctttgttacattaacaagtttttcggagaagtctatatcagaccaattcaaagccaaagcctcaccaatacgtaaaccagtagccaataatagacgatataaggcattatgtagctggttatctatacttggctctaatgattcaagatattctaagaacattttcagctctttatcatcaaaatacttaatctttttaactgtccttgcctttaacttaggagggaaaacctttatagctgaattgtcgtttatcgctcctaattgcacaccataatcaaggatacgtttgatgatattgagcattatcttatagtttttacctttacccttttcacgtttaccactaataatcacagaggtattagcattcttagaccaatcattaacaataccttgtaataacatcggagttatttttggtaaaacgtatgtcccaatagctggtaaaatataaacttttagataatttttcactgaacgtatactgttagctttaacagtcagcttataactttcaaaccagctcaaagctaagtcctcaaagttatcaaagacgactttttcccttgcaattgtttgaccgttattgataaaatcatttataacctgatgtgctttaatttcacacatctttttgctttttgcggttacgcttgtccgcacttgcttacctgtgagattatctacacccaaataaacgttagttcggtacacctttgtaccgtctttttttatatattctttaatattcataattttttcctttcctttttgtactaatgtcaggcaaggcaatgtaaaaggattgagaaatatttttattagagcttatacgattaattaattaactggtttattagtttatagagttattaaattctatactaatatagtattatttacggtaacaagagtaacaaagtattataaagctatatatatcaacactttaagctgttaccgttctttatattaagagtaacaacaaggtaacaaggtaacaagatataagaaaataacttgatagaaaacaaactaaaaatagcttaatagagcctttttatttggcagaactacccacataattcataaagtaacgcacgcgcttcatcgtaagaattgtgatgatagccgtagaagtctaaaaagttgtatatgtttaacgtgtcgcgcgtgatgatatcaaaacggctgatgtaatcaatggcgcactctctaaaactcttattactcatatcacagcacattgatgttatgagtctttgagtagcttcatagtggcaaccagttatttcacagaactgtgttatatcatcaaagttaccgccattttttatgaacatatcccacagcattaaaatagcttctttgttggccctcttttccgcagggcttaacgtgtcgcactcgcctagtcgtctatcatctttgtgataagcgtgtatgtactcatgagcatggtcaaagggtgtggcagtgttcggattataaccaccaatgcaaagccttgtatctatccatgccctttgattatcatattcaaacattctataatctatgcttaagttttcaatcttgattactataagggcggtcaattcttcttgattcatttatcgccctcatttttcactatctttcaagtctttggctttttgttggagttcttcccaacggtcagcaaaaactaacttaatcatagctttatctttttcagtcaaaggacgaccgccagcgcttagaatgctgtcaaaaatagcgtcatcgtcagagtttgcgacttccgccaagtcaatcggctcattgattggcttagcttcagcacgccctagcagatagtccacagatacatcaaaataatcagcgattagcgtaagtttttcggctgttggttgctgattttttaatcgatacaaatagttgaccccaaagcctaagtcctcagaaactttttgtaatgattttccttgtttgtccgcaagttctttaatacgttcagatatagtcatagtcactctttcaagcataactaaaacgcaatttaaaccttatagggttttatccttgacaaaataaacctcataaggtaaaataggttcagttaaatatatatttaaaaaaagcaaagacacgttttgactagctccccagcaagttcatgaagttgtttattgctcttttaattatttatattttaccccataaggttggtaaatgcaagtatttacgacttataaagttaaaacgaaaaagaaaagaggtaaaaaaatgccactactaaccccagaaatgaaaaaagccttgcgacgcgttcaggctgataagttgctaaataaaaaagaccttgctaagtatatcggagtaagcgaaagtacagcaaagtcaatcactaaagacaacgaaccgcagaacgttaaaaataaggttttcaatgccgttgtttccgctattgctgaaaattgctagtctatgaacaaattagacacggcaatcaagcaaagcaagcagtcgaaaccgtactatcataaaatcattcttgatttactggtacaacttacgacaagcggaaaacatcgcagtctaacgagctttaaacagtcaggcgataaatcaaccgcagaacaaaaagaaacgcttaggcgctatactgacagcattatattgctgttagaaattggcatggcgtttcatgagattaaacaatttttagtaaattaacaagtccgattgggctaggaggtggaaagatgagaaaagataaaaaagagatatggatagtaatcttacttagctttacagcaagttctctagtaaatattttgctaaccatattagagtcgttgttgccgtagatacccaaataggagtaaaatatttttcccataattgttcacgataaatatttttatatcttaaacctgtactagttggagcaataatattttgtggatttatgtgttcccctaagtcaggatcatatttatcgcttgtaaagtaaacttttgctaacttgttttcaattaaaacttgatgcgataaattaccttgttcataatttagttttttggcttttactagtttatacaaatactttctatctttgccactaagttcaatcattagtattaaactcctaatatatttatttaagtcaaaaactattatacacgcagtttactactaaaacaagaaaggctctcaaatgtgggacaaaatcaaaaaagaattagacaaacaagggataaccgagtatcgccttgccaaaatgacaggcataagcccccagcagttacaccaaattaaaaaacgtaatacaaaaaatcctaaatggctcacagtcgttaagattgcggaggcattaggagttagtttagatgaatttaaatgatcatacaaaaaaagcttgacccgaccaagagacagcttttaatcaaattagagtagcaaaacgtgaaaaacacgcgctttctacctctaattataacaaattggagaataaaaacataatgaataacacagcaaacaaagaaacttatatcttagacgattcgatcgcctttgaactcatggacttattaaaagccaaagcaaggcattttatacagcttaatgagtatgtctaccgcttgtttgacggtcaatcagtagtgactttcacaactttagaaaataacattcaagtagaaatggttaaggggtaaagcatgaaatttaaaacatttgatttaagagtataccgccataatgatgaaacactgctttcatttgatatcaaaggcggacggataccattaagcaagttattacatattcccaaaggaaaaccatttaagatgaagctcactcctgaaattgttgaaaaataccgcattaagcaggaaatcaaacaaacagaatataaagggaaaagtcctgaaggtctgtatccattaattgaagccattgaaaaagatgtttctcaattgttaaataaacaagataaggacgattgggagaaatgggaacgcctttttgcttacgagtacatgtatgatgttgcggttaatcgtggtattcgccatgaaagacaacgcagaaaaacgaagcgcaaagcattgacggctttcgatgttataagcgctaatgatgtcatagaattatctaacgtgctaggaataaatgaagacagactaacgtacgcagtgctggaagttatcgctaaacgtaaaaatggaggtaaagcatgattgaagatattaatttaaaaaatgctgaggtttcagcaatcctaacaatggtttttgatgaagtacaaagaatttacggactcgaaaaaggaggtagggaatacgaattggatagattgaaagatactttaacgacgtcgttttatatgatgagtgaacgagtggaagacatcaatgaaatagctagtttgattatgaaaaaagagaagccaaaggaggcaggaagtgaatgacgacaccttaacgaaccttgttgcgcgtggcttagttgataaagtcatcagcctatttaataaatatcttggtatgcaatcaaaaatcagaaatgaaaagcgagtattaccctatatttctaaaaagcgtgtcatggaagacttagatatatcagacagaacacttgataattgggaaaagcacggattgaatcgctacaagccaagatataagacttcacttatttattatttgattgatgatatatgcaaattcatcatcatagatacatagcaacttgtcaggcaaggcaaagaggattataaaaaaatgcaaaatattgttaaaatttgcccttatgtggctggcattgatagcgtagggttgcgaagtttaaaagcctatcacacagaacttacagataagcagattgaaaaattagacccattgaacgcaaacacaggcacagttgattatagctttaaagtccgtaaatataagcacggtatccgctttgagggcgagaaagagggcggagaaatcagcttatttgatgaggtagcgaaatgatagaacaccaccaaggctacacggcaaggaaacggctagggcggaatagttttagaccagcaggcaaacacccgtttaagatgatttacaatgcacgagcggtcaaatacgacttaatacagcagtttgaagcaagtacaggcataatcttacccagcggagtgaaaagaaacttatgcacgcaatcggtgccaattttaggtaagcaactggctggcatgaaagtacagataaaggaaaataaaaaatgaaaattacaattgatgtccttgagaatgaaaacaataaggacaatttagaatatcttatcagcgatacaagcaacgaagctattactgttttaatgtttgccttgattggcgaagctagacagagagcaagctatgagcaatttttagaaaccattactagaatttgggggtatttcaatgaagataactgacttacagaaattagaccaaaacattattaaatttcttgctgaacatcgaggaattgaccgagctgtcaaaggtagaaatttagcacaaaaccttaacattgattttcgtaccttacaaggtcgcattgaatacctacacaagcaaggttgcgccattggttcgattgataacggctattttatcccaactaatgaagacgagcgcagagctggcattatcaagaaacaacgcacaggcattgcgattaataatgcagtcaacggctacacccttgcagaacttgattggattgaccaactttttaaggaggactaacaaagtgaattgttatttatgtggtaaacatctaaaagaaaatgagattatcccctatcaagaacggcagatttgtgatgaatgcgagtatcgtttggaggttgactattgacagaattagaagcacaacgcaaagcgtgggaacgattagaaaataatcataatcgcgtgctggcgttaccgtgggaagagttcgaccatattgacagtgccaaaataccaagagcacttgattttatacatgttttacaccgtgatgaatttgaatatccttatctgtcagttaaaacagccgagggaaaaatcagaattaaacgccctacctttcatattaataatggactgaaccatttctcactcttttatggcagaataaaagcaaataaagacgaaacagagacatcaatttcagaagaatcaaatgtgccaagatatgttcatgctattatggactatctcgcaggaacaatcgccatttataaagaatgtttctatttgattaatgatgatgaactcgtattactttcacaaatgaaactatcagaacgttatcgactatcaaaccgtagtacctttgatgttggagcagttgaagaaatattgttatttattcatgaacacttacagcttgaacccataaaagccataaaaacggcggttatcgcttgtaatgattttcaaatggatttacacactaaaaacatcttagttgataccctgccggatgaaaaggagtgctattttaaacgttatgagtgtaattataatgatgtgatgaagattgtaaccacttatggcagttacttagatatggttattgatgataaagatagcttacacaatgcgagcttacagccgatttataccatgttagtcgcgtgtcgtgagggaaccaaagcaaaattctttgtaagtaagtccgcagagcgtacaggcaaaggattaaggcacaaggttatttcagccccattcatcacgaaagatatactgcttgataatttaggcggtggcggttttgaagccttaaacgcatgggcacagttggacggtggcgagttcttactagcaactgaacaaggcgacatcacaggtaaagccatggagcgcgctttgaaagtcattgcgaccgaggatacccaccaagcacgacaaacaggcggaaacaccaacaatgttaatctcacaggggtgctgtctattgatagtaacgccaaaatcttactcgatgagggaatgaactcacgcgcagtaaatatcgcttttcggaatcgcccagcacaagaaagtgataacgaacgtgaacagattttttctgaatactgggaggcgtttaccatacaaacggcaactagtaccagcagaacagctaaaataagcgcaggggtggcaagtttagtccatagttttttatattggaagtctgagaaattcaagtttaattttaagattgtagaaatgaacaacttactcgataacagtatgcttgatgacgttcaggagcgcgtgcttgaaatttacacacagggcaaccctatcatttactttgagcatttccccgatattttgccactactggcagaaacttatgcaggggcaggcaagaaagacaagcggaataaagcgctggaatttatcggttttaaacaagtcaataagagagtgattaataacgatggttcaggatataccagtaaaaaggcttttgttataagaaactctaaacgagtaagacagattacaacggcttatcttgaaaacaagatgagagacaaccaattatagcaaaaacggtattatgaataccgatttaataccgttttgaaatagctataaaccccagtaatataggaaataataccgataataccaataatactgatttatagaggggttaattatttttgttaaatataacaaattataaaactataccaattagccactgaaaatattaaatatattggggggaggtaaaaacggtattttgcgtattatcggtattaaattgagtaaaaaaaagggtttataggtggtattaaaacggtattattttatgtcaaaacagtattattttgcttgtttttgataaaatcactagaaaagttaaagaattcctagaaaaacatataccaaaaaacaactataccaattgcaaaaggaataaaacatgaaaaaagcacgctgtccgacaaaatttatttactgacagaacctaacctaaaaatagaaaccggagaaaataaaatgagccaaaatacaaaaacaatcttatctaacctttttacacttacaagtgaactttcagaaccaaattcaaaacttattcatattgagggagcaaacgaaacgccagccactcaaaaagacttagcgaaaggattgcatgagaacctcatcaaccttactgaagttttgggcttatctgtggacgaactgacagcaccgcaagagtatgaaccacaggaaacagtaaaatcaattattgaggaaatgcaacaactgacctttgcacctcatgaaatatcaggcaatgacacgcaagtttttgcggacttacttactgatagtatcgagcgtttaattaaagcgttaggattgaatgacatgagcctttcggcagagagtaaaaacaaaccgcatgaattggcactcaaagcacagttacaagacttgcacgcgctcaatcattccatgtttaaagatgatatccacgaagtgccacggttcacagacggtacaatcatcacagccaaagacttagcagatatgaatatcaacgctttagataatatcgcagagttaattggctttgaattagaagaataaataaaaatgcctagtcaatgactgggcttttagtcgttatgtggaaataaaaacttgtcaaaacttgtcattttattttgctataatcaagacaagatatacaaacagaaaggagtgaagatgacaccaaaacaacagaaattttgtgatgaatatattaaaacaggaaacgccacacagtcggctattaatgcaggatatagcaagaaaacagcgaagtcgataggagccgaaaacctgactaaacctgacttaaaaaaatacattgatagcaagttaaaagacatttcaaacaacgccatagcaaccgcagaggaaaccttgggcatattaactaagatagtacgcggagagcatacagagcaagtgataacagcagagggtgatgtcatagacaaacaccctgacactaatcaaatcattagagcaagttctgaaatcttaaaacgttacccacttgtacaagatattaatatcaacggaaacttgagtgttagcaacccttttgaaaatctaacagaggaagaacttagaatcttagcaagcagagatgaggaataatgacagtaagatattattggggtaagcccaaagacattataaggtggtatcttagaggaacgttataccttagcgctcaaagcaggcagtcttatattgaaaagactggcgctgatccaggcaacttaccaagacttctaaaactattagataatcttgatgagctatttgattcagtcgatactgacagcatagctgtattatgcttgaggtatgtagagctattaagtatcgcagagactacaaaacgtacaggactattagcttatcagattacagctaagacaggtaaggtcatgaagaaagctaaggaaattatagccaaagcatgatataatagaactatcaaaagtcgcagaaatgcgcgtggtataatatagtgcaaaaaagtatctctttttccaaggagtgcttttttgtattcctaaaatttaggactgtgatatattttatcagttgcagaatatgattcataaataattatcaaacttgaggtttatactaaaggattttaatgactaaaaaaaataatagcaattacttcaaagcttttgggtcaaagaaagaaaaaaacaaacagcataaacaaaaaatcgagtcatgtatagtttgtttgaatggaggaaagtgcaaagtatgaaaaaggttgatgggttaaataagaaaaaaggaaatgatattttttatatcaattttaaataaaaaagttggaatttatataggtattttgataaaatacctatataggtaactattttattgaagaaaaggttataaaatgattcagaaactaaaatctattattattgaaaatataaaaaatgtaaagtacggagaaatttattttgaaacgtctgaaggttttttaaatactacagggatttacggacaaaatggttcaggtaaaacaactgtaatagatgtccttgaaatgatcaaagaattgatacaaggtaaaaaattagggagtaaatattcagggcttattgactttgaggaaattagcaaagtaagaattgaaacagaaattctaaacgaatctattaatagatacgaaattgtatttaaaaaagttaatatagagggaaaagatagtattgaaatattatcagagaccttgtctaagaaattaaacaaaaaatatcaaaaatttaaaactattattgaatttttatcaagggaaaaaactatcagttttcatactctgtcgaaatttgaacttagtgaagatgcattaaaaattttaaagtcagttagtatggaaaatcagagttcttttatatttcaacaaaatttattaaaaaatcttaatgatttttctagagcagattatgaaaaaaagatattagatgaatttaaatcatttgcaaataatttacgtatatatacttcagaatatggtggattaatttctgcaaatttcatggcgcctgtaagcatctattattctgaacaagatagcacatataatggtatagtaccggttccattgggtcctcagggatatctatcaaatagatttattaatatttataaacatatactcccacaaatgaatgttcttttaaaacaaatagttccagggataactattggatatgatgttagagatacaagattgggtgaatctggtcaagatgagcatagggttgagttttactctacaagagatggcaaaaaattctcgttgcgttatgaatcagatggtattaaaaaaataattgctttacttaattttttgattgaagtctataatgatccaaatattattgttgctatcgatgaacttgattcaggaatttttgaatttctacttggggaaatagtaagtgtaatatctacaggatctaagggacaagtgatttttacatctcacaatttacgtgtactcgaagtgctaccgaagaacaaagtagtgttttcaactactaatccatcaaatcgctatattcgtttaaaaggtgttaagactacaaataatttaagagatttttacattcgatcattattagtaggaggacaagaagaagaactttatatatctaaaaatgcatctaacattaggagagccctgaagaaagcagggcaaaaaaatgactaaaaaaataattcttgtttttgttgagggtgtttctgatgatactgtttttaactttctactagaaaatatttgtaatcaacaaaagtacaaaacagaaataataggaggcgatcctttttctgataatgaaaatatcaggaaagggggaaaaacaattgttaatgaagcagtcaaaggctacctaagtaagaataaactaaaagcaaaagatattgaatatgttgcttttataaccgatgcggatggcataaatattccaaggagagatttcataatagaagaagttcatgctatggaatctaactatatttatgatttagataacggaattgttaaatcaaaaaacttaagatgtcggactaatatactaagttcttgggaaagaaaaaatgaaaagttatgtcctttaatgtgtgatggtgttacaacaagggttaattcttataatatccctattggtctttattttaattctgtgaacttagaacatgttactcaagggaaaatattaccttgggataaaaaagacgatgcagctgatgaccttatagatcaatacgaaaacaatattgaggggttatttcaaatttttaaagataaaacaatttccgacaatttgaaagattcatgggaagctttgaaagagtcggaatggagagttccttactcaaatgttaatatactatttgagaaaataagacaaattaacgaaggttaaataaaaaatacctcttgagaacttgcctaattatggttctcacttttacgtacagcggcatatatagtgtaatagagcatcttctaattagaggtgcttttttgtttgtttttatccatatatcaaagcacagcacgcgcgtgaggttgattgaatataatttaccgcaaaacatattaaaagctcacagacagcaaactatgggctgtcggttaggtatccccccacttagacaaaaagagcaaattttgataaaatagtcttagaattaaattaaaaagggaggccaaatataatgaaaaatatgaatgacaatgatgttatctttgaccaacgaagcgacggattgaatgcattttttagtaagatttatgcattgatgggagcaggagtattagtttctgcattagtttcttggatcatgattacatttttcttagataacatgagagcaattctccaaagtggaagtttattcttccttgtactctggattattccattagtgatggtggtatcacttcaaggtttagcaatgaaaaactcaaaaatggcattaccgatttttatcggatatgcagcatttatgggattcttgattagcttcactcttttgatgtataccgcaactgatattaccttagcttttattacagcatcagcaatgttctttggtttatctgtttatggacgatttactaaacgtaatttatctggtatgggtaaagctttgggtgtcgcagtttggggcttgattgtcgcaatgttgcttaatctcttctttgctagtaccggacttacaatccttattagcctagtaggtgttgtgattttctcaggtttgattgcttgggataatcaaaaaattacacaagtttataatgcacacaatggacaagtgagtgatggttgggcaatttcaatggcactttcactttaccttgattttatcaacatgttcctcttcctgctccgtcttttcggtatcgcaggtggaaatcgcgattaaaaataaaaattactgacaaaaattctgtcagtaaaaataataataaaagctctgctatcagcagagcttttttattttataaatccttaacaatcacatagttaatttttagaggaccgtgaaggccgactacaagttgcatttcaatatctccagaatttgaaggaccagaaataaagtgaatagtggaaccaggcttcttatttttatcaaaccagtcagcagcttgagtaaaacgaggcaacatccgacttaatggaatcacagaaatataatgcgtaggtagaaaatgcaatgaccgcccctgaccggcttcagactcgaccacgatggttgccgattcagcaaggaaaaatttgggaacagctacaacaacattagaattttgagcggctgtgatattttcatcacgaaattctttgccgattttccatttcaccaagttttcagagttaacatttacccctaaatttttaaatttatctgttgtaggaatcatgacttgtccaccaccagatttttcaattaattgacgaatgacttcattcatttcagaagaagttgtttcaactaaatttgcggagactcgttcggattgaaccttggaaatttctaacaattcatcagaagtcaaatcagctaaatgagtctcaggcaaatctgaaattggcacataaggctcaaagggaagttccacaccgccacttttttcaaacaaagtttccaagaattttgtacgattttcaatagttccagtcatttttatttacctgccttatgttttttataccactgacggaattgatctttgtgcggaggggcaattggtaaatcgcgcacatccgtccaacctttggctaatgctggcgcttttctgaccgcaccatattcaaaaattgaaccttcgacagtgacttctttagctttaggtaagacattcagacccgtatgcgccatattgatagccatgccaaacaaagctggacatctcgttcctctcccaatcgtattcatttcaaaattaacaaaagatccgtcatgatgcatattgagatcatcttccatgaccttacgatgttcaatcaaaagttcatgcaaaggaattttgacaggacaagtttcggtacaagccccacaaagcgttgaggcgtaaggtaaattgccatattgctcataaccacccaaaacaggcgataagacagaaccgattggtcctggataaatcgaaccataagcatgtccaccaatttgacgatagactgggcaaacattcagacaagccccacagcggatacattgtaaaacagcttcaaaagcagtcccaatcgcatttgagcgtccattatcaacaataacaacatgaaagtcctcaggaccgtcagactcatcatcagcctgctgaccagcaaaagtgacataagtcgtcagtttttggccaacggcagaacgagccagcatattatccaaaatttcggcttctttgatagagggaacaattctttccattcccatcagaacaatttgtgtcttaggaattgaaatcgttaaatcagcatttccttcattggtagacagattaatatcgcccgtattggcaatggcaaagttacaaccggtaattccgacttcagattttaagaaaagcttacgcatggtatctctagcacagcgagccaaattaactggattattgtctccttcatatcccaattttttagcaaatatttcgcggatttggtcgcggtttttgtgcaaagctggaaaaacaatatgtgaaggctcatcccagtcggctacttacaaaataaattcggcaaggtcggtttctaaaatatccatatcgtcagccagtgagaccaacattggatcaatatccacttcggtagtcaccatcgattttgatttgacaatcttttttgcatttttttcaagaacaatgcgtttaacataatcattggcttctttagcatcagcagcaaagaagacgtgaccaccacgagcggccacattatctgaaaactctgtcagataatggggtagatatttcaaagtatgttgacgaattgattctgcgatattgcgccattcctgccaattacctagttcatcacgtgctgattctctcttgtcccattgggcatcttgtgcttttgctaccgcggccttggcaaattggtcttttttactttcttctaaacgttcagcgaaagtttttgtacttgttgaaagtcccattttctccccctatgctcttatgaattctggatttttcacagtatcgattcgttccaaatcaacatttgtgtttaaaatttcggcgatatgcatcactcttatttttttgccttcacgatttagttttccagcaatattcatcaaacaaccaaggtcggcagatattaaaatttcagcacctgttgataagatatcatttgttttttcagtgaccatcatttccgaaatttcaggagatttaactgagaaagttccaccaaaaccacaacaattttctaaatgaggaagaggtagaacttcaagacctttcactttatctaataagataaatggcgcttctcgttcgcctaagattcttgtcatgtggcaagaacgatgataagtggccttttcaccgttaaaagttgcgccaaggtcctcaagacctaggacacggtaaataaattgggtaaattcataagatttattggccaaatcaatggctttttgcttataagggtcaccttcatcaaacatatgaggatattctgtaaacatccctgagcaagaaccagcaataccaacaacataatcagaagattcaaaggcatcaatctgatttttgattgttggcatagattctttgactaagccagaattataagtgggctgtccacagcaaatttgtccttctggtaaatctgtttcaatccctaaacgttcaaggacttcaaccattgcaattccaacttgtggaaacattaggtccatcacacaagtggagaatattgaaactttcataagtgctccttagtattttgaaatctttgttaaatattggacattttctagagatgtatgctctttcattataagccgattcatttacattttcaaaaaatggagctgtcaaaagaatttgacagactgttgtttattgggatagattaaaaaaataccagtcagagactggtataagcatcatttattgggagttaaaaagagtttttcgagttgtctagccaccccatcctcatcatttgtccaaggaagaatttcactggcgtaaggagtgagcctagcagaagcatttttcatagcataggcttgaggtgcaagtttaaacatctcaatatcattatgttcatcaccaaaagcaataagattttctagcgggatatcaagaactttaagaaggtgattaaggcctgaagctttagagattcctttagggacgacttctaaaattccatttggaccaccccaaacgcccacatctattttgccattataatgacgtttcatttcctcagccaagcctaatttatctttttgacgagtcgaaagaagtaccgcgtggggattttcggtaactcggtctgcccggagacggttatagggctggaatttttctacaccaaaaagtttaggttcaacgttacggaaagtgtttagaaagaactttctacgatattcaacagcaaaaaaatgtagattaaagttttgctgatgacgcagaaggtcaaaaataaaagaacggtcaatataataagacttagtgtgttcccagtttttatcatttggcattgaaatcaaagcaccattaaaattgatgaccgggctagtcaactcaagctcacgataaacatccaaagacattctaaaaggacgtccagttgtgatgcaaataatatgtccaagtgattctacctgtttaaaaatatatttggtataacggctgattgaacgtccatcggactgcaaagtagtaccatctaaatcaatcgcaatcagtttacgttctttgtagttctccattcaaactccccttagtctaaaatttagttatcaatttattcattataacatagatataagctggaaaggaattacccaagttctacgaacaagaaagggcttttcaaaaaattcgttcgttattaccgaacgatttaaggatttgaagtaatttttctactaaaaatcttgtttccttaatcaaaactgattagaataataatataatgttttttattttatgacgtgcttgctttttaagcaaagacaactttttatcaaagggttgaaattttaatcttagaccctaaaaggagaaattattcgtgaacaagttctttaaacttgaagaaaacggcacaacagttggccgtgaaataatggctggattgactacattctttgccatgagttatatcctctttgttaacccacaagttttggggacaacagggatgcctgtccaagcagttttcttagcaactattttagcttctattgttgggacacttgcaattgctttaatcgctaatgttccttacgctctggctcccggaatgggcttaaatgctttctttgcttacacggttgtattgtcacttggttacacttggcaagaggccttggcaatggtcttcatttgtgggataatcaatattatcatcacttttacttcaattcgtaaagcaatcattcttggaattccagaaagcttgcaacatgccattggtggtgggattgggattttcattgcctacatcgggattaaaaacgctggaattttgcgcttcatcgctgacccaggaacttatgtgaacaatcacggaacaattacagcaaattcatcaattgttccagagcttgtaacttttaataacccaggagtattggtagcacttgttgggattgtcgtgacaatgttctttgttattcgtaaatggcgcgcaggtattttgctttcaatcttagtaacaactatcttggctcttttgactggcgtggttaaagttgatgtgaatactttatttgctgaaaataatttggggactgcaatcaatcaaatgggaacaacctttggtgcagcatttggtccaaaaggatttggttctttattctctgattcatcacgttatattgaagtattaatgacagttcttgctttctcattgacttcaatctttgacccaatcgggactttcatcggaactggtcgtgcgacaggaatctttactgatgaagatttgaaagacatggaaacaagccatggtttctcatcaaaaatggacaaagctttgtttgctgacatgattgctactccaatcggagcaattttcggaacatcaaatacaaccgtttatgttgagtctgctgccggaatcggtgcaggaggacgtactggtcttgcatcagttgtaacagcaattatgtttgctatctcaagcttgttcttgccacttcttgcgattgttccaacacaagcaacagcaccaattttgattatcgttgggatgatgatgcttggttcatttaaagaaattaaatggggtgatttgacagaagcgattcctgctttcttcgcctcagtattcatgggacttgcttattcaatctcttatgggattgcagctggatttatcacttatatccttgtcaaattattcaccggaaaagtgaaagaaattaaacctgtaatttgggtcgttgctctcttgttcttaattaactttgcagtattggctgtcttataaacaataaaaactcatcaaaaatatttgatgagttttcttattaaaatttgtagattacaatattagaagtgtgagtattattttaaataaaacaaatctattagttatttgaatgtggtaaaattcaaattttgagaaagaaaaataggatattaaaaataaaaataataaattgggaatatttaataaattgtggtaaaatcaaatcatgaaaaaatcatttctcttatcgtgagttttattgcagtctttgttatcggtatcttcattggtcactctattcttccgccacacccacttgtagcagcaaaagaccgtcctatttatccgacgatttatattactggctcaagtggctatgcgtcaacgatggatacaatgattaatagtgttactgcggacaaagataccctgctaaaaaagggctgacaattgttgttgacacagaacacaattattcactcaaagtgactggaacaattgacaaacgtaatgcctatccgacaattgaggtcggaatggtcaaaggaacgaataattccgataaatatgaagcctcattaatggctatcatgtcttatctcggtaagcattataacgttgcttatgccaacgttttgggctattcagctggtggcggtggtgtttacaattatttgattgaccatggttatgaccgaagccttccgccgattaaaaagtttgtttctcttgatggtcagtacaatgcttgtacggcacagcctgaccaaacgcttgcacaagttcttgctgacggacccaaaattaaaacaaaatattatgatttttggttgaaaaattatgaacgtgtggataaaaatatccaagttgtgctactagaaggagcttatgatactaagaaagaaaccgacggtacagttccttgggctgacggcttctcaatttatcctttgctgataaaaaatggaaactctgctactcattatctaatagaaggaacaaacaccgagcatacggaaatgccaagcaatcaaaaagcaattggctatgtcaaaaccttcttttatgaataagctttatttaaaaatgataaattgtctctatttgggggacaatttttttataatgtatttactataaaatgacagatagtcagcaaaatacttcatttaaatcatagagcctgatgtattgacagttggctttaagtaacggtataatgaaattatggatttgaaaaatggaatatttatttttggaacagttctgacaatattttttgcaggactgactactattttctggtggaaaatcagaaagttgaaagatttacggaccttacgattggggcgcttatccttttttgccctactttttttgtgggtgacgataaatggaattattggttctggattagccttgacagaattacaacaaaaagtactactttggctactttttaccgaagcttttataatattattattgataccaatgacaataggaattgttgtttccattagtattgttgttttaacgattaaaatgtggcgaagagagtcaaaatccattggtaatcttttattgcctattgttgttttggcatttttactaattgactgggtttatctgtctatgggaagactaccagatagttggatttggttgaagattttaggaattgtttatccagtcctatcaatttatttggcttggcagtttggtattttctttttatcaagttgggtttatggacgacgcgttcgaaaacaaagagcagcctatcatgttgtcttaggggcaggtcttattcaaggagagcatgttggaaaattattaggaaatcgaattttagcagcagtcaaagccgtgcgagataatgaaactattttggttttttcaggcggacaaggtccagatgaaaaactttcagaagcgagagccatgcaaaaatatgcagtagaagtgctcggctttccaattgagcgaactatgcttgaagaccaatctagaacgacatatgaaaacttggttttttcttctcgcctaattaaagaaaaatttatgtttttcacttccgattatcatgtgtttcgggcggcactttttgcagcaactttaaaaattgatgctcaaggaggaaaaggaggaaaaacagcgatgtattatcgtgttcccgcctttattcgtgaatttattgcagttatgaattatgaaaagagaaaacatattaaatgggtgggaatcattgttgcttttttctttgttattgctatcttttcgcaaatcggttatctttggaataatagataatagtaaaaagttactgacagactagttagtaactttttttgtgacaaaattatatttttttcgtataaaatattatgctgacagcaattgatgaaaataataaaataataaacttactggaattagaacgcaaagaattgaccgggaaattttattgtccttcttgtcatgcagagctacttattaaaaatgggcagataaaagttcttcattttgcccataaatctctaaagagctgcaatttatggttggaaaatgagtcagaacagcatttaggtttgaaaaaaatattatatcagtggtttaaaaggactgacaaagtcgaaattgaacgctatttgcccgaacttaaccaaagaccagatttattagtaaatgacaaaatcgctattgagatacaatgctctcatttatctattaagcgcctcaaagaacgtacagaaaattataaggcgcatggctttaaagtgctttggttgatgggaaaggatttatggctggctgaacaggtgacaaaacttcaaaaaaatttagtttatttctcggaaaatagaggattcttttattgggagttagattttcagaggaaaaaattaagattaaaatctcttattcatgaggatttacgcggcagaatcatttgcttacaagaggaaattccttttggaaaaggacgacttattgcgcatctacgcttaccttatttggcgcaaaaactggtgaaaattcctacttttaaagatcctaaactttctagttttattcgtcagcaattatactatcaatcaccaaaatggatgaaaattcaagaaaaatattatcaaaaaggagaaaatttactgacgaaaaaatttgaaggtccatacattgctccactaggtttaaatttactagagagttttactgacgaaatgacgatcacaacttttactcagattgatcaaaatgttaagctttactatgaaaattttttaataaatttccaaagaaatagccttgaaatgctctatcctccctgtttctatgctataatgggaaagcagaagaaggaaaaataataggattttattattttattttattctcattattataagaaataagagttttaagctaaaaaggagtaccaattatggtaaaaaatagaaatgaaatccctgaagccttgacttgggatttgacaacaattttttcaacagatcaaaaatgggaaacagaattagagaaggtaaaaaaagagctttcgcttgttgagacaaatgataaaggtcatttacttgattcagcagaaactttactgacaattactaaaaatatgctatcaatttctcaaaaagttgaaaagctttatgtttatgcttcaatgaaaaatgatcaagatacaagagaagcaaagtatcaagaatatcaatcaaaagcaacggccctctatgttaattttggggaaagctatgccttttatgaacctgagtttttaaaaattacaaaagaaacctacgaacaatggttagaaatccttcaggaattgaaaaattacgatcacatgtttgaacgtttatttgctaaaaaagaacatatccttagtcaaaaagaagaaaaaatattggcggcagcgggtgaaatctttgaaagtccttcggagacttttgaaattttcgataatgcagatgttaaatttccttttgttaaaaatgaattgggagaaaagattcagttgacacatggaaattatagctctcttatggaaagtaaaaacagggaagtaagaaaagcggcttatgaagcactttacagcaattatgaacaatatcagcatacctatgcaaaaactttgcagaccaatgtaaaagttcataatttcaatgcccaaatacgcgcatatgattcagcacgtcaggcagctttgatgagtaattttgttccagaaaaagtttatgacgtcttgatagaaggcattcatcaacacttaccacttttacatcgctatattgaattacgtaaaaaaatcttaggaatttctgatttcaagatgtatgatatctatactccattatctaatttagattataaattcaattacactgaaggagttaagaaagcgcaagaagtgcttgcaatttttggtgaagagtatagtcagaaagttaaagcggcttttgatgaacgttggattgatgttgaagaaaatgtcgggaaacggtcaggggcatactcaggtggttcttatgataccaaggcattcatgttactcaattggcaagggacattggacgatctttttacattggttcatgagatggggcattctattcacagcacttttacgagggaaaatcaaccttatgtttatggagattacccaatcttcttagcagagattgcttcaactaccaatgaaaatattttaactgagactttgctcaaagaaagcaatgatgaaaaggaacgttttgctcttttgaaccattggttagatagttttcgaggaaccgtatttcgtcaaagtcaatttgctgaatttgaacaaaaaattcacgaagtcgatgctgaaggtgaagtattgacgagcgaatttttgaattctctttatggcgaacttaatgaaaaatattatggcttatctgccaaagaaaatcctgaaattcagtttgaatgggcaagaattccgcatttctattataatttttacgtttttcaatacgcaacaggctttgccgcagcctcatttctagctgaaaaagtggtgcatggttcggctactgaccgccaaaattatcttgattatttaaaagctggttcatcagcctatccactagacgtgattgcaaaagctggagttaatatggaatctacagattacttagagtctgcttttaagctttttgaaaaacgtttgaatgaattagaaaaattagttgaaaaaggagtccatctttaaaaatggttgaaacatataagagcacaagtaaccccatgatgaatcgaccagttgtcaaagctgagttagtcgaatggatgcgttcaagtcaaacacaagtgactggagaacttgcagaagtcctaaactttgctaaagaaaataacattcctattattccacatgaaacagttctctattttcaaatgctattgagtctgctcaagcctaaaagaattctggaaattggtacagctattggtttttcagccttagtaatggcacaagaagttccagaagctgagattgtgaccatcgatcgtaatcctgaaatgattgagctagccaagaaaaatttaactaaatacgatcaccgcaatcaaattcagcttaaagaaggagatgctgcagatgttttgcaagaattaaaaggtccatttgatcttgttttcatggattcagccaagtcgaaatatgttgaattcttacctaaatcacttgaattgctttcagaaaatggccttatcctaatggatgatgtttttcaagctggtgaaatattgttgccaatcatggaagttaaaagaaatcaacgagctttggaacgaggcttaagaaaactttttgatgaagtttttgataatcctaaatatatgaccagcgttcttccgctaggtgatggattattaatgataaaaaaagcataaaaattgctgatataagtctcagtaattttagaaagtttttttgcataaataaagctttctttaattttttatgatataattacaacaacttaaaaataaaagtgtgtttttagtacaaaaagctacaaacaacgaatgatgcgaaggagaatatcttgaaattcaaaaaactcggattagttatggctacagtctttgccggagccgcattggtaaccttgtctggttgctcaagcagtgattcagcaagcaaggatatcatcacaatgaaaggtgataccattcgcgtttctgatttatacaaggaagctaaacaattcccgtcacaaccgacaaatactttgcttcaaaatttaacctttgataaaatttttactaaagattttggaaaagaagttactgataaagatgtcaacaaaaaagttaaatctctcaaagatcagtatggaagccaatttgcctcagctttgcaacaacaaggtttgacagaagcaagtttcacaccatacatgcgtacacaaatgcttgagcaagcagcaattgaccacgaaatcgaagcaacgcaatataccgatgccaatctcaaaaaagcttgggaatcttatcatccagatgtaacagcttatgttgtttctgaaacttcaaaagatgcagcgactaaagctttagctgctaaaaaagatgatgctggtaaagcaagctttgagaaaacaaatgctgcaagtaaagtcacttttaattcaacatcaacaactgtgccaactgaggttcaaactgcagcatttaagttgaaaaatggtgaattttcaagcgtaattgaatatactagtgcatcaactggggctacttcttactacattgttgagatggttaaatcttctgaaaaaggtagtgacatgaacaagtataaaaaagaacttaaaaatgtcattaaagctgaaaaagaacaagatacaacctttgtcagcggagttattgctaagtaccttaaaaagaataatgtcactgtgaaagaatctgcttttgcatcaatcttctcacaattcactcaaacatcaagtacatcttcatctaaataatttaataaaaatcaactttaaagagagctcaaaatggtgagaatgagcaagttgataaaagtgcttacagcagagagaactgctctaacaaccaaagtaagatgatagaaattctatcgtgaataagggtggtaccgcggtataactgtatgcgcccctttgtttacggtagaattttattattttattgtgaaaacattaacaaagtatacaagataagtttattgctaagctataaactttttataaaaggagaaaataatgaaaactatgacttccgcagaagttcgccaaatgttcctcgactttttcaaatcaaaaggtcatactgttgaaccttcgcaaagtcttgttcctgtgaatgacccaactttgctttggattaattcaggagtagcaacactaaaaaaatattttgatggttcagtcgttcctgaaaatccaagattgactaatgctcaaaaagcgattcggacaaatgatattgaaaatgtcggaaaaactgcccgtcatcacaccatgtttgaaatgcttggaaatttttcaattggtgattatttccgtaatgaagcgattgcttttgcttgggaattattgacaagttctgaatggtttgagtttccagcagaaaaactttatatcacttattatccagctgataaagatacctataatcgctgggttgaagttggagttgatccaacacatcttgtcccaattgaagataatttctgggaaattggtgctggtccttcaggtccagatacagaaatattctttgaccgtggggagatttacgacccagaacatgttggtttgaaattattggctgaagatattgaaaatgaccgttatatcgagatttggaatattgttttgtcacaatttaatgcgaatccagcgattccacgttcggaatatcctgaattaccacagaaaaatattgatacgggaatggggcttgaacggatggtctgcattattcaaggtggtaaaacaaactttgatacagacctattcttgccaattattcgcgaaattgagaaactctctggaataacttacagtccagacagtgaaaatatgagtttcaaagtgattgctgaccatattcgctcactttcatttgctattggggatggtgctttgccaggaaatgaagggcgtggttatgttttgcgtcgtttacttcgtcgcgcggttatgcacggtaaaaaattgggaattcaaggtaaatttttagcttcactcgtgccaactgttggtaaaatcatgcaatcttattatccagaagttctcgaaaaagaagatttcatcatgcaaattattgaccgtgaagaagaaactttcaatcggacgattgatgcaggtcaaaaattgattgatgagcttttggtaaatcttaaggctgaaggtaaagatagaattgaaggggctgatattttccgcctctacgatacatatggattccctgtcgaattaaccgaagaattggcagaagatgaaggattcaaaattgaccatgaaggattcaaagtagctatgaaagctcaacaagaccgtgcgcgtgcggctgtggttaagggtggttcaatgggtgctcaaaatgaaactttgtcttctatcgaagtggactcaaaattcctttatgaagataaaaaatcccaagcaaaattactcgtggctataaaagatgatgagcttgttgatgaagttactggcaaagctcaattagtatttgatgtgacgcctttctatgctgaaatgggtggtcaagtggctgaccatggagtcattaaaaatgctgatggtcaagaggtggcaactgtattagatgttcaacatgcaccacatggacaaaatcttcattctgtggaaactacctcaccacttaaagttggggaaacttatactttagaaattgatgaagaacgtcgttctgctgttgtgaaaaaccatacagcgactcacttacttcatgctgctttgcataatattgttgggaatcatgcactacaagctggttcacttaatgaagtggaattcttgcgctttgacttcactcactttgctcaagtaaccaaagaagagttggctgaaattgagcgtcaagttaatgaagtgatttggcaatcattgaaagttgaaacgattgaaaccgatattgccacagcaaaagaaatgggtgcaatggctcttttcggtgaaaaatatggtaaaaatgttcgtgttgtaaaaattggagattattcaatcgaactttgtggaggaacacatacgcaaacaacttctcaaattggtcttttcaagattattaaagaagaaggaattggttctggtgtgcgccggattattgctgtgacaggtcaaaaagcttatgaagctttcaaagatgctgaaaatactttgagcgaagtggctggattggttaaagcaccacaagcttcacaaatcgtcgcaaaagtttctaacttacaagatgaacttaaagcagctcaaaaagaaaatgatgctttagctggtaaacttgcagcgagccaatcagatgaaatcttcaaaaatgtacaaagagctggttctgtaagctttattgcgagtcaagtcactgttccagatgccaatggcttacgtaatttggcagatatttggaaacaaaaagaattgtcagatgtcctcgttttagtcgctacaattggtgaaaaagtaagtcttttagtggcttctaaatcgtcagatgtaaaagcgggtaatttagttaaagaattagcaccatttgttgatggtcgtggtggtggaaaaccagatatggctatggccggtggttcaaatgcagcaggaattcctgaacttttgacagctgttgctgaaaaattaggataagacaagaatatcgtagatcatctacgatattttttcttttttggtcagcaagtatttgtgataaaatgagaaaaatacttgaaagagaagtctaaaatgaagatagcgatttttggggattctatcacaaatggatttggtatggacgaaggaggatcatcaaatattctggcaagattaattgagaaaaaagagccagatgttaaagttttgcttcatggaatcaatggagatgatacttacggaggacttcttcgactaaaatatgttgttgaggaaaaagctgatttaaatttcattttctttggggcaaatgatgcttcaccttatcatttgattcggacaaaagaatttcaggataatttagagcaaatgattgcacaactggatgcaaaaagaacagttctaattactcctccgttttataatgatgacgaaccgacgcattatagtcggctgtctgaggttgaactttttagacaggcaacaattgatttggcaaaagaaaaatcgctcaagttgattgatatttaccaggtcatgttggaacaagaaaacccaaaagccttgttaagagttgatggtttacattttactttagaagcttaccagcttttggttgagaaaattttggctgcgataaaaaattttattcaataatttctacaaaatcattggtagggtaacgccgatggggataacctgcttttaagggtttaccaagaggtagcattaggataggttcaagattttgaggaatatttaaaaattccattattttttggaaatcagtaccgcgcataggattagactcgtagccaaattctctgattgtatgcatcagattcatggcaaaaagtccgttatcaaatctgagcccttcgttacagatatcctcgggatgaagttttagataagtatgtactcgactagttttttctgtcagctgattttctgaaatgatgtgattttctaaattgaatttcataattttttgaatatcgtagttacttttgtcgccaaaaattagaaatactgcggaggcatcggcaatttgttgttgcttgaaagaaatatttttcaagatttcttgtttttccttatttttgacaacgaagactttccaaggttggaaattatttcctgaaggggcattagccgcatggctaagaatatccataatttcttggttgctgatttgtgctgtgggatcaaaagttctgacggatttgcgtccatctaaaaagtctaattgtgtcattcttgttctccttgatttattgatggagttattataatataatagaatataaaaagatagtacgcacttttttgttactgtaaaaatgttaaggagcacaaatggatcaagaatgtggtgtgagtaaagtcatggatatttttgggggaaaatggaaattaaaaattctttggataatatgtaatcatgaggggattcgttttaatcaattgcgaagagaagttaacggaattactaatgtgatgttgacgaggtctttagagcttttgatggaacacgatttggttatccgcaaagattttcagaccattccaccacatgttgaatattatttgaccaaaaaaggagaagatttagtaccttttatgcagcaactagatctttgggggcgagaaaatctgtaattgcctaacatttttgtggtcttatggtaaaattaaattaagagattcttggggaatgataaatatggtaaaaaatacagaagataagccgctagctcagaataaaaaagcacggcatgattatgaaatttatgagacttttgaggcgggaattgtgctgacaggaacggagattaagtcggttcggcaggcaaaaattcaactcaaagatgggtttgccagagttcgcaatggcgaagtttggctatcaaatgttcatattgcgccatttgagcaaggaaatatttttaatgttgaggagctgcgcacgagaaaattattgctcaataaaaaagaaattgctaagattgataaagaattatcaggaacaggaattacttttattcctttaaaagtttatttgaaaaatggctttgccaaagtgctgatgggacttgctcgaggtaaaaaagattatgataagcgagaaagccttaaacgcaaagagcaaaatcgcgatattgcaagacagcttaaagcttacaatcgttaacgatgattaaaaatactgacagagcgactgtcagtatttttttactagttttcagtaattataaaaaagaattctaaagaaaaaagtatttacgttccatttaccttgtatttactaagtgtttacaagcgattcggtctttcgatgataaaatagttttgtaagcaaaaagcttaacaacttatttagaaattaattggagaaacttctcatgaaaaagaaaattcttgttggtctcattactgctggtgcattgttgactttggcggcctgtggttcatcaaatggttcatcatctagcagctctagttcttctgacaaagctttgtcaggaaaaattatcgctggaggttcaacagctcttcaaccattagcacaacaatcgtcaacagaatttatggctaaaaattcttctgttcaagtaactgtgcaaggtggtgggtctggtgtcggcttgacccaagtggctgctggttctttccaaattgggaactctgacatttttgctgaggaaaaatccggaattgatgcttcagcaattactgatcacaaagtagcagttgttggttttgccccaattattaacgctaaaactgatgtgaaaaatttaacttcacaacaattgcaagacgtctttactggtaaagtgacaaactggaaagaagtgggtggtttagatcaaaagattactgttatcggtcgaactgaaggttctggaacacgcgtgaatttcgataagtttgcactgggtggtgcaacagaagttaaaggaccaacacaagatgcgtctggttcagttgttcaaatggtaggtcaaacaccaggagccatctcatatgttgcactttcttatgttgatacaagtaaagacatcaaagatatttcgattgatggtgttgagccaactgaagcaaatgttgtaactaatgactataaagtttggtcttacgaacatatgtacacgaatactaaaaaagaaacagcggcggataaagccttcatcaaatatgtttctgaaaacaacaaagacattaaaaaattaggatatattccaatcagcgacatgaaagttgaacgtgatgctgacggaaatattactaaaaaataagacgaaggctgattcaatttcgacagaaatcagtttgtcagtaaaataattatgtataagaagtagtggttaatcacatcattcaaagcaataaaaattttcttcttcataaattaaaattttatgctcagctacttttttataaaatcaatgttcagtgaatttaaacagggtttactgagcattggactttaaatatatcttcatattctttccctaaagacaggaagctgctcattctctaagaattgagcattttcccgtattatttacaaaacatttacataagaacgctgtcatcaagcgacctttgagggggcattatgttataattaagctatgaagaagaaaatttttattgctttgatggccagtgtaagtttatttgcattggcagcttgtggttctggaaataaacaggtcacagctggtggctcaactgctttgcagccaatggttgaacatgcttctatgtcatatatgaagcaaaatcctgatgaaattatcatggttcaagggggcggttctggtgttggtttagctcaagttgctgctggttcttttcaaattggtaattctgatatttttgccgaagaaaagtcaggaatagcggttgataaaattattgaccataaagttgctgttattggttttgcaccaattatcaacaaaaagttaaaagtaaaaaacttgtctcaacaagaactgattgatattttcactgggaaaatcactaattggaaagaagttgggggccaagatcaaaaaattacagttattggtcgaactgctggttcaggaacgcgtgtgaattttgataaatatgcgttgaatggcgcaacagaagtgaatggtccaactcaagatgcttcaggttctgttgttcaattagtagggcaaacgccaggggctatttcttatgttgcttttagttacactgataaaccgggagtaaaagcagtcaatgttgacggtgtcgctccgacttatgacaatgtgaagactaatgcatggaaaatctggtcatacgagcacatgtacaccaataaatctcgtaaaaatacgattgaaaataaatttatcgaatacgttcaaaatgataaaaaaacacttgagcaattaggctatatccgtgtctctgaaatgaaagttgaccgagacgcaaaaggaaatattgaaaaaatcaagtaatcccctttaaattttgtgataaaagtaaattagaactgacaatagtcagctttaatatactttaaaaataaagttttaagtgaaaaaaattctgcattatcaaataaaatataaatcaacaaaaaatagttaggtccttatggaaaattcaaaaatcaaagaaaaattgctttcaagcaataaaaattcaaggcttgaaaaatttggtaagagtttgacgttcttatgtattgccctcattgtcttcgttgtaggcgcaatcctcgtctttgttgctcaaaaaggtctatcaactttttattcagatggcgtaaatcctttccgtttcctctttggaaccaactggtcaccaggtaatcttgggccagatggtaagcctgcagttggggctttgccaatgtttgcgggttcattgattgttacggtactctctgcacttgttgccacaccttttgcgattggtgcaggaatttacatgacagaaatctcaccaaaatatggtaaaaaaatcttgcaacctgtcattgaactccttgtagggattccgtcagtagtttatggtttcattggtttgaccgttgtcgtgcctgccattcgtaacgtttttggcggaacaggtttgggacttttgtcaggtgtgtttgtgctctttgtcatgattttgccaactgtgacttcgatgactgtggacgccatgaaagctgtcccttcttattataaagaagcatcactcggacttggtgccactcgctggcaaacgatttggcgtgttctcttacgtgcggctacaccaggaattttgactgcggttatctttggaatggcgcgtgcctttggtgaagctttggctattcaaatggtcgttggtaatgcggtcatgatgccaaaagatttgatttcaccagcttcaaccttgacatcaatcttgacttcaggaattcctaatgcaacacctggtattcaattgaatgcactttggtcgcttgccttactccttttgattatgtcactctttttcaacctcgcaatgcgtgctattgctaagaaaggaagtcttaaataatgaacgctaaacgctctgacaagattgccactggtgtcctttacgtcctttctggcatcattgtgcttatcctcgcttttttactggcatatattttagttaaaggtttgccagttatctttaaagaccctaaatttatcatcaccgcgtcaaatccgttgacaggtggtgggattgcagttcaactatttaactctgtttatctattgattgtaacgctgattatctctgttcccctatcgctaggtgctgggatttatctgtctgagtatgcaaatcggaaacattggttaactggtgttgttcgctcagcgattgaagtattgtcttcacttccttcaatcgttgttgggcttttcgggatgttaattttcgttttacaatttggtcttggcttctcagttttatcaggtgccttggcgttgaccgttttcaacttaccgttgatgacccgtaatgttgaagaatcacttcgagcaattccaacttcacaacgtgaaggcggtttggcactcggaatgtctcgctgggaaacagcaacacaagttattttaccagcggcagttcctggaattatcacaggggtgattctttcatcaggacgtgtctttggtgaggcagcggctttgatttatactgctggacaaacaaacttgccgattaactgggcaaactggaatccgatgagtttgacttcaccgctgtcacttttcagaccagctgaaaccttggctgttcatatctgggcacttaatactgagggaacaatttcaacggcgcaacaaatttctgcaggagcctcagcggtattgattatctttgtcctcctctttaacctgggtgctcgtttcattgggaatcgaattcacaagaaattaacctcttcaaattaagaaaacttataagtttaacagaaagaataattatggcaacaacatatgactggactcagcgcaaaattatggtgcctgagaaagaagaaatagcattatcaaccaatgatttgcgtgttttctataatggaacaaaagaagcaattcatggtgtgacaatgtcatttcccaaaaatgaaataactgcacttattggcccttctggttctggtaaatcgacttatctgcgtgcattaaatcgaatgaatgatacgattgatggagcgcgcgtaactggtgaaatcaattatgaaggggtcaatattaacgacaacaaagtaaatgtctttgaagttcgtaagcaaattgggatggtttttcaaagacccaacccatttcctaaatcaatttatgaaaatattgccttcattcatcgccgcgacggtgtgagagataagaaaaaattggacgagattgttgaaacctcactgaagcaagctgctttgtgggagcaagtcaaagataatcttaatcaatcggctttggctatgtctggcggacaagcgcagcgtttgtgtattgcacgtgccttgtcagtaaaaccagaaattatcttgatggatgaaccggcttctgcccttgacccaatttcaaccatgcaaattgaagaaacgatgatggaacttaaagaaaattatacgatcattatcgtgactcacaatatggctcaagcttctcgagcttctgataatacagcatttttctactctggagatttgattgagtatgataagacaagcactattttcactcagcctagtttacaatcaacagaggactatgtttctggtcactttggttaagaaataaaaacatcacacatttattcaattttgttgtcaaaatttgataaaaattactgacaaagctacaaagttgctaaaatattttctgtcagtaaaacatactgatagaaagtcaaaaattttttgtcataggacagtcatttgtactttggtacattacgaatgtgctggtagttctatcagtaacttataaaaaggtaagatatggaaaaagaagcagttttaaccgtcagcgacttgtcgctttattacagcaagaaaaaagcgttgaatacgataaatatgacattctacaagaatgaaattacagcgctcattggtccgtctggatgtggaaaatcaacactattgcgctcaatcaatcgtatgaatgatttgattccaacagtgactatcactggagcgattgattacaaaggtaaaaatatttatagtccaaaagttgataccgttgatttacgaaaagaaatcggtatggttttccaacaaccgaatcccttcccattttcaatttatgaaaatgtggtttatggactgcgcttaaaaggtgtcaaagataaagcacttcttgatgaagttgtggaaaactcacttaaagcagcaaatatttgggatgaagtgaaggatattttgcacagttcagctcttggactttcagggggacaacaacaacgggtttgtatcgctcgtgtccttgcggtcaatccagaaattatcttaatggatgaaccaacatcagcccttgacccaatttcagcggctcgtgtcgaagaaaccatgcttgaacttaaaaaagattatacaatcgctatcgtgacgcatagtatgcaacaagcatcacgtatttcagatcgtaccgcttttatgttagacgggaatctgattgagtataatgatacaaaaagtattttcttgaatccagaaaaacaagaaacatctgattatatttctggtaaatttggataaatttcattgctagcactttggtgctaaaaatatcaatggccgtaaaacgctaaagcgtcaacggtcaaacaggaaagggaaaagcgatgcttttctaatctccaacctgaaagctcccttttcagtcgctttcagttatggcgttcttcctagatattacattagcattcattaaagcggaatatcatcgatttaatgaatgtctcataataacattactataaaaacaaagaggggtaattatgttgcgtacacaatttgaagaagaccttaataaacttcacaatcaattttactcaatgggcacgcaagtttctgctcaattgaataaggccgttcgtgcctttgttagccatgatcgtgatttggctgaacaagtcattgaaggcgaccatgccattaatgaccaagaaaaaagtcttgaaaaccaatcattagaaatgattgcacttcaacaacctgtttctagcgatttgcgaacaatcatcacagtccttaaagcgtcatctgaccttgagcgaatgggtgaccacgttgcatctatcgctaaggcaaccatttcacttaaaggtgaagaacgaattcatgtaattgaagaagatattagcttactcggtgaaaaagttaaatctatcgttgatgcttcgctcaatgcttatattcaaggaaatgacaaacgtgctcatgaaattgctgaacaacaatatgtcatcaaaagcatgagtcatgaaattcaagaaaaaattcttgacggaatgaaagaaaactctgaaacagtaacaacaggtaaagaatacttgttgacattggtttacttggaacggattaccggttacgcggtcaatctctgtgagtggattgtttacttgaattctggaaatattattgaactttaaaataaaaagttactgacaagaattgctgtcataggatagtcgtttgtactttagtacattacgaatatcctagcagttctatcagtaactttttttattgtcataatcaatttcaatgacttggtgggtcagataattattttcagcaaagtccattttgatgacatagggcattttgccagctaaagattgaaaatcttgaaactgaaagtctggttgataaaaatttaaaatggtagaaagagaagtgccatgagttccgattgcaactttttgatttttagaagttgctaaaatatgttcaagggctgaaatattacgattttgaacttcacgtaaggattctccatcagcaagtttataatcaaaatctttccattgtcgctttgcaaaaggccaaaaatcagctatttcatggccaacatttctttctctcaaatcagaaatgagttaaatttcaagatttttagagtgagcaagaggattcacggtacgaacagaacgttgaaatggactggaaaaaatttgctcgattgatacatttgcaaaagcatcagctaagattagtgcgcgtttttcaccctcagcagtcagaggaacatccatatcgtcataggttgcattatctctaagagaatgtcgaataaaataaacttcagtcatgtgactctcctttttgatgttctaaccttccaaaatttcaatttttaaaggttgggttgaaatttccacttgccctcccagaggaaaagtaaaaatcggttgagtatgtccaaaatcgacatcataaacaactggaattgtttttaaatgagggtatttatctaaaataaaatgtaaaatttcttcagtcattccctcttcttttggaaagcgaccaataaccaaagcagagatatcgggataaacttgaagaaaatgagctaattcacggtcccaatcataaaaatcttcaccttcagcattttctaaaaaagcaatttgttgattagatttgacctgagcactagttcctgtcacaagcatcagggtattgagatttccgccaataatctcccctgacgctttgccatggttatatattttccaggcagcaggcaggagatgacgagcttgagtggggtcgtaccaagcatcactcgtgtagaaatcgctggcatttaaagaataacttgactgaccagctactgcattttgccaagaattagtttgaaagtcttgcaattcatccattaaaaaggcgatgtaaccaggaccatagtaagtgactaagccagttttagcgaaaattgcttgatgaagaacagtgatatcagaaaagccacagaaaattttaggactattttttacaatgttccaatcgatataagggagaagttcattagagttaaagccaccaatggacataaaatggctttgacattagggtctaaaaaagccgcatggaaatctgcaagtcgtgaattaatcgaacttgattcaagcaaatcattttctaaaatatgctgaccaaaagtaacctgataaccaagtgcttcaagacgagcttttgcttttaatttgtcttcaaattttccggtccgagtcaaagaagaactaggtgaaatcacgcggatttcatcgcccttttgtaattttttaggaaatattttagtcattcatcaaagccctccgtcagtaaattgaactaattatagcatttactgacagcattgtcatcaaaaatatttaaagattttaatttaggattctattttgaaagttactgatggaactgctagtatattcgtaatgtactaaagtacaaacgtctatcctatgacagaaattctgtcagtatttctttatgttcgactaacttttggaatatatgacaaaagaaaaataaatatatttttttaaagtcggtaactaaagatactatgtaagaactgacgataatataagaaaataaaaaactaagaagatgttataatccaaggctttccagcaaaataatcacttttggcatatattccaaaatttttcacagaattttcagagtgctattaggatagcacgacttatttattttccaatgaacttaactagcaattcgggtatctaaaaaaatattttgatgaatttgttgtatttaaaggtctttcaagggaacgtaagccttctgtaaattctcttagaaatataaggtcaaagattttactattctttgaatattgctggttagaaaaaagttatatatcgtcttctcctatgtctgaactacggataaaaaagcataagaaaacacaatctgaatatgataagctaaaagacaaatgtttcttttcagaacagatggaagtattacttaatcatatgaaagaatttgaaaaaacacagaatgcgaaacaagaagattgtgttagaaagagactttttatagaatttatttatctaaatggaaataggtatggagaaggagcaggtttaaagttctctactgtaaatcatggtggaatttggataaaagatcagtatagtagaaaaagttcggtaaaaaatccaatcaataaacagaccaaaactttaacttctaggagaataaaggcatttgaaaatgatgatacgaggagtaaggaaattattcaatggtttttagaccataataactcgggtatcaatgatgattatatctttgttagaaaaaatggacatcttttgtctgatgatacaatgaatagatacttacatagatttgaaaagcagatgcctgataaactttctagttcatttgtgatgcactcgttaaggaattcttatattacaaggaggagatacagaaacagaaatcatggctaaagttggacatgctaaccctaatttagttcatactctttatactcatgttagagatactctaaagtttgatgaacagaaaaaatttaaaaaacaacctagattattaaagattgggaaaagtgcttgatgcaaaccaaaaactaaccatatgttcgggaagaattgggaaaattgaggaagaatattactaagtataacttgcgtaaatgtttattttaaaagaattgggaagattgaggaagattctggcaaaaaaaacagtaattatggtataatatacgcaaaattttgaaataattaattcgaggaaaaaataaaaaaatatgagtagaatgatgccggcacgagtgcggagtgagggaatcgccctctatgcgaaaggcttcttaaatgatccgattgaaactgattttaagttaactgcagaaattgatggtgaagaagtaagttatgatttagatggagctcaagatagttgtacttgttcgatttttcaacaaaatcatcgctattgcaaacatattgcagcgattgaagagtatctgaaaaatcaggacaagggcagtctagagacaaaggataaagaaactaaaggagccgaacgagggctttataatgaaaatattgcttttctagatgcagtaaatggagaaacccaactaaatttcagtacagatcagtattctatcgaagttcaaattgaagataacagtcagctttatgattatttttcaatggactactttttatactttgatttaaagttgaaaagtaaaaatttaggacgttcatatgtcattaaagatattccctattttttacgagcgcttaaaaattacagccagtattcattaggctcgttacactacattgatctcttctttgataattttgatgaggccagtcaggaatttttgagttttctactaaagattgatgggaaatcagacgaggctctgaccaaatccttatatatcaaaaatggacgctatctcaatatccccttcttgtttttggaagaagccatggatttagtctctgctttagaagtttatcagcttaaaattatcggaagaacagttaattattttacatttattccattggataatgactcagaaatttttaaatttaaagttgagagccaacaagattatattgaattgagcttattcagcgaagattatcataatttttatgattattcgcttctttatgataataatgtattctataaactgagccaagaacaacgtcgcttactccttgtcttagacaaacaatttgctcagaaatcaaaaataaaattcttatattcagaaaaagataaacttgctcaagcacttcaacaattatcaactttaggaaaaattgaagcaccagaacattttgttgtcaaaccatttgatgcaaagttcacttttgatttattagatgaaaaaacgcttagtttggcaatgaaatttgattatggaactttttctattgatagctttcatgacttggaaaccttagaattttcaagggatttgcgtaaggagcaaaagatttttgctttaatggagcgactgcaatttgccaaagcttttaattcaactttagaaattacggaacatttgtcagagaatttctttttaaagattctaccttcttttcaaaagcttggtcaaattgaattatcaccaactttaagaaatatgagaatggatgaagtcccagaaattcatattgatagccaaggaggcttgttagatatctcctttaatattccgcatgttgaggatggcgaatttgcaaatgtgattgctaaattgcaagaaaatgctgagttttatattagtgaaagcgggaaattttatcatttcaatgaaaaatttgatcgcttaaaagcggcactacatgaacttgatgaccaatttgttattcaaggaagtagtttgcatgttaatattaatcgtagtttccaaatttctaaaatttttgaaaagattagtggcgcctctttttctgagaaatttaaatcactttatcaacatttaactcaccctgaagaatttccctatgagaaacctgagcatattaaggcttctttgcgttcttatcaagaaacaggtgttcgttggatgagtatgttatcccattacaatctaggaggaattcttgctgatgatatgggattggggaaaaccgttcaagctattacttttatcctctcaaatctaaaaaaagacgaaagtgtattaattactgccccagccagtcttacttacaactgggcaagtgagtttgaaaaatttactgacgaaattgattttgtcgtgattgatggtaataaagctgaccggactaaggagattcaagagaatcaccagatttatattacgagctatggtagctttttgaaagattttgaagattatcaagataaaaagttaaattacttacttttagacgaagcgcaagttgtaaaaaattatagtagtaaaacgaataaatctctttcggctcttaatgttgagcatacttttgctctttcagggacgccacttgaaaatcgaattgaagaaatttgggcaattttccaagttgtaatgccaggctttttacccaagcgtgaaaaatttaataagatggaaccttcggtcatctcaagattgattcaaccatttatcatgcgtcgtaaaaaagaggatgtacttgaggaacttccagagaaaatggaaattacggtttacaatcaattggctgatgaccaaaaagtgatttatcttgcacaacttgaattaatgcaaaaacaagttttagaaatggacaatgcagctttatcacgttcaagaatcgaaattctggcaggaattaccagattaaggcaaatttgtaatacaccagctttattcatggatgattacaagggaagttcaggtaagcttgaacgcttaagagaactactggctcaaattaaagattctggacatcgtccgttgattttctctcaatttacaaaagtttttccacatattgaaaaattaatggaagaacaagaaatgactgcttataaattgacaggctctactccgattaaagaccgactttccatggttcaggcatttaatgctggaagccgtgatgctttcttagtttctttgaaagctggtggtgttggtcttaatttgacaagtgctgatgttgtgattttagtcgatttgtggtggaatccggcagtagaagaacaggcaattgcgcgtgcccatcgtatggggcaaaaaaatacagtagaagtgattcgtttgattacacaagggacaattgaagagaaaattatggaaatccaagaacgtaaaaaagacctgattgcaaatgttttggaaggcgatacggttgataaagttcttagtgaagcagaaattcgggaaattctcggagtatagctttaaaaaacttagaaattaagctataatggatattgaaacggttatcttaaagaatcggattggcttttaagagctgacgagatgacaataaaagctctaaagacttataagataagctttaaaggctttttagatagaccttcatattaattcacataaatttgaaaagtacaattaagaaataaaacaaactataaaaaagtagggcaaaacatggtagaaagaagagtggtatttccggttattggtgatgacgaagtgcttcaaaaagatactcgggtgatttttactaatcagcagttgctgacaagaaatcccagccttcaggatgaagcttcaattgagacaagcaagtcaaaaactgatgctaaaagacctgagagcttcaaaccttataaggctaaaacaagctttagcacacaacatcgtccgctaaattctaatcatgctggcgtaagttcatatgacaaaatgccgaaaaaaacaagtgtagatgagtcaaaagaacgagcaaagcgagcagcagcaacacttccaaaatctccaaaacaatatgtttctcctttggagcgtgataaagaggatttaacggttcgtcgttcaacatctgcaattttgaataaacgtccttcaactaatgataacccaattcgggatatgaaaaaacaaggaatgaatgtttcggatgcagttgcaaagaatggctctggaatgaaaaaagcaacaccgcacggtggagcagcaaatgatacgcaaaagggaagttattttgaaaataagcggaaaaacatttttgaccgcggaatcgtataattttcaaatttgaacaaaaaactgacagagaaaataaattttattttgataaaatttattttaaaaaaacaacttatcagttattttgtgcgtcttttagggcgtgacttttaaataaataaaaaattttaactgtaagaaaagaagggaaatttctgtcagttgctgatgaataaaagtagctgacagaaaattttatcatggaaaaaacatatcattttaccggtattaaaggttcaggcatgagtgcacttgcattgatgttacatcaaatgggcaaaaacgttcaaggttcagattcaacagactactttttcacacaacgtggtcttgaacaagtgggtgttccacttttgccgtttgacgaaaaaaatattaaacctgagtttgaattgattgttgggaatgcttttcgcgatgataataatgtcgaaattgctttcgcgcataaaaatggcttcccattcaaacgttatcatgaatttttgggccatttcatggaagatttcacaagtattggggttgcaggagcacacggtaagacttcaacaactggaatgttagctcatgtgatgtcgaatatcgtggacacttcttacctaattggtgatggaactgggcgtggaaatgctggaagtgaatattttgtctttgaatctgatgagtatgaacgtcatttcatgccatatcatcctgaatataccattatgacaaatattgactttgaccaccctgactattttgaaggaattgaagatgtcacttcagcttttcaagactatgcaaataatatcaaaaaaggaatctttgcttatggtgaagatgtgaatttgcgtaaattgtctgctaaagcgcctatttattattatggttttgaagctaatgatgattaccgtgcaaaaaacttgattagaagtacacgcggttcatcttttgatgcctatttccgtggtgaaaaaattggtcattttgttgttcctacctatggaaaacataatgtcttgaatgctttatctgttgtggccgtttgccataatcttggtttggatatgacagatgttgctgaccacctcttgactttccgaggagtaaaacgccgttttactgagaaaaaagtaggagaaacagtaattattgatgacttcgctcatcatccaactgagattgaagcaacattggatgcggctcgtcaaaaatatcctgaccgtgaaatcgttgcagtattccaacctcatacatttaccagaaccattgcttttgctgatgagtttgcagaagttcttgatcatgcggatactgtttatctagcacaaatttatggctcagctcgtgaagtagaccatcatgaaattacggcacaagatttagctgataaagttcgtaaaccagccaaagtaattgagcttgacaatgtttcaccattgttagaccacgaccgcggaatttatgtctttatgggagcagggaatattcaaaaatatgaaattgcttttgaaaaattacttagccaaacttcaacaaacttacaataaaattaaaaaagcactgacagtattgttagtgcttttttattaataaaaaattcaagtcacgggagtgtgacttgaatcaaaggggtttatgaagaaattatttagggagtaatatgagtataaatgtaaacgcttaaattaaccttaatttcgtttaaattaacctaataaaatatatttaatctctgctgtcaaaatatttgctgctttttcggacgcacaaataacaagcaaggtatcagcaccggcaattgtacctaaaatatcagtccggctatcgcgttcgtcatctaaagcatttgctaaaacgtccgcttcaccaagttttgtacgaatgacaactaaagcacctacagattttgctgaaatgacaaaattataaaaatacaactgtaaatcagaattaattttagagttgccagaagtcaaaaatgagtaaaaactctctcctttgtcccgcttttttataatatttaattttctaatatctctggataaagtggcttgtgttacctctacaccgcgttctaataatagagattgaagctcttcttgagtcgatattttattatttgtcacaatttctttaataatttctaatcttttatctcttttcatagcataattataccatataatggactatatattgacaaaattagtgttttttctgtataattagtgaatggacgaaaaacaactagtaagccaagcactgtctgctgcaatcgatggtgttcttggagtagaacaaatcgcagctataatcgaaaaacctaaatcctcagatttaggagatttagcattcccagcttttcaattggcgaaaactctccgaaaatctccacaaattattgctggagaaatcgctgagaagatagatacaaaaggttttgagaaagttattgcagtagggccttacgttaactttttccttgataaaaatgcgacagcctcagaagtcattcgtgaagttttgactgaaggtgagcactatggtgatgcaaatattggagaaggtggaaatgtgccgattgacatgtctgcgccaaatatcgctaaacctttctcaattggacatttgcgctcaactgttattggtgattcgattgccaaaatttatgaaaaattgggttatcaaccgattaaaattaaccacttgggtgactgggggaaacaatttggtctattgattactgcatataaaaaatatggagatgaagcgaccattacagcaaatccgattgatgaacttttgaaactttatgtaaaaattaatgcggaagctaaagaagatccagaagtcgatgaagaaggacgtcaatggttcctcaaaatggaacaaggtgatgaagaagcccttcgtatttggaaatggttctctgatgtttcattgattgaatttaaccgtatctatggaaaactcggagtaactttcgatcactttatgggcgaaagcttctacagtgacaagatggatgctattgtggaagatttggaaaataaaaatcttttatatgagtcaaaaggtgctttgattgttgatcttgaaaaatataatcttaatccagctttgattaagaaaacagatggtgcaacactttatatcacgcgtgaccttgcgactgctgcttatcgtaaaaagacttttaattttgtaaaatcactctacgtggtaggtggcgaacaaactaaccacttcaaacaactgaaagctgttttgaaagaagctggctatgattggtctgatgatatggtgcatgtacctttcggaatggttactcaaggtgggaaaaaattctcaactcgtaaaggtcacgttgttaaattagaaatggctcttgatgaagcggtggatcgtgctgaaaagcaaattgaagcaaaaaaccctaatttagaaaataaagaagaagttgctaagcaagttggagttggtgctgttaaattctacgacttgaagactgaccgaaacaacggttatgactttgatttggatgaaatggtttcatttgaaggtgaaacaggcccttatgtgcaatatgctcacgctcgtattcaatcaattttgcgtaaagcaaatcgtaaagtgaacattgacaatatttctcttgttgtttctgatgctgaagcttgggaaattgtcaaagctttgaaagaattcccaaatattgtgaaacgtgctgctgataattatgaaccttctattatcgctaaatatgcaatttcacttgcacaagcctttaacaaatactatgctcatgttcgtattttagaagatgatgctcaattggatggacgtttggctttgattagtgcgacttcaattgtcttgaaagaagcattgcgccttcttggggttgctgctcctgaaaatatgtaaaaatatacttaattatttaatctcttatcaaaaagaatttaattcttgctgatgagagatttttttgtttcttttttaaaacattttgtaaaataagtattttaataaaaagctaagaatcccatgataagcaaaggagtgcataaacgtgaaattgtcagaatataaaaaaacatgtataaatgaataaacctttgtaaagtgtagcattagtgctcgacaaaaatatgcatagatgtataatttccttgtaaacgattccaataatactgaatcaaaatcagaaaggatactccaaaatgaacaatggaattaatgttaactcagaaattgggaaattaaaatcagtccttctccaccgcccaggtgcagaggtagagaatattaccccagacacaatgaaacagcttttatttgatgatattccatatctcaaaattgctcaaaaagagcatgatttctttgctcaaacattgcgtgacaatggtgctgaaactgtttatatcgaaaatcttgcaacagaagtttttgaaaaatcatctgaaacaaaagaagagtttttaagccatttgttgcatgaagcaggttaccgtccaggacgtacttatgatggattgactgaatatttaacttcaatgccaacaaaagatatggttgaaaaagtctatgccggtgttcgtaaaaatgaattggatatcaaacgcacagcacttagtgacatggcaggttctgatgcagaaaattatttctacctcaacccattaccaaatgcttacttcacacgtgacccacaagcttcaatgggtgtcggaatgactattaataaaatgactttcccagcacgtcaacctgaaagcttgattaccgaatatgtgatggctaaccatccacgtttcaaagacactccaatctggcgtgatcgtaatcatactactcgtattgaaggtggtgatgaattaattcttaataagacaactgtagcaatcggggtttcagaacgtacttcatctaaaacaattcaaaatcttgctaaagaattatttgcaaatccattttcaacatttgatacagtgcttgcggttgaaatccctcataaccatgcaatgatgcacttggatactgtatttacaatgattaaccatgatcaatttacagttttcccaggaattatggatggtgcaggtaacatcaacgtcttcattcttcgtcctggtcaagatggtgaagttgaacttgaacatttgacagatcttaaagcagcccttaagaaagtcttgaacctttcagaacttgacttgattgaatgtggtgcaggtgacccaattgccgctcctcgtgaacaatggaatgatggttcaaatacccttgctattgctccaggagaaatcgttacttatgaccgtaactatgtaactgttgaacttttgaaagaacatggtattaaagttcatgaaattctttcaagtgaacttggtcgtggtcgtggtggagcgcgttgtatgtcacaaccactttggcgtgaagatttgtaatctgaagacttttacataatgttcttgaatttaactactaaatttaaaaacaagtgaatttataaatttagttttataagttcgtaaaattaaagatgaaagtagctcattaatgtaatttaaaaaattcattaaatatttaaaaatagaaaaaggaaaaaaataatgacatcaccacttattacaaaagcagaagtaaactcagtattccaaggtcgtagcttgcttgctgaaaaagattttacaccagctgaaattaactaccttgttgattttggtcttcatttgaaagcattgaaacaacaaaatattcctcatcactatcttgaaggtaaaaatattgccttgttatttgcaaaaacttcaactcgtacacgtgccgcatttacaactgctgccattgaccttggtgctcatcctgaatatcttggtgcaaatgatatccaactcggaatcaaagaatcaacagaagatacagcacgtgttcttggttcaatgtttgatgctattgaacgttgtggattttctcaaaaagaagttgaagatttggcaaaatactctggtgttccagtttggaatggtttgacagatgattggcatccaacacaaatgattgctgactttatgacagtaaaagaaaactttggttaccttaaagggttgacattagtttacgttggtgatggtcgtaacaacatggcaaattcactcatcgtaactggttctatgcttggtgtaaatgttcatatcgttgcttcagattcacttcatccttctaaagaagttatggatattgccaataaatttgctgaaaaatcaggtgctaaacctcttgcaacttctaatattgaagaaggtgttaaaggtgctaacattatttattcagacgtttgggtatctatgggagaatctaactgggaagaacgtgttaaacttttgacaccataccgcatcacaatggatatgttgaaaatgacaggaaatgctgacaacggtaaacttatctttatggactgcttaccagccttccatgacactgaaactgaatatggtaaagaaatcaaagaaaaatatggtttgacagaaatggaagttactgacgaagtttttcgttctaaatatgctcgtcaatttgaagaagcagaaaatcgtatgcactcaatcaaagcaattatggctgcaactttgggtaatttatttatcccagcagttcctgaagattttaaataattaaaatagataatttgtcagtttactgacagagctgtcagtaaactgatagattttgatttaagtcgttgaaagcagtctaagatagtttttagactgttttgacggttaaaatcattgaaaggattgatatggacgcagaaaataaaaaaggaattggccttgctgctttagttgcgattattgtttctggagcgattggtggtggggtattcaacctctctaacgatttagcaacaaatgcatcacctggtggtgttgtcatttcatggatcgttattggttttggtatattaatgttggttttatcactgaatcatttggtggtaaacaaatctgaactttcaggtgtgtcagattatgcacgtgctggttttggtaatatggttggttttatctcaggatggggttattggttatctgcttgggcaggtaatattgcctttgctgttttgatgatgactgccgttgactatttcttccccggcgtttttcaagctaagaatggctcattgaccattctgtcagtaattgttgtttcaattgtttcgtggggattgactttacttgttatgcgaggtgttgaaggggctgctgccattaatgcaattgtccttgttgcaaaattgattcccttgtttgtctttgttattgctggaatagttactttcaaagctggagtctttagtgctcacttttggcaaaatttcgttgcgaatacaaatgctgatggcgtaattaagagtttaacttggtctaatatgactggcggagatttattcagtcaagtcaaaggttcactcatggttatgatttgggtcttcgtcggaatcgaaggggctgctatgatgggtgaccgtgccaaacgtaaatcagatgctggtaaagcttcaattctcggtttgattgccttgttagtgatttatatcttgctctcactattgccatttggttttatgagccaacaagaactagctaatactggtcaaccaggtttggttcatattttgaacgctatggttggcggttggggtggttcactaatggccattggtcttgtgatttcacttcttggagcttggttgtcatggacaatgcttcctgttgaagcaacacaacaattatcagaacaaaaattacttcctagttggtttggtaaacttaatgacaaaggtgcacctaaaaattcacttttgctgacacaattgattgttcaaattttcttgattgtcacttattttgtagctgatgcttacaatgtctttgtttacctttgtaccgctgttatcatgatttgttatgccttagttggtttatatctctttaaattagggattcaagagaagaaaacaagtaatatcattattggtttcatcgcggccgccttccaaatcttagccttgtactattcaggatggcaatttgtttggctctctttaattctttacgcagttggtttcattctctaagctttaggcaaaaaagaatatggaactaaaatgtccacagctgaattaatcgcaacctttatcttgacagttttaggaatcctcgctgtttttggagtatacgggaactggcttggcttgcaagatgcactgggaattgatggaaatactttacttgtcgctgtagttccattgattgtagtaacatttattgtttacttcgtggttcgtagtgatatcaataaaaaaggaattaaaaattaatcaaaggggtataaaaaatggtaagtcctattgttgtagcccttggtgggaatgctattttgacaaaggacccatcagcagcggctcaaaaaaaggcgcttgaagtaacagctgaacagttgatgccattaattaaagataatgacagacaaatggttgtgactcatggaaatggaccacaggttggaaatttacttttacaacaattgggttcggatagtgaaaaaaccccagctatgccattggatacagttggggcaatgactcaaggcgaaattggtttttggacggttcaagcttttacaagagcaatggctaataatggcctagagcgatatccagttatttcggcagtgactcaaacattggttgatgaaaatgatccagcttttaaaaatgctagtaaaccaatcggtcccttttatacagaagaacaattgccagaaattaagaagcaatttcctgattgggagttgatggaagatgctggccgtggttatcgtcgagtagttccaagtcctaaaccacttgaaatcattgaagcaaaagcatttggcccaatcttggaatctggaagtttatgcttctggcggaggtggaattcccgtcattaaagatggtaatggttataaaggtgttgaagccgttattgacaaagatttttcagcagctaaattagctgaaatggttggtgcagatgaacttttgattttgacaagtggtggcgatgtttatttgaactatggaaaagaagatcaagttcatctagaaacggtcaaagtttctgaaatgcgtaagtatgtcgatgaagaacgctttgccaaaggttcgatgggacctaaggtagaagctgcggtcagctttgttgagcgaacaggtaaagttgctacgattacaagccttgataatgttgaaaattttgtcaaatctggcagcggaacaagaattgttccataaataagtaaaaaagatagaggagaaataatttaatggtaagacgtatggtcgtagccctaggtggtaacgctattttaacagatgacccaacagcaaaagcacaagaaagagcgcttgaaacaacggcagaacaattaattcctcttattagaaataacgatgtggaaatggttgtcactcatggtaatgggccgcaagtggggaatcttttgttgcaacaattagcggcagatagtcctaaaaatccagccatgccaattgatacagccgttgcaatgactcaaggtcaaattggattttggatggggcaagcttttacaagagctttgataaaaaataagatggagcgcgttccagttatctctgtagtgactcgtacagttgttgacaaagatgactcggcttttgaaaaaccaactaaaccaatcggtccattctacgacgaaaagggcttagcagagatgaaagctcagtatcctgactggacttttgttgaagactcaggtcgtggctatcgtcgagtagtaccaagtcctaaaccaacacgtatcgttgaagccgaagcaattaaaccattgatttcatcaagcgttttggtgactgtatctggtggtggtggtattcctgtcattgaaactcaagagggttatgaaggagttgaagctgttattgataaagacttttcagcagcaaaagttgctgaacttgttgaagcagataatcttttgattttaactgcggtagataatgtttttgttaacttcaataaacctaaccagaaaaaacttgaaacagtaacaatggcagaaatgaaagcttatattaaagaagggcaatttgccgcaggttcaatgttaccaaaagtagaagcagcaatggaatttgttactcgcactggtcgtcctgcaacaattacctctttggaaaatcttgaagacttcctcaacaatgattcaggaacaaagattattccttaacgttaaaaatgctacatttctgatgtagcatttttttataaatgtagtttaaaaatcgataaactttccgatattttatcaataattattgtacaattaacatgtaaacgatttatattgataaaattactgacagaatcctaatacgattcaggaatattatgctaatctagctaataaatctgtcagtaaaaaaataaagagaggaagacaagttcggatgatttctcgaaaaaaatcatttaaacttgcaaataaaacttatggaacttgtacaatttggttgcgaagattggctcaatgtttgggaaaaatcagcaacaattgatattgctcagtcaaccattgattcactatctttagaagaggtcttggcttttgaagaagataaaggtgaagcttttatgtctcagatgatgaaagaaaaatttagttatggatggattgaaggatcaccagccttcaaatcagaagttgctaaactttataaaagagtatcagaagacaatattttatctactaatggagcgacaggagcaaattttcttacaattttaggcttgattggtcaaggagatcatgtaatcgctcagtatccttcttatcaacaattatatgattggccaaaaacattaggtgcacaagttgattactggaagataaaagaagaaaatcactggttgccgcaaattgaagacttgcgtcgactcgttaaacctaacacaaaattgatttgtttaaataatgcagctcaaccaacgggtgcgattatgagtccagatttcttagcagaagtagttgagattgcccggagtgtcgatgcttatattctttgtgatgaggtttatctgcctcttgatgaagaaaccccttatgcaccaattgctgatttatacgaaaaaggaatttcaacaaattcaatctctaaaacttattcggttccaggaattcgtgtaggttgggtcgccactcaagatcgtgacctttgtaatgaattccgaaagattcgagattatactctaatttgtacaggagtctttgatgatgctttggcttctttagttttaaaacataaggataaggtgttggctcgcgctcgggatattgttaaaggaaatctctcaattttaaaagaatgggtcgaaaatgagccattggtctcaatggtttatcctaatgctgtgtctgtaagctttgtgaaattcgaacaattagacccaatgaaaacggaagattttgccattcaactccttcgtgaaaaaggagtgctaataattcctggaaatcgttttgacttaccgggatatgccagaattggatattgtacggatgaaaagactctacgtcaaggtttgcaactcctatctgaatttttgagagaatataaaggttaatatcttttatataaatacattaccgttttactaacttgtataaaaagtgtataatgggaaaatgtgagtataattataactaaagaatataaaatagtctctatattcaagagactattttatatttacagtcagattatacgaatttaattatagcgaatttataattaaataatagaaagtgagtaaatggaaaacaagaaaacaaaagggattagcctttttgcactactagcgattatcatctcaggagccattggtggtggagtgttcaaccttgccaatgacttggcaagatgctcaactcctgggggagtcgtgatttcatggctttttattggttttggaatattaatgttagttttgagttttaatcggctcattacaataaaacctgatctttctggtgtatcagattatgctcgagcaggttttggggactttgtaggttttttatcgggctggggttactggatttcagcatggacaggaacaattggttttgctgttttaatgatgacttctgctgattatttctttcctggtaaatttgcaaattcaaacggttcactaactattctgtcagtaattattgtgtcaattatttcatggatattgatgcttctagttgatcgaggagtagaaacggctgcggctgtaaatgcaattgtgatgattgccaaactgattccattggttgttttctcaattacaggaattatcttatttaaggctaatatctttactcaacatttttggcaaacctttacaacgaattttgctgctgatggttcagtcaaagattttgtttggcacgcaatgactgcaagtggacttttaagtcaaattaagggctcattgttggtaatggtttgggtctttgtcgggattgagggtgctgcgatgatgggaaatcgcgcgaaaaagaaatcagatacagcaaaagcaacagttattggtttagcagttttgcttgttatttatgtacttttgtcactccttccttatggttatatggatcaagcaagtttagcaaatgtcaaagcccctggtcttgtttacattcttaatgaaatggtcggtggctggggtggtagccttatggcagtcggtctaatgatttcattattaggagcatggctttcatggacaatgctaccggttgaagctacacaacagttggcagagcaaaagctattgccaagttggtttggtaaactcaataaatatcatgccccaagtaattcattgttgattactcagttgatgattcaaatctttattatcattacatattttgtcgcaaatgcttataatgtttttatttatatggcaacagccgtaataatgatttgctatgctttagttggtgcctatcttttcaaaattggtcttaaagaagcatcagtaaaaaatatactgattggtttcttcacttttgcttttcaggctctggcactctacctctcaggctggcaatatgtttggctggctatgattctatatacaattggatttcttttgttcattggagcaaaaaaagagagtcatcaatcaatatcagtcaaagaatggttggggatgcttgttgtgacagtacttggggtattagcgattgtggtcttgatttgtggggccaaagcgggaacaggctttgaccttcgaggattactaggattttaggcataatttaataatgaatcatcttataaagataattttactgatgtttttctaggtgaatggaggaaataattgatgagaacttttgcagaagtggaaaaattgttaactgaactttcgattccttacaaaattgtagaacacccagctagtcattcaacagaagagtcggataactacattaaagattatgaagggtgtcgttcaaaaactttgattttggccaataaaaaatcaactcagttttatatgattatcatggatgacgctaaacaagttgatatgaatcgtttgagtgaaattcttgaggtgaaaagactccactttatatcagaagaccgattggaagaaatgttaggtttaaattcaggaattgtttccctttttggtttagtcggaacaaattatgaaaatatgaatatttattttgatcaacaaatgcttgatgattatcagattcaaacttttcatcctaatgataatactaagacaattttctttaagatggaggcttgttttactattctgaagtcacaaggttatgattatcaaattattgatttataaattaaaactcttgctcgtcaagagtttttttattcgcctattgagtctaaaaactaatttttgtataataacaatatgctaacttttccactaatcaatgacacttcacgaaaaatcattcatatcgatatggatgccttttttgcttccgttgaagtgcgtgataattcgagtctaaagggtaaaccagttgtgattgctaggaacccattgcagactggtggacggggagttgtatcgacttgttcttatgaagcgcgtgctttcggaatacactcggcaatgagtgcaaaggaagcgtatgacctttgtccacaagctatttttatttctgggaactatgagaaatatacaaaagttagtaaacaggttcgtgaaatttttaaacgctacacggataatattgaggcagcgtcaattgatgaagcctatttagatgtaaccgagaataaaataggagctcaatcagcaataaaaatagcaaaattaattcaacatgatatctttgttgaactaggtttgacttgttcagcaggagtttcttataataaatttttggcaaagattgcttcagattatgaaaagccacatggtttgacattaattatgccagatgaagcattagagtttttggcaaagttgcctgtggaaaaatttcatggggtggggaaagcaactgttcctaaattacatgccttaggattctttactggaggagatttacaaaaagctgatccggttgatttggctgaaaaatttggtatttatggttgggaacttttccaaaaggcaaatggaattcataactctaaagtcaaaaatcatcgtgaacgaaaatcagtaggcaaagagcgaacctacgggaaattactatatcttccagatgatatcaaagctgaattaatcaaaatatctaaacaggtttctaaatccttaaaaaggcaccaactcaagggaaacattattattttgaaattgagatattcggattttacaacactaacgaaacgaaaatcaatggtagagaatctggatagtccggaggacattgcagaagctgcacaacagatatttgaagaaattgattatgatgagagcttgggagttaggctgctaggagttaccatatcaggatttggtgtccaaaaagcaacattagatatgcaatagttagaaaagggatgaaggcaatttcgtctcgtttttttatcattaaataatagataattccaagtaaacaagcgatttgaagaagtttcatttcatcaaaaaaacttatagaaaatgaggccgtaaaaaaccataaaaaatcaccacttccaattttaaaatcgaaaatctcagttaagagtgcaagtactaaccagctataaaaaatcaaagaagagggaaataaaataataaaggaaagagcgaaaataagccaaataataaaagggaagctatgatgccgataatcaaaagcagataaaattactgacagaatgctcatcaaaaattgtggaagactaagataattaagccataccaaacaaaagaggagaccaacagaaaactcaagaataaaattcatcaatggaattttattcttacaatagcgacaaagtgatgcagaagataattgagaaaataagggaattaagtcacggaagctcaaaatgtgattgcaagagtcgcaatgtgagcgtctaaaaataattgattctcctgccggaatacgatcaaccaataggccaaaaaacgacccgaaaattgttccaataataaataaaaataatatctccatactaatctatacgaaaatggattttgaatgtaactaaaaatggaattaaaaagaaaataagtaaatcatttgataaaaaattctcattggtttataatatatttatagaaaagttaatattaaatctctttatggcatttaatatttaaaaaatggaggttagttatgtcaaatgaacacacacaagaagttttaaatcaaacggttgccgatttatcgaaagcatctgctcttgttcatcaaatccactggtatttgcgtggccctggttttctttacctacacccaaaaatggatgaattaaaagaccaattggacgaacatttggatgaatttgcagaacgtttaatcactattggtggttctccagtttcaactttggcagaatttgataaaaattctaaaattgagatgacgcctgcagcttggggtaaatctaattcagaacgtgtcaaagaattgatcgttgcttataaatatttgactcaactcttcaaagacggaattaaaattgctggggatgatggagatgatgtgacagttgatttattcacaactgctcttggggatatcgaaaaaacactttggatgattgaagctgaagtgggctaataaaattgtaaatgaaaagctctgtcagtactgacagagctttattttatttttaaatttactgacagattttttaacaatctaaaaggatagaaagattctatcctttttatgattaaataccagattttgttttcccattccaagaatttaacccacctttaaggatataaatttcaggaataccagcttttttaagttttttagcaacttttgctcccccaataggacgaccagtttcataaattagcactggtttatgtttgctcaaagcatttaaactttggtcaatctgaccagaaggaagattacgcgcaccaagaatatggttaacccggaattgatttgcttcgcgaatatcaattaattgagaagttggtatcaaccgagcaaattcagcttcctcaacaagttttgcattgcgacgaagattccagcggggatagacaaacattccgataattactaagacaagaatgatatcaatgataataataatcaaaattattctcctttaaatttaagagcaagacttgcagcgccgataattccggcatcatttccaagaacagcaagtttaattttacttgagttacgaacagttgaaaaggcatatttattgaaataagtttcaactttttcacgcaagaattcaccagctgctgatacaccaccaccaataacgattgaagcagggtttaaagtagaacccaaatttgcacaggcaaatccaagataataagcaaatttatcaacaacagataagctgaagtggtccccttcttgagcagcaaagaaaatgtctttagaagttacttcatcaccattgtcaatagcagccttaatagtagaatctccttcgtactcttcagcaaatttatgagctaagcgaacgattcctgtagcagaagttactgtttccaaacaaccgcggtttccacaagtacattcaaaaccatcagggtcaacgcaaatgtggccgatttcaccaccagctccagcaacaccatgaactagctctcctgaggcgataattccaccaccaacaccagttccaagagtgatgaagactacatcaggattgttttcgccagccccaacccaacgttcaccaagagcagcaacgttagcgtcattgtccaagatgaaaggtagaccaacaccctcagaaattggtttaccaacctcttgagtgtctgcccagtttaagttgaaagcggctttaacagtactttcagaaatatttactgatccaggagttcccattccaattccaagaaactctgatttatccaaattgtaaaggttcaaacggtggttgattgattggataatatcaggaacgatatgttttccatcttctaaaatatttgttgggatagaccatttatcttgaacttcaccagtgagagttaaaatcccaaatttaattgaagttccgccaaggtcgataccgataattttacttgcagtcattgttttttctccaatctgacactaaaaaaagcattattttttattagtcgtagattttttcttttcaattctctcttcacgcgacaaaatcaagcgagcagtcaagtaatcgtggtcgcttttctgaaatattcctgattcaagcatctttcctaattcaatttgcataaaagcaatcgcatccaaacgatctggaaaaagattgatatatccatattttttcagcatttcttgtacatcgtagagagttttcattactatattttaccgtatttgataaaggctttcaagtgcaagctatatgtaaaatatagagaatagcgcagattttgtttataaaatggtataatacactataatttgaaaacgtaactaaaaagatatttaatggtaatgatgtttttggaataagattatagttaaaatttacttgttgaaggtaaaaaaatgaatagaattttgatttatgcggacttttatgcaggaaatcgcttagagcgatttgttcttgaaattgaaaaagaactcgggataaaagacaaggttgacgtaacaaaagtattctataatcatcaagatgcctatcaatatcttcaagtttacctcaaagatgttaaggcttgttttataaaaattggacaaaaagaagaactagaaatactgaacaaaatgcagaagttagaaagtgaggcattttttctgatttatactgataatcctgacttaaaagatgaattattgagctttactaccctaccattatggtctcagatgactgtgtgtagcgattttgatagtgaagttagggaaataattgaaaaagttttactgtactgttttacaaatgaattaaatattgttgaaattgctgactatccgatttctatggattctcttttatatattgaagcggacaaaacacatcgaaattatcttagagccatcacaaaagataatgagtgtctagttcgtggaacgatttcagatgcaaaaaagaaaatgcccaatctcctctcacttgggcgtgggttactcgttgattcaaagaaaattcgtcgaattgaagatgatggcttgaccctgtgttttgtacaatgtttgaaaaaagtcaaagcaccggcggtttataaaaaagtactgaaagtactcaaaagacaatcagagtggataaaataatcatcctttttagggtgctttttatttttggctgataaaaactcaatttcatcacaaaaaaagtaatttcatcataaaaatgattgaatttagcaaaaaagcgttgcattcagaaacaaaaacgcttacaatttaattgtgaaaacaatatcaataatttttgaaagagaaaaagtaccaatggaaagttaagaaagttcaatatcagctcaaagatatatcgtgcaacaaaagaaagtgagtaatttttttaatggaaaatatactgtcaagtaagttatagtttgagaattaactcttagattagtaacttacagactaagaaaagaggatttatttatgaatacgaaaaaagaagtgaagtatgttgtaaatgatggagtaatattggataataccagcgggggacataatctgacagcgcctgtgactgttgagatagaagtaacttcaactgctaaaggtacaataaagggagagacgacttacacagcagattttggagaagcagaggtaactaaaaaaggagaaaatttgaaggcaagttcctttgggaatttactgggcacaaaaacttttgcagctagtcagaatcagtcaaagtcagataaaacttattctgttaagtttaggctgaatataaattggacagtgtctaatggctacgctggtctaacaaaagtaacaggaggttatggtcctagtgttgatcgtgtttatgtcgctaattccagagtcactactgcaacgaatggtcaggttaaaggaatgggaggttatagccaacaggttgatgacaaatcagaaggaggcaatctatcatggtcgattacccggaattacaaacctgtaaagattccctcagccagtgcaatggtaggcgctacttatttcgctacgcttaaacggggaaatagtacttggacatttgaaacgacaaatcgggcttattaatgggagaaagtaaaatgagtataaaaagtataaaactttggcaagtaatacttgcatttattatctggctaggaacgatgtttcttccagcaacagttaatcagaataaattgaatacgaactttgattatagagaaagtcgagaaaatttcttttattttatctctcatcagtttcccttttacagtattattttggctctactactattgctatcgattatcttgctttatagaaaagcaagggttggcaagtaccttgcttttgcaagtctgatttattatattggtttcttagtcgtaggttttccaggaagtatcatttttaatcgcagtttatcgggcaatacttttgaaggagaagcggcgctttttttaactttttatggggtgggctatattgtttccgtaattgttgggtgcctagctcttctcttactttacttatatagtttatccagaattaatgaataatagtttgctcatgaaaaaatacattgtttttacatttattattctaaaatagtagaaataagaagaaaaaagactaaaaaattgtttgaaaaaattatgtaaaagtcaaaaacaggtgcttttgttgatttacataatttttttataggctacataatcaaataaaatgacgaattgagacaggtttttttctttaaaaatgatataatgatttcatggaaaatacagatttaatttacggattgcatgcggtcacggaagcactaaatggagaccttgtcaacaagctttacgttcaagaagatttgcgcggaaaaaatgttgaaaaaataaaagaactcgcacgaattaagaaagttaatatatcatggactcccaaaacagaattaaataagctgacagaaaatggagtccatcaaggatttatggcaagggtttctgaatttgcttacgctgatttagcaacgttgcttccagaattagcggaaaaagcagaagctacaattttaattttagatgagttgacagaccctcacaatttgggttctattgcgcgtacagctgatgcaactggtgtggatgcaattattattccaaaacatcgagcagttggtattacaccgacagcagttaaagcatcaacaggtgccttacaacatgtgcccgtagttcgagtaactaatctgtcacaaactttagataaactaaaaagtgctggattttggatttttggaacagatatggatggtacggtttatagcaaatggaatactaaaggaaaaattgctttaattattggtaatgagggacacggtattggtcagaacctcaaaaagcaagttgatgaaatgattacaattccgatggtaggacatgtgcaaagtcttaatgcgtcagtagcagcaagtattttgatgtacgaagttttcagaaatcgtctttaatatttactgatgaaattaaagcttgtttctaatcacaaataggcaatgagtgttctttaaacaagctgtcaatgaagcactatttctgtcatttgtaataaaaagaaaggatttttatgacttttcaaatcatgaccgactcaacatcagacttgagtcaatattatcttaaaaaaaaccatattgaaatattaggaatgaccgtaacagtcggtaatcagacctatgaaaccattggagaagaggcgctagataacagtacactccttacagcaatcaaaaaaggagcgacggttcacacttcccaaatcaattcgggacaatttttagaagtgtttaaaaaatatgccttggctgaggaagaccttctttatcttgctttttcatctgggctttctggaacttatcagtctgcccttattgcacaaaatatgattttagaagaatttcctaatgcaaaaataacagttattgatacacttgcggcagcatcaggagaaggattcatcgttgaagaagctgtcaaacttagagatgcggggaaatcactgacagaaactctgaaagttttgtcagatatcatcccacgtttacagagtcgtttcatggttgacgatttaaaccatcttgcaagaggaggtcgaataccaaaggctgtagccttggttggaacgatggcgaatatcaaacccttacttgatgttgatcctgcaggtaagttacgacaagtgaccaaagttcgtgggaagaaaaaagcgataaatcaaatgcttgaaaaaacgcttgaggaaatggatatggcttatccacgcttggttatttcttattcgggcacagatgaagtagctcaagaaatcaagaaacaagctatgcaaaaaaatggaattagcgatgtcgatgttcgcccactcagtccaacaattgtaacccatacaggagacgggacgatagcaattttttcaataagtagacaaagtagagaataatttaataaaaaactgaaaaaatcacagctaaactcttgttttactgtgattttatgttaaaataattaatgagtgtaattgtatataaaattatctgtacacttacctaatttattaaaaaaaatatgaatcgtgatgtgtgagggaaaggagtcgcttttatggccaaaagtggactttatacaggcgtagatatcgggacaaacacaataaaggtgcttgttgctgaatacgtctcaggtgaaatgaatataattggtgtcggaaacgcaaaatccgatggccttaaaaatggaattattgtagatattgagaaggtagcacaagcattacgaaaagctgtaaatgctgctgaagaacgtgccggaatcacgattgatcgaattaacgtgagcattccagcaaattccctcgaaatggaaccatgccaaggtatggtcccaattgttagtgatacaaaagaaattacagataacgatgtgattcaagtcgttcaaaacgctttaatgcgtgggattgttcctgaaagagaaattattgctgtagaaacaaaagagtttacagtggatggctttacaggcatatcagatccacgtggaatgtttggtgttcgacttgaaattcgtggggttgtttacactggccctaaaactcttgttcataatgttcgtaaagttgttgaacgtgctggattgcttgttgacaatattgttattgctcctcttgcaatggcacaatatgtgctcacagaaggtgaacgcgaatttggaacaatcatggttgatttaggtgctggacaaacaacagttagcattgtaaaagatcaatctttgaaatttacacatacaagccctgaaggtggcgactatgtgactaaagatatttcaactgtcttaaatacctctgtttcggcagctgaagatttgaaagtcaactatggtgaagcaagtactgaacgtgcaagtcaagatgagtatttccttgttgatgttgttggtaaagatgaaccagaacaaatcacagaatactacctctcacaaatcattgaagcgcgaatgactcaagtttttaatcgcgtacgtcaagatttggaacacggacacacatcagaaactcctggaggactgattttagtcggtgggacagctgctatgccaggtgttgttgatttagcaacaaaaatcttgggaatgaatgctcgtctttacgttcctggagaaatgggcttgcgcaatcctgcgttcgctcaagtcattagtgtagttaattatatcggaagtcgaagtgatattgatgttttagtatcacaagctttttctggcgattatgcctatacggcagctgaagaaacttacgttgctcctgttcaaacaatcgcaccacaagtgacaacagtagccgacgtagaaaatgatttctacactgaacctcaatcgcgtccagttgcaactcaaaaagtaactgagcccgaagaagaaaaagaaggtcttgttgaccgtgccaaaagtttctttggcaacctctttgactaatctgaaagtaaaaacggagaaataaaaacatggaattttcatttgatacagacttaacttctggtgctgtaattaaagttatcggtgttggtggtggtggtggtaatgccatcaaccgtatgattgaagaaggtgtttctggcgttgaatttatcgctgcaaacactgatgtacaagctttgcgtagttcaaaagcagatacagtaattcaacttggcccaaaattgactcgtggtttgggtgctggtgcacaacctgaagtaggtaaacgtgcagctgaagaatcagctgaaactgtttcacaagcccttgaaggatcagatatgattttcatcactgctggtatgggtggtggaactggtacaggtgctgcaccagttattgctcaaatcgctaaagaacttggtgctttgactgtcggtgttgttactcgtcctttcggtttcgaaggttcaaaacgttcatattttgcaactgaaggaattgaagctcttcgtgcaaatgttgatacgcttcttatcatctcaaacaacaacttgcttgaaattgttgataagaaaactccattgactgaagcattacgtgaggctgataatgttttgcgccaaggtgttcaaggggttactgatttgattactaacccaggaatgattaaccttgactttgccgatgttaaaacagtcatggaaaataaaggtgatgctcttatgggtatcggagttgcgactggtgaagaacgagttatcgaagcaactcgcaaagcgatctactcaccacttcttgaaactacaattgaaggagctgaaaatgttcttttgaatgtgacaggtggaatggatatgagtttgattgaagcacaagatgcttcagaaattgttatccaagcagctggtaatgatgttaatattatgttaggtacagcaattgatcctaaccttaaagatgaaatccgtgtaacagttgttgcaactggtgttgctaaagaagatgcagatgaagctttgggattgcaaccagaatcacgtcgtcaacctaatttgacacataattctaatatgcaacatgctcaaacaagtcgtccaattcaaagacaacaacaaccgcaagcgactcaacaaggacaaaatcaatcttcagcatttggagattgggatattcgccgtgaaacttcaacacgtcaaaacgtaagtaacacacgcgatacttcttcagtaacaagctttggtggagtaccaactacagatgaagaccttgatacaccaccattcttccgtaaaaattaatctatgacgattaaagagaatgttaaaagaatactgaataatgtggatgcagcaaaagctgcgtcttcttattctaatcagtcagtttcagtcgttgctgtaacaaaatctgttgaagctaatcttgcacgcgaagtatttgaaaatggaatttcacatttggcagaaaatcggacagaactttttctagaaaaatatgaagctctaaaagattgtgagattacttggcatctaattggtaatttacaaagacgtaaagttaagaaagttattaattatgttgattattttcatgcattagattctttgaaattagcgcaggaaataagtaagcgagccgagcatctcattaagtgttttatcgaagttaatatttctggtgaagaaagtaaacatggcttttctgtggatgagcttaaggaaactttagctgatttctctgagttagaaaatattgaaattgttggattgatgacaatggctccgtttgatgcgaatgaaagcgaatgtaatgacattttcggacgaatgaaagaattacaagttgaaatttctgaaatgaatcttccaaaaattccctgcacagaattaagcatgggaatgagtcgggattatgaaattgccattaaaaatggagcaacttttgttcgaatcggcacagaattttttaaagatttataagcttaaagattaacgtaaacaacggaggaaaatatggcatttaaagattggatgaataatctacgagattattttgtagaggatgatgaagagttcaacgaacctacacgtcctgtgcaagaatctaggccaacggtggcatctacgccaaaaccaaaggttgaagagtggaaagtgcaggcagactatcaaagtcgtcgcccagcacaatcaactccaaaaccgcaagcacaaacagcagcgccaaaacgctctgcttcaactttctcaaaacctatgcctgaaaaaatcgtacaacaacaaaccgtttcgcaagctcaatcattagctgcaacggtttctactattgcaattaaagaaccacgtgcctatgcagacatcatggaatcagcacgcatcgtcaaaaatggcgaatgtgtacttgtcaattttaaatttatgggtgacgcccaagcgcgtcgttcaattgacttcatgactggggtggtctttacccttgatggtgatattcaaaatgtgggtggtcaaattttcttgatgactccagcgaatattacagttgatgcagcaaaagaaatgtctatcttagctggtcaaaattttgaaagttatgataattactaatgcctattataattacaataataaactggcttttacgtttattggatttttattcaattattttaataatttatgccttgatgagttggattccaaatctttatgaaacttggtttggacggttaattgttaaggtttctcgcccctatttgagtttatttgaaaatctaccattacaaatttggggactagatttcacaatcttggttgctctcattgttttacaatttgttcaacggttcattattattgtatttaatggtgtattccattgattaccgaaaatgtttatcaacactttcaagcaaatgaacatcattttattgatcgttgtttagattggataagtcaagttgaagagacttattcggtaataagtacattttttcttaatcctcgtgaagtagagattttgaaaacattagcaaataaaagagaagtccaagttttttctagcgcggagttagcacaaacagaattagtcaaaataattttggctccaaatttttatgtgcttgacaaagatgatttcgatattgctttactggaaatatcttatgcaatcaaatttgttcaaatttcacatgcacaagtcttagggactttcttaggacaagcaggtgttaaacgccaagaattaggtgacatcattgttactgacagcaaaattcagatttttgtcagtaaacatcttgtcgaaagttttaaatcgattgataaaattggacgagcagcagttaagattgatgaaatttcactgacagatttagctcaagatactgagcgagctattcaggaagttgtacttcttgatggtttgcggatagataaaatgattggtatcgctttcaaaatctctcgcaatattgctataaatatgttagaatcaaagaaggttaagattaattaccaagaaattgataaaaaagatttctctgttggagctggtgatttgattagtgtccgagggtttggacgcatcaaaattttgagcctcttaggcctgactaaaaagggaaaacagagagttgaaatagaacttattagaaatcagaaaaaatagtttctaagacgaaaatcgctttgatgagattttctaaggataaagaggagtgattgatggcattaaatagtttagatgttcaaaacaaaacctttaatccacaatttcgtgggttcagtaaacatgaagttgatgaatttttggatatcgttgttcgagattatgatgaatttgctcaaacaataaaagatcaagaacgtgaattaaaagcattacgtgaacgcgtgaaatattttgatgacatgaaagattcattgaacaaatcaattgtcgttgcccaagatgctgctgataatcttcgtgaacaagcgaaaagtgaagctgacacattaaaaattaattctgaaaaagaatctgcagaaattattgcaaatgctggacaaaagagttcgttaataattgaagcggctaaaaaagaagctggtaatattttaaatgctgcttctgatgatgctcgtaagttagtacgtgatactgatgatttaaaacgtaaaatacgtctctatcatcaacgtatgacttcgattattgaaaatcaacttgcttctattcaatcagatgattgggctgaaattttcagaccaacacaagattattcaattaatcctgaagaaaaattgcaaatgattattgaagaacatttggaaaacgctgaatcaactttagtaaaaacccaagcaattcaacctttaacagatgaagaaattgaacaagcaaacgaaaaagctgaagagccagaagtagaagctgagccgattgagtcttctgaaaatattgaagaaactgaagttcctactgaagcaaaagaagaagttgctgaagtgactgaaacagttgctgatgaaagtcctgagcattcagaaattgatatacctaaagctgatgattcagaaatttttccagaattagaagcgaaagcaccagctgaaacaactgagcttgttgaaaaagataatcaagaaacaattgatttaagcgaattaaaaaattaaaatcagaccaagatgagaaaaaatataattaaagcaagcgagtgatgatggaagactcgtattccctatttttcttattatcagctgattgaatttctaattttactgacagattttcttatctcgaattaaattagaaaaatcttgaactgaactcaaagtaagtttaagcgtatcgcacgttacgcgattagagtttctgtcagtaagttttactgacagaaaaaatgaaggtggtaccacggtttttcgtcctttacgaaaggccgtttttttgtatagttcagaactttaaaggaagtcttgggtttatagctcaaataaaagattacttttcatgagtgagaaataagatagttttcttttacattggataaattattttattagattattcacaaaaaaacaaagattaaaaaacaaagattaaaaaatagaaagaagaaaatatgaaaatcaaagatactttgaacttgggaaaaacagcttttccaatgcgtgcaggcttgccaaataaagagcccaattggcaaaaagattggtcagatgctacgctttatgagaaacgtcaagaattaaatgaggggaaaccttcgtttatactccatgatggacctccctatgcaaatgggaatattcaccttggacattctttaaacaaaatttcaaaagatattattgttcgttataaatcaatggcaggattccgtgctccttatgttcctggttgggacactcatggtttaccaattgagcaacaacttgctaaagcaggtatgaaacgtaaagaaatggacttgcttgactatcttgaagaatgtcgcaaatatgcgatgaaacaagtagacatgcaacgttcagacttcaaatcactcggtgttttggccgattgggatcgtccatatctgactttattgccagaatacgaagcggctcaaattcgcgtttttgggaaaatggctgaaaaaggatacatctataaaggacaaaaaccaatttattggtcaccttcatctgaaagctcacttgctgaagctgaaattgaatatcaagatgttcgttcagcctcaatttttgtggcatttaaagctaaagataccaaaggaaaattgccagaagatgtcgaatttgttatctggacaacaacgccatggaccattccatcaaacttgggaatttttgctcatcctgactatgattattcagttgtggcggttaataatcgcaaatttgtgattgcttctgaaatgcttgaggccgttgctgaaaaacttgaatgggaaaatccagaagttcttcaaaccctgaaaggttctgatttagaatacatggttgctaagcacccattttatgatcgtgaaacactaatcatgaatgcagattacgtcacacttgattctggtactggacttgtccacgttgctcctggtcatggtgaagatgactattttgctagtcgtaaatataaattgccagtcttgtcaccaatcgataatcgtggttattatactgacgaagctcctggtcttgaaggcgtcttttatgatgatggaaataaaatcgtcagtaactggctggaagaaaaaaatgctttattgaaacttgaattcttcactcacagttatccgcatgattggcgcactaaaaaaccagtcattttccgtgccacaccgcaatggtttgcttcaatcgatgacttccgtcaaaatattttggatgaagttgaaaaagtagattgggttattccatggggtaaaactcggttattcaacatggttcgcgaccgtggggattgggtcatttcacgtcaacgtgcttggggagtaccattgccaattttctacggtgaaaatggtgaaccaattatcacaccagaaacaactgaacacgtagctaaactttttgctgaatttggctcaaaagtttggtttgaacgtgaagcaaaagaccttctaccagaaggatttactcatccagcttcaccaaatggtgaatttacaaaagaaaaagacatcatggacgtttggtttgattcaggttcttcttggaatggtgtccttaacgaacgtgactatcttagcttcccagcggatctttatcttgaaggatcagaccaataccgtggttggttcaactcatctattacaacctcagtggcggtaaatggtgtagcaccatataaagcagttctttcacaaggattcgttttggatggtaaaggtcgcaaaatgtctaaatcaattggaaatacaattgtgccaaaagatgtcactaagaaatttggtgccgatattctccgtctttgggtggcctcaattgataccgaatcagatgttcgtgtatctatggatattctcagtcaagtctctgaagtttaccgtaaaatccgtaacactttgcgtttcttaatcgcaaatacatctgattttaatcctaaagaagatggaattgactttgctgaacttcgtccagtagataaatatatgcttgtgaaatttaatgaacttgtaaaacaaatccataaagcttatgataattacagttttatgagtgtatacaaatcaatcattaatttcatcactaatgatttgtcatcgttctatcttgattttgcaaaagatgtggtttatattgaagcagcaaattcaccagaacgacgttcaatgcaaacagtaatgtatgttattttgaaagatttggtaaaagttcttgttccaattttgcctcatacagcagaagaaacatggacttacttagagcatgaaccagaaaattttgcttatcttgcagaaatgccagaagcagcggaaattccaggtagtgaagaactattaggaaattggcaagaattccttgacttccgtgataagattttgaaagctttggaaagtgctcgtgaagcgaaacttattggtaaatcattggaagcaacagtgacaatttatccaaatgaagttgtacgtactttactgacagcgattgacgaaaatgttgcgcaacttttgattgtatcaaactttgtagtagcgaacggaactgtaagtgatgcaccagaagcagctatgaaatttgatgaccttgctgttcttgtggaacatgccgctggtgatgtttgtgaccgttgccgcagaactgacgaaacagttgggcataacgccaatgaaaatctcaaaatgctttgtgaacattgtgcacatatcgttgaaaaagaatttccagaagtccttgtagaaggctttgaagattaatatataaaaaaagttactgacagatttgtcagtaacttttttattttaaaatttaataattacaatacagcgagcattgatgcaagaacgctaaaaagcgttagaacgaccatgataatcacaacgatcatcgtgactttttggaaagtacttttttgtggttttttatatgccataagttcctcaataagaatatttttaattaattgtaacaagaaaaagaagacttttcaattagtttgggtctttttcattattcgtttcttttagagctaagaatttagcgaaagggtcttcttttttttcaggagaaggaactgtcttcttatcatcatcagtcactaagtcaacagttgagacacctaaatcatccatcattttgtcaaaatcatcacgttttctaaaagttagtcccattatattctccttggaattaaataatttacagtgctcgaaaagagaagagcaacactagaaccattttactacttaagagataaaaaagctagatatatgaaaaaacttattgaaaaaatgcgattaaaggctgataagacttgcatttcaaaacgattttaagtataatgataaggaacggtagattgcaattatgcagactacctataataaaacaaattccccaaaggagacatttttaaaatggctaaagaagtatacgaccgtagcaaaccacacgttaatattggtactatcggacacgttgaccatggtaaaactaccctctcagctgcaatctctaaagtattgtctgacaaaggttactctaaagcgactgactttgcatctatcgatgctgctccagaagaacgcgaacgtggtatcactatcaacactgctcacatcgagtacgaaactgaaaaacgtcactatgcccacatcgacgctccaggtcacgcggactacgttaaaaatatgatcactggtgctgcccaaatggacggtgcaatcctcgttgttgctgcaactgacggaccaatgccacaaactcgtgaacacatcttgctttcacgtcaagttggtgttaaataccttatcgtcttccttaacaaagcagaccttgttgatgatgaagaattgatggaactcgttgaaatggaagttcgtgacctcttgagcgaatacgacttcccaggtgacgatattcctgtaatcgctggttcagcacttggtgctttgaacggtgaaccacaatgggttgctaaagttgaagaattgatggacatcgttgatgaatacatcccaactccagaacgcgacactgacaaaccactccttcttccagtcgaagacgtattctctatcactggtcgtggtactgttgcttcaggacgtatcgaacgtggtactgttaaagttggtgacgaagttgaaatcgttggtatcaaagaagaaactaagaaagctgttgttactggtatcgaaatgttccgtaaaacacttactgaaggtcttgctggtgataacgtcggtgcacttctccgtggtatccaacgtgacgaaatcgaacgtggtcaagttattgctaaaccaggttcaatcactccacacaaacttttcgaaggtgaagtttacgtattgagcaaagaagaaggcggacgtcacactccattcttcgacaactaccgtcctcaattctacttccacacaactgacgttactggttcagttaaacttcctgaaggaactgaaatggtaatgcctggtgacaacgtgcatattgacgttgaattgatccacccagttgcgatcgaacaaggtactactttctctatccgtgaaggtggacgtactgttggttcaggtatcgttgctgaaatcaaagcttaattataaaactaagcaaataaaaactgtcatttatgacagtttttttatataaaattttagtaaaataaaaactcccatagggagttttttaaatttctgattttgtaaatacaccgcggtcaacaagtgcatccatttggaaataaaacttattttgaatcatttcattcgcatttttgaaaatatcaacattgcgtaatcctgatttgtcagtaactgaaagcttaaaaccacttaaatcaggattaacgataatttttaataaaaatccttcatttgaatttggaacttcttcaagaagtctcttaaattcaaaattaccaattttagtttggataaaagttgtatcttttagagtgaattttttaacggtaggcgcaagttgataaacatacttgcttccctctaaatgtttttctgtgacaaatgccattgcattctcctgactaaatattaatttattttaaaatagaactaagcttttcaacaaagagattaacttcatcaagtgtgtttaattctgaaaatgaaatacgaatattttctttgagtttatcagaattttttccgtaaactgcctcaagaacgtgagaaggttcaattgttccagcagcgcaagcagaaccagttgaaattgcaaaaccagctaaatccagtttcgtcagtaataagtcatgattctcatttggaaaagcaagattaagaacatgaggcatacttggaccaaaattatttttataaaaaggaatttcttgttcttttaatttactgagcaagtggtgattgagttcttcgactgcttgataattagactcaatattttcaagtgcgagttctaaggccttagctagaccaaccagtgagtgaagattttctgtaccagcccgtcttttttcttcttgttcaccaccatgaatcagagcatcaaagtgaagaagttcattatagtataagaagccgacaccttttggtccatgaaatttatgagcagaagcagataagaaatcggcgccaatttcaagagggtgaactggaatttttcccataacttgtgttgcatcaacatggaaaacggcttgatgttgactcaaaagttctccgacttcctttactggaagcagttgtcctgtttcattattagcccacatcatgctgactaaaattgtgtctggacgcaagtttttttcaatgagtgccgctggaaaagtgccatcagcatttggttttacaaaagtcacatcaaatttataacggtcatgaaggtattgaacagtatttaaaacagatggatgttcaatagctgtagtgataatatgatttcctttatctctatttgccaaggcataaccaattaaagcttgattattggcttcgctagcgccagaggtaaaaatgatatttcgacttggaacttcaagagcagtggcgaccgtttcacgggatttgcgaacaatctgactagcagcacgtccgagagtgtggatacttgagggatttccaaaattagttgataaactttctgatattgcggtgatgacctcaggaagaagtggagtagtagctgcgttatctaaatatataattttatttttcctacctttcgtagtaattagtggatatttttataaggatttaatattttttgtaaaagttagtgttttatctttgcatactttactgatagaaagattataatttttctatcagtattaaatcgtttccttatctgataagctctattttaacatttttttatcttttttatctgaatcttgataagtttatttgctagattgaaatatcaaattgaacgattaaacgtcatctattgatggtatatttctctatttaattatataatattcttagggagggttttattatggttgaacaatataaaaatattttagtcgcagtagatggttcagaacaatcctatgatgcacttcgggaagcaatcgaaaccgctcaagcgaatgattcacagttgaaaatattgtatgttttaaatgataaactggcaaatattccggtacatttggatacaatgacactttataaaagtgttcaagagcattctgattatgtggtggatcaagttcaagggtatcttaaagatacagaagttagttttgaaattgtccgtttaacaggaagccccaaaagagaaattattaattattcaaaagaaaataacattgatttaatcgttctaggttctacaggtcttgatgccattgaccgttttattatcggttcaacaacacagtatattgttaatcatgcatcttgcaacgtgatggttgttaaataaaaaagagaaaagttgtcattagatgactttttatttttctaaaagaattataaaaataccaaatctagcttggtatttttattgttttaaattagaaaattcttttaatcttgaggtttttcatgttcaaaaagtggagaaactggacgtccttcatgaatacgaagaattgcactagctaagtattcagcggcacttaaatatttcacgttcaaaggcttacggtgctcagtaactacagagtctgttactaagatttctttgatatctgctttttcaagaacatcagcagcatttgttgtgaataatccgtgactggcaacagcatagatttcgctggctccagcttcgcgaacgacattcgctgcgttagcaaaagtcacccctgtatttaagatatcatcaataagaattacttttttaccagaaacattaccgattacataaccattttcacgatttttatcatcatcttcatagtcaacaatggcaattgctgattctaagtattcagcaagtgaacgtgcacgtttgataccagaatttttaggagcaacaacgataacatcgtcaccaaataaaccatttttacgatagtaaccagcaaaaagtggaacagtgaaaagattatctacaggaatatcgaagaatccttgaacctgaacagcatgaatatcaagagtgagtacgcggtcagctccagctttaacaatcatatcagcaactaattttgctgtgattggttcacgagaagtcgcagtacggtcttgacgagcatagccaaagtaaggaattacgatgttaatcgtacgagcagaagcacgtttacatgcatcaatcatgataagcaattcccaaaggtgatcattaacagggcagctggttgattgaacaatgaaaatgtcttgactacggacactttcttccatgttaatcataatttcaccgtcagaaaactgttttgaagaaagttttcctagaggaactcctgtaaattggctaattttctcagcaagaccagggtttgagtttaaggcaaaaagctttaagtgtgaatcagagtaaaccacgatttctctccattttcttttatgaaataatatagttctattttagcaaaattatgatgattttcatagtctatatcgataaatatctttgtgaattaatatgaaaataaaagttaagagtatttagaaaaaattttataagtgaaaaataaattcacaaacttaaaattctaataatttaaaaaagcgctttaaacgtttaagaatacgcttttgaaaacattttcaaaaaatggggaaagtaaagtttgtgaaagttgcggcaaagtcttgcgtttacataagtgaagtgttacaatggttctgtaaggttcgtgaaagctaagtgttacgaacaaattatttatttttaggggaattaaaaatgaaaaaaacaaaagtgatttcacttcttgctgtttcagtgctctcagtttctttacttgccgcttgtggaagtaataactcatcaagtagctctgataaaaaaacagaacaatcatctaaagcagaagtttttgctggtgcaactcaaggaacaagtaacttctatgatttgcaaaaaggtttttctaaaaatggcgcttggttgaacgcaactaaaggtgatatgaacgcttcaggcaaaactttgactgttgaaggacttttcttgggtgacggacaagttgctcgtaaattggcaatctacaatcaagatagcagccataaaattactgctcgttatactttgacagttgataaaattgaagtgaaatctcctggtttctatatttcaaatggtactgttaaaggaaatgttgatgtatttgcaactggcttccacggacaaactgttacaggtgttgaaggacaagcaacaattgatggtaacttgacttttgctagccaagacctccttgacgcttacaataaattaccagatgctcaaaaagttaaagtgactggtacaacttcagttgttaaaggtgatgttgtttcattcaaacctggtggaattactgccggtgctcatggtaatgtaacttattcatttgaaggaaatggtacagatacaaaaactggtgcaacaactggtactgctgatgtttcagtattgaaaaaagcacttggtaaaaatggtgcttggcttgtagctactaatgctgacgttgatgcttcaggaaaagaccttacaattgatggaactttcctcaatgaaaaagcggctgttcaacgtacacttgcgatgattagccaaaatgatcaacaccaagtaactaaatcttatacattgactgttggacgtttgattgttaactcaccagcctttgaccttgaaggtggtaatattaaaggtgacgtttatgtcggtaaagatgcttcaattgaagctcgcgacatgaaaggaactgatggtaaatcaatccaatctgaaatcactggaaatctttactttgcaactcaagaacaacttgacacttacaaagctcttccagctgcaaatcaattcaaagtatcaggtgaagttgctgtaaaagccgctaactaatgaactaaaaattgtctaaaaggctctctatgagcctttttttctttctcaaaatatagtataatgggacatacgtgtagttctatacaaaaatgaatttgtcagcaaaatgtttactgacagaaaagaaaatctctcataagaaaaaaatttactgacaaaataatcagtgatgacaatttgatttttgtttagaaacacgtagactaaaaataatgcaaaagcaggagactggactgttagaaaaaattctaagcatttcaagtcaaggagaataacattggcaaaagaaacattttcaatcgaatttgcaggacgaactttaactgttgaaacaggtcaagttgcaaaacaagcaaatggagctgtggttgtacgttatggagatacaacagttttgacagctgctacaatgggtaaaatggctacaggtgatttcttcccactacaaatgaattatgaagaaaaaatgtatgctgcaggaaaatttccaggaggttttaacaaacgtgaagcgcgtccttcaacagatgcgactttgacagctcgtttgattgaccgtccaattcgtccaatgtttgccgaaggttttcgtaatgaagttcaagtaatcaatactgccctttcttatgatgaaaatgcgtctggtcgtgtggcagcaatgtttggttcatctcttgctctggcgatttctgatattccatttgatggtccaattgctggtgttgaagttgcttatattgacggaaaatatgtcatcaatccaactgttgcagaaaaagagtcttcaagtttggaactttctgttgctggaaacattaatgccattaacatggttgagtctggggcaaaggaattgtcagaagaagtgatgcttggtgcacttttagctggacataatgctgttaaagaattaatcgaatttcaaaatgaaattgttgcgaaagtcggaaaagaaaaagctgaagttgaacttttgcatgttgatgaagatttgaaagccgaagttattgcagcttacaattcagatttacaaaaagccgttcaagttgaagaaaaactagcgcgtgaagcagcaacaaaagcagttaaagaggcaataatttctgtttacagtgcaaaatatgaaaatgatgaaaatctatcaatcattttgcgtgatcttgctgaaattcttgaaggaatggaacatgcagaagttcgtcgtctgattaccgaagataaaatccgtcctgatggacgtaaaattgatgaaattcgtccattggatgcggaaattgactttactccacgtagtattacacacggaactggtttatttactcgcggtcaaactcaagccctgtcaaccttgactttagcaccaatgaatgaagcgcaaattattgatggcttaaatgatgaatataaaaaacgttttatgcaccactacaatttcccacagtactctgttggtgaaactggacgttacggggcaccaggtcgacgtgaaattggtcacggagcactcggagaacgggctttagaacaagtccttccttctttggaagaattcccttatgctattcgtttagttgctgaggtattggaatcaaatggttcttcatcacaagcttcaatttgtgcgggaacacttgcactgatggctgggggtgtgccaattaaagcgccagttgctggaattgcgatgggcttgatttctgacggaacgaactatactgttttgaccgacattcaaggacttgaagaccattttggtgatatggactttaaggttgcgggaactcgtgaaggaattactgctctccaaatggatattaagatttctggaattacaccagaaattcttgccgaagctcttgctcaagccaaaactgctcgcttccaaatcttagacgtgattgaagcaacaattgcgcaaccgcgtgaagagttggcgccgtctgctcctaaaattgatacaattatgattcctgtagataagattaaagtggtcatcggtaaaggtggcgaacaaatcgataaaattatcgcagaaactggggttaaaattgacattgatgatgaagggctttgttcaattttctcttctgaccaatcagcgattgatcgtgctaaagaaattattgctgaacttgtccgtgaagcaaaagttggcgaagtttatgaagcaaaagtggttcgtatcgaaagttttggtgcctttgtcaatctctttggcaaacaagatgctatggttcacatttcagaaatggcttgggcacgtacggccaaagttgaagatgtcatgaaactaggcgatgtagttaaagtgaaaatcatgaagattgacgataaaggacgtgttgatgcgtcaatgcgtgctttggttgaaaaaccagaaggatatgttgaacctgagcgtaaaccccgtgaacgtcgtgataataaggaccgtcgtaatggaaatggattcgatcgtcgcaacaacgaccgtaataaccataataaccataacaacaatagcggaaatcatagttttgaacttcgtgaacgcaaatcacacgttgaccatgagtttccagagctttcaactaaaaagccagaataaactgaactttaaaatggaaaagctgtaaaaatagacctaaaaaagctaaaaatttactgatgaaaatactagcctattcctaagtgttctctaggcatttcgtactgtgttgtccctttttctatccgctcaagcgaatgaaataaaggcaaagcgtcgaaggttacgttatgacagaaacaggcgaggaataatcttaaatttgtcagtaagttatttgtttacttagcttgtaagtaatcactgacaggtctgtcagcaaaaaaatatgtctaattataaccttaatccagaattggatgaacgtctgcgtgtctcattagcaaatccaggatcatttatggaagatttgtccttggtctatgcttttcaccaattcccagtactcgccccaaaatcagtcttttttgttccgattgaagaccataaggctttacctgtctttacaacagaagaagacttggaagtttttctgtcagaactgacagattttgaaacagaatgggaacttcactcattgattgagatattggatcagttaatggaaactgatattgatattttggcaatcaatccaaaattgcctcaagatgaagataaaggaaatacggtttatttcggaacaccggaattaatgcaatttttgattcattatacggaaattttgaataaagttttcagtccagaaaacacttctgctgaacaaagagaaaaatattacttcgtaccagcttttgtgactacaacgaatcaaagaacttttccaaatttaatcaatcaagaaaacgaagaatatcttcctgtttttgataacttagacagtttggctaaatggcataatgaagattattttagtcaagcctttaaagacaacaatggccaagtattacttttgaaacttgatgaattgttggaatcagatgttgaaacaatgaatgatttaggaaaaagccttggaattactgtaaatccattggatttttcacaagaagaagttcaaaattcaatggttacttgggaagaattggcaagagattaaatgaattaacagagtaattaagtctcggcagcatttttttaacaacaaggcccacaatgcttatggtataattactgtaagtattttttagcgaagtaggaaaaaatgaaagaaaaaaagaaaggtttttggtctgaagcaattcgggtgaccaaggaaaatgacccagccgctcgaacggcattagaagtgttgttgacctatccgggagtaaaagcacttgcggctcaccgaatttcacattttctttggcgccataatttggaacttttagcccggatgcattcccaattttggcgcttttggacgcaaattgaaattcatccaggagctgaaattgctcatggtgtctttattgaccatggttcaggtttagtcattggtgaaacggcgattgtagaatccgatgtaaaactctatcacggagtgaccctgggtggaacgggtaaagacaaggggaaacggcatccaaccattagacaaggtgccttgatttcggctcattcacagcttttgggcccaatcgaagttgggaggaacgcaaaggtaggagcaagtgctgttgtggtaacagatgttccagcagaggttactgttgtcggcattcccgcaaaagttgttcgagctaaaggtaaaaaggatttggaacggattacaaatcttgaagagcaacgtgaagcgagctatcattcgtcacatttgtgaggaggaatgagaagtgaaaaagagaaaagtagctgtttatgaaggacatatgcttagcactttaaaatcgtttactgatgcggtaatgtctattattgcgacgattatggttttagagattcctttgccaaaatttattggaactaatcattatgattttcgtgaaacaagtagttcactcattattttctttgtgagttttctagttgttgtttcatattattttcagtttagtaagttttttggacggataaagaaaatgagtggttggcagatattcgcctatacgatttttctcatgcttgtttcacttttcccctttatgactcaaactgataatggtagtcatcccgcttattttacaatagtctatgttatatatattattgtgacctcacggtttgcttctttgattatcaaagctgcttatcgtttaaatgaagtaaaaatcaataggtatcaggcacgcaaaccttgggatttgttagctatgtcagtgattgctattgtgatttcgagtcttggttattctgcttatacaggaataccattgctctatctgccaatacgttctcttgtaacctcaattgtttatgatgaagattaagaaggaaatagaatgaaaatatataacacttatagtcgacagctagaagattttcaaccgattgaacctggaaaagttaaaatgtatgtctgcggaccgaccgtttataattacatccatgtgggaaatgctcgctcagttgttgcttttgatttagtcagaaaatatttggaatttcggggatttgaagttgaatatatctctaatttcacagatgttgatgataaaattattaaggcagctgccagtgaaaatatcagtacaaaagaactttcagaacgctatattgcggcattctatgaagacactgatttattgaatgtcaaaagagccagccaaaatccaaaagcaacggaatttatcgaagcgatgattgattttattcaagaacttttggataaggactacgcttatatttctgagggggatgtgtatttccgtgtagctaaatcaaaaaattacgctaaattggcaaataaaaaccttgcagatttacttgcaggggcttctggacgtacggatgaggaaactaatttaaaagaatcaccagccgatttcgccctttggaaatctgtaaaagctgatgaagtttcgtggcaagccccttggggagcaggacgtccgggttggcatattgaatgttctgttatgtcaacttcgttattgggtgaaacgattgatattcatggagggggagcagatttagaatttcctcaccatactaatgaaattgcacaatctgaagcaaaaacaggccaaaaatttgttaactattggatgcacaatggttttgtcaatgttgatggtgaaaaaatgtccaaatcattaggaaatttcacaactgtccatgaattacttcaagttgttgacccacaaattttacgtttctttttggcaacaactcattacagaagaccgcttaattttactgatgatgcactgacagaagcagaaaataatattaaaaaaatagaaaatgcttatcgacatttggatgaccaagctgagtccaatctatcggctttgacaacttttagaaatgattttgtggctgctatggatgaagatttcaacattgctaatggaatgactgttttttatgactttgtttcgtgggtcaataaaggaaatgggggagctgaggtcaaagcattctttgatcaggttttagaaatattaggcataaaatttgaaattgaacaaagtttagatagtgaaatcgaagcgatgattgaagcgagacaattggcacgagaagtccgtgattttgcgaaatcagatgaaattcgtgatgctttgaaggctcaaggaattgttcttgaagatacaaaagatggggtacggtggcatcgtgaataagcaacaagcagaacttttaaatggaattgcccttgcctatgtgggggatgcaatatttgaagtctttgtccgcgattacttgttagaaaaagggctgacaaaatctgctttccttcaaaaaaatgccacaaaatttgtgtcagctaaagcgcaagcaaaaatcatcagagacatggaagaagtcgattttcttacggaatatgaactcacatatttcaaaagaggacgtaacgctcactctaaaactacggccaaaaataccgatgttgtcacttatcggatttcaactggttttgaagctgtcgttgggattcttcacttgacacaagaaaatgagcgtcttaaagaattttggaatttttgtgtcgaaacaatcgaaaaagatacagcctaaagattactgtctgacagaaaaaaagtattaagcaaattattttaaaaaaagaaaaaaatccgctaaaataggtatgcaaagatacaaagaaaaaaacagcggaaagaagaagagatgtatagagtagttacaatgtacggcaccgatgagccatggtggttctttgaaggctggaaagaagatatagtttcagtagacgaatttgatgatttttataaagctttaaaatggtacaaaaaagaatggtttgagatggctgagaattttaaagaattcactagtaagtcaggattacaaaccgcattttggcaaaatggtgatgaagaatggtgtgaagattgtgtaggctatttgcaacgttatcacagtattgccttgcttgaagattggcatgcgattcctcttgaaaaaaaacgttcaggttatagtaaaaaatcaggggagcttcctgagcgattctgttcaatgaaaaacgaaaattaaaaaatgagaaagtttactttttaggaaaactttctttttcttttctttaaatataaatatgcactaatctttaaaccaatcagtacttattatcttagcaaaaatattgatagtaaaaatatcatttggaatatatgccaaaacttcattaagtgttgaactcgccagaaacctttgtttttactagattataattctttttctaattccaagtttctcacattatctccagttttactttcaaaatctcaatcctaaactttttttaaaaattttattttatttatcttttgtcatatattccaaaaatatccgataaaaaaactactgacagaaaagctgtcagtagtttttatttttctaaataatctaaagcgtcctgaatagtcttgacgggaacaattttcatcttcgtttttaattttttagcggctgctttggctccaagatagttattgctgctttcttttttggtgcctgagtcaggaactaagaaaacttttgcgccttctttgctagcagtagctacttttttatcaaccccaccgatttggccaatgcttccatcatgttcaatcgttccagttcctgctatttcgcgaccaccacgtaaatctttacctgtcaactgactgtaaatctctagtgtaaacattattccggcagatggtccaccgattgaacctgcattgactgtaacttttgggtctgtgactacttcagtatggtcaactagtccaattccgattccagtttttccattagcgattttgatatattttccagtagacttgtgtttacttccatcaatccgtgtatattcaatggtaactgaatcgccgactttttgcttcgaaacgtaagcaatcatatctgcacttgatttaaattcttccccattgactgctgtaatcgtgtccgaaagttccaatttatttttaaaagtcgaatttttagcgatatcaaggacataaaccccttcatatttcagttcatagggtttatttgccaacttgaaggcctgataaacggctgtattttgtgccgtttccatgtaaaactggttgacacgattgaactgcgcatcattaaggccaccggtcatttcttgttcactgtaaatgcttgtaaaactattaaaatgactgtaaatcattgtggcaagattagcgcgcgcaatttgaacggtagtaaggaaaaagtcacctttgtgctcatctttttttccttcgactttgaccatttttcctaatggctcggttgttccaggcatttccacatagtaatttgttggatacactaaaacaaggagagcgacaataatcagaccaatagagattccccattttaatttgggactgatttttttattttttttcttcatctaatttccttaattcacgactcacattttctggaacccaagcgctgacatcttgcccgaaagcatgtaattctcgcattcttgttgaatttagcggttcaagttctggttttgctagaaagaagagggtttcaatacctgtcatctccagattaaaatagaacatatttttttcatattctaaatcttggctattacgtaaagaacgaaccagagccgtcacgtcaagtttttttgcgatatttactgtcaaatcacgttcatgtttgatgactttaactttatgagttactgacagatttgtcagtgcttcttctagcatttccactcgtttgtccgttggaaaaagtggatttttctggtcatttttaaaaattccaacataaagttgatcaaaatgctggctagcacgtttgataatatctaaatggccatttgtcagtggatcaaaagttcctgtaaagagtccaattttttctgtcattacttttttctttcttaatttactgacagaacttctgtcagtaaatgtcaaaattcataaattgatattttagaaattccataaattttttgtctggtcaactctaatttcccaattttgccaggaagttcaacttccttgtctgtttcacagacaacaattaccttttctgtcagtaaatttttttcttgcaaaagttctaagttttcaacaatttgttctttagcgtagggtggatccaacaagactaaatcaaaactttcagacagatttgtcaaaacacgctctgctgacatttttaataattgaaatttctcaggctctttcgtcatcttgatattttccaaaatgacttgttgagctgctcggtctttttcaacaagaagggcatgacccattcctcttgagacggcttcaattgccaaacttcctgaccctgcaaataaatcaaggacacgacctccgtcgaaataaggaccaatcatattaaaaatagctcccttgactttatctgtggttggtcttgttgtttttcctgccaatgtcttcagcggtcttccgccataatttcctgaaactactctcatgaaaataattatatcacaaaatttcaaatggagagccgaatctccctgtaagccttggtctaaaggttctgtcagtaaaaattttcttattattttactgacaaaaaaataagtttctcaaatcagaatttcattctaacttttgaaacttatttttacctatatttaactcatgaatgactttcatgcatccgaattgctcgtagtgaaggtagcacacctaatacaataatgaaaaacatgaagatggtcattccaatatttccataaagacttgagagggacacaaggattcccgacaagaccgaagcgataggctgagtcactgaaaaagctcctgtataagttcccacttggtctccgtccattaaatcggcccgcagagcctgagaaaatggaaccaaaatcatttcaccaattgttgccaccaaagccgcaacaagttcccaagtcaaatcacggccaagaaatgcaatcatgaagcccaaaccttgcaaaataattccaacggatattccgctacttcgtgaccaatttttggttagtttattgactcttcccataaacaatacgacgactaaggtattgaccattaggaaaattgtcagcatccgttgtccataaacttcaatgccaaaaattctggcggttctaaagctgtcactcaagtgaactggcagataataatcaatttgattaaaaatcatcgcaataaagaccgaagcaaataaataatacatgaaaatgcggtctttagcgactgtgaaatgggctttaataatatttgattcttgcttgtgctgctgagtatctggattgaaggattcatcaatccaaaaaatcacaaccagacaacttaatatttcttcaattgtaatagctaaaagtagccaaaccaagtaatctctgaaaaaccagcctgagagtcctgaaccaatcatgattgcaaagttgataatccagtattgaatactataaacgactcgccgatttgcgctcgttgttaaatctacaatcatcgcttgacttgcggtattaaagaagccaaaaccaaaattaataatgagaaaacctaaaaaagttacccaaggattgaaataaaagggcgagtttgcgaatgttgctaaagctccaccaaatccagtgatggcagttgagaaaatcatcacaggtcttcgtccctgaacatcggacaaatgtcctgcataaagtccaaccaagaagaccatgactgagctaatcaccaaaagtagtcctgtgattcctgctcccatatatttattgtagtagattgtcattgagccacccactgtactaaagcaaagcgtcccaaaaaaattcataattaaacgaattttaagtgttggatgtaatccaaaaaaatctttcattttctttctttctgttttctttcaataaaaaatctatcttgactccttttcaagataaatttctttttttagaagtcatttttttaatttaattttgttttctggtgtctatttacagcaataagcactaaaataatcgctagaacttcagtcaatgctaagaccaaagaaactcctgttgccttaataattggtgaaatcgaaacaagtaaaccggcaagaattgatgcaattggcattttaattgctgcaacgccattataagaaccaattttttctggattcatcaaatctgcacctaaagtttgaacacttggggtataaacaatctcacccaaagtataaacaatacctgcaataaaaattggtgtaaaagttgttgtcaaaaatgaaaaaatcatcccaattgccataaataaacttccccaaataaatcctttttggtgtgaccagtccttggtcaatcgatttagggtggtcattaataggaccactaatacacaagctaaaatcaaataaatcgtaagcatccgttgtccatagatttcaaaaccccaaaaagtgattgttttaaaactatttgataaatgaacaggcaaaaaattatcaaattgcatgataataaaagtggtcgcaatattagcacccataaaaatcatgtaagttttatcttgtagtactgtcttataagcctgaaaaatattctcggctttctcatcaactttgactgtgggtataaaagtttctatcattacaaaagtagtcaggaaaaatgagactaagacagttaaaagtaaaatcactaaaagtgcttcaaaagctggtctaaaaagccaagcacctaatgctgcccctaaaataaccgataaattttgcgcccaatagtccaacataaaaacaactttacgattttaagcattcgatgcatcaataatcatggcatttcctacagttatcacaaaattatagccaaaactaatcagcaaaaaagcaataaaagttgaccagggattcacatgccccggtaagtttgaggcaatagctaaagctgctcctaaaagttgaataattgttccaaaaaccatcactggttttcttccatttcagtcagcaaaaaagcctgcaagaattcctgcgacaaaagttgccacagcagataaggcaagcaaaatccctgtaattgcacttcccaaatgttgattataataaatggtcattgaagaaaaaacggtgccatatgaaaaggcacctaaaaacacaatccctaaacggagttgcaagtttttgtctaaattccaaaactctttcatactattccttaaattattttaaattttctaaatttattaatttatctataattgtagcatatttatacttctaaaactagatgaattacatctttatcaaaataattcttctacttatatcagtttttgttaaaataaactgtaaccaaacttaatttgatttgttatatatatgagaggggaggaaatggtgaatttaaaagaatatgaaaataaagtcaatgattatgcgatagaaatcactaaataccttatctctcgtggaagtcagttgatcgatgccgaagatgccgtacaggatactctagttaaaattttaagtctggatattttcattgaacctgacaaattacgggcttttatgtatcgaacatctatccgaacttatatcaatagttataatcgaagtaaacattatcaaaaaattattaaaaatttggaaaaagaattggaaacagcagcttttttagttgagtatagcccacttccaaaaattattgaacaactttccccttattacaaccggcttttaactgcatattattatgaaaatagttcaactaaacagcttgcagaatattttgaatgtagtttaagcaaaatcaaaatcgacctttatcgagctcgaaaaaagcttaaaaaacaacttgaaaaagctggttatgaccagtggttactttaattgcctatcgaaaggatttaaaaatgcgtactctcttaattttcccttaccttgttctagctattactttcttttttggtttgcttcgtttgattctttttacagtcaagaaaattcaacgtagaaatcaatcaactaattctcattctaatctcaacaatgattttcataattttgccacaaaaacaaaattgaaacgttggggaatcacctcttggattgcaatgactattttttcggcatttatagttattgcctggcaagtgaactctgctctcatggaaaaaaattattttaagacttttgatttttctactgctactctcactgctgcggcaccaaatattggctataataatcaaattatcaatgattatggtatttttaattccaatcttcattcagatacttataaagatatagatggttatcgtgttccttggcaagcttttgattttgcatttggcgtttcaaatgttgggactttaagtcttgatactttaggcacgatggaaaattcaaatgcctatttcactcaaacaactaatcaaaaaattgctagttttttctctacaaaaacaaactacaaatctaaggaatattatggaattttcccaacccgtgacgcaggcaaaatttcacagcttgcaaatcatgtggccgaagcggcagtcacttttgacaaaccttatagctataaggaaattcaaaaaatgattccagaagacctcctaatcaattggtattggattggttacaataataccaaatcacttgcagcggcttcacaaactaattggtttggtttgatgagcaacagcaatcatactggaaatggtaataattcacaacttactggaaaattagacaatgctgcttatcaagatttcaaaaaatcattaactgagattgcgaaaacgaatcaaatcacaattaatgactttagcccaagtaaagatgcacttaaacaggtaaaaaaatatcctactctcaaatcagcaaaattttcgggagttattttaacaggacaaactaagaattttgcgaatttagataaaaatccttgggtttatgcaagcaatgtcggacttacagtagaactccgtcctgatattcagccactcaaataacaatttcactgacagatttatcaacagaaaatggatataaaaaaatcactgacagacatctgtcagtgatttttatgacacttttaatcaaagattaaaggcggtcattcaattctttgctgagttcttcaaatcctggtttaccaagaagagcgaacatatttttcttgtaagcttcaacacctggttggttgaatgggttaattccgttcaagtaaccagaaacaccgatagcaagttcaaagaagtaaattgcatagccaagtgtgaattcatcttgttcaggcaatgtcacgatcatgtttggaacatttccgtcagtgtgagcaagaagcacgccatcagctgcttttttgttaacgaagtcaacatctttaccttgcaaataaccaagtccatcaaggtcagcgtcaagttctggaatgttgatgtttttacgtggtttttcaatacggattgctgtttcaaaaacagtacgtgttccttcttgaatccattgtcctaatgagtgaaggtctgttgagaagttagctgaagttgggtaaattcctttttggtctttcccttctgattcaccagccaattgtttccaccattctgagaaatattgaaggcttggttcgtaattgatcaagatttctgagaattttcctttacggtaaaggatattgcgaagtgcagcgtatgcgtaagcatcattttcatgaacgtttgtagaagtgtattctttacgcgcagcgttagcaccttccatcaaagctgtaatatcagcacctgaagctgcgattggcaaaagtccaacagctgtcaatactgagaagcgtccaccaactgaatctggaacaacaaaagtttcccagttgtttgcgtcagcattaacttttacagcacctttttctttatcagttgttgcgtaaatacgtttgtttgcttcttcgcgaccgtattttttaactaacatttcttcgaagacacggaaagcaatcgctggttctgttgttgtacctgatttagagattacatttacagagaagtctttgtcagcaacgtaatctacaaggtcagccaagtatgatgaagaaattgagttaccagcataaagaatacgtggtgctttacgttcttcggcagtttgcaagttaacaaagctgttgctcaaaaagtcaattgctgcacgtgcaccgagatatgaaccaccgataccgataacaataagtacttctgaatcagattgaatttttttagctgctttttgaatacgagcaaattcttctttatcgtaatcttcaggaaggtcaagccatccgatataatcgctcccagcaccttttccttcgtggagcaatttagctgccccgtcgatttgccattggatttcgtataattcattttcagctacaaatggagtgagttttgaatagtcaaatttaatatgagccattttaattcctttcaatttctcgctttttacgagaatttagctattgaagaacgacaacttttgcattgttttatcttcgaattttctagttcattttatcactttttcggctttttaacaatactaaaggctatgtaagcgcttatttgtttagctttccacttctgaaacttcctcatctctttaacgactttttttgaaataaattggcttaaaattccaatgaacattaattgtcatcaaaagatttactgataagttcattagcagattttttgagggtgtcaaatctctttgacgactgacaaatcagtctttcataaaaatttttgctaaaatattaatgatgaaatatacatttgaaattgaccttgaccgttataaaaatctagcccagcaaaaacaaaagacacataaaaaatttttagctggacttgccaaaaaaccaccaaagcaattagataaaatcgctaaagaagttcatgaggcagtttttttagaaattgactgtactaaatgtgccaattgttgcaaaaccttaggccctctttggacagaagccgatattgaacgcgtcgcaaaacatttaagaatgaaagtgaatgactttgaagccacttatctccgaactgacgaagatggtgacaaagtttttcaaacgatgccttgtcagtttcttggctctgacaatctctgtagcatttacgaagttcgtcccaaagcttgccgtgaattccctcatactgaccgtaaaaagatttatcaaatcaacaatttaacgataaaaaatacactctactgtccagcagcttatgaatttgttgaaaaattgcaaaagcgcttagattaattggctcataaaaaatacaatttgataaatttatcaaattgtattttttatatatttttctagtttttctcttgcaacttctgcattgtatttttctggtaatgacacttcatttcccttgtcatcaaacatcttcccagtcataccagtatatctttcgtccaaagataaccttcgaccaacggcaacagaatgattggtcagatttttggtccaagacatcaaatcactctggacatctccgggataaaacgaattaaccataatatttttttcaaaaagttcttttgaagctaatttcataagcaaggttttatgagtaatttcccaaattccacgctctaccgtattcttttgtccagaacaaatcattcctagtctaagcacttgaaaatgtccagttaccaaagcaacacgtgcttgttcacttttttctaaaagcggaacaaacaggtggataagctcagcatgcgcctgtaaattcgtgcgaatatttatttctgctgaacttgggaaaacgccaaaagtatcgattaatgcatcaatatggtcaaacttttcaccaatctcttgaatcaactttcgttgctcatttttgttagtcaaatcagcaataagaaaatcaattttcccgtgagcctgatgactcaccctttgagcttttgcttcactgcacccaataatcagaagtcttgcttcatcatctctaaaacccaaagcaattgcttttcctacaccagaagtgccacctaaaattacaatattctttttcatagcttcagtataggaaaattgagaaagaaaataaaataagaatccttatattttgtcaaataccttttctttataaagttcggtaaaaagttggcttttagaaaaataggctctacttttatcattttcaacaagtaaagcagccaaataataaaagttggccaacatataatgagaatgtgttcagaaataaattggatccctttctcaagtgtcattaatgctaacttatttttttccaattttttataaattactgctctcaaataataaagaacattcaaattttcatcataggaggtcttttctaagtcctgaaatgcagcttcaatatattcctctacttgtttttcttgatgattcactgccgaaatcacccctaaactcatccagctaaggcgagaaataatcgttaactttttttggtcaactaaagctaagcgcaagttttcttgtgcctcattaagttggccgagttgagcttgagacacgcctaaataatagtaataggcttgcaacccctcctctgaaatggcatctatagttgaatctagcaacaaaaaatctcgtaattcagcgtattgatgttggcggcataattcttcagatttttgactcaatttttcaatttgactcattggaaaataatttttcaaatttgcttgcagctctgaaattcccaatttttgataaatgccaataaaaatatctgctgccggcatataatccccagcttcaatatgagatagcagagcctgtgagcaaattccttgtgccaattctgcttgagtaagtcttaatttttttctttcttccttaatacctttaccaagcgcttttttattcatgcatttattatagcagaataaaaaatttactgacaaattgatctatcagtaaatttttcttttattttattaagccaaaaattctttcaaagcttctgttgtctctgtcagtgaatgtcccaaggctttttcaaaatctttagattccacatctaaatcttttgcttcaatgtctttttggaatccgaggaaaagttcggctacaaaatctggaagccctgtttcaactaaatgactgacaaaagacttatcatcagcgacaataacttcaaaatccttatcagatactgattttagtgcttgagcaagttctgcgtacgtgagtgtctttcctgaaagctctaaaacttctggaaaatctgctcctgcaagtacttttgccccagcttctgcgtattcgcgtttcaaagcccagcccactttacctgttggggcattgtaaacaaattttccatttgaaagagctgcagcaataattggcatttcattgtcaaagtaccagttattacgtaaaaatgtgtgggaaatccctgatttttcaatcgctttttcagtataaatgtgatcagcagctaaatcgcttgtcgcagtttctgcttgaggaaaacttgtataaacaatgtaagaaattccagcacttttggctgcatcaaccacatttttatgctcagcttgacgatttcccggcgctccggagacaaaaagcagacggtcaattcctgtaaatgcttgctctaaagctgttaaatctgaataatcagccaaacgtacatcgaaacctgccgctttaagtggagctgctttttcttctgtgcgagccaaaaccgcaatatcagaaattggaaccaattctttcaaaaatccaagagcataagtaccatatccacctgtcgcacctgttactaaatatttcatgttaaatcctccatttatttattattttttatattttaaagtagcttgcttttttgactacctaagtgtataataacattgtactaccaatgtgtaaagtaagcacttaaaagtaagatactatccttttagatactattgtataataccaacgatttgaggtgataaaaaattgaaaaaaatttctgaacttcccgattgccctgttgaaacagcacttgttttgatgggcgaccgttggaaaatgctcattgtccgtgatttattagagcgaaccatgcgctttggcgaacttcaacgttcagttggacatatttcacaaaaagttttgacccaacatttgcgtgccctcgaagaaagcgggctggttcatcgtgaagtctatgcagaagtgccccctcgtgttgaatattcgctgacagaacttggaagaaccctcaaaccaatccatgatacgatggcagcttggggaaatctttataaaaaaaaatcagcaaagcttagagataaaaattactgacagaatttcctgtcagtaatttttgtttaattatttataaatttctgcacacctttacctaaaaaagaattataataaaagtaaatatggaggtttgatgatgacaaaaaatactaaattttataaatttggacttattcttagtatcttcttagtgtttttaacttttgtcagtacaattatttgctcaatcctatctgtaaatttcgtcagaatttctgctgcctcagaatgtttgagcattgctctgctacttttctttttgcagaaatacggtgagcagacagtcagtaaagaagcagatttctgggttccacgaaaatttgggttgggtataagtatcaatcctcatacaaaggcaagtaaaagaatgactatttttcttatttgctttcttgtcttcgctggattctttttgatgtttttatagaaaaaccagtatcttttgagatactggttttttttatttatgattagttttctttcaattcagcaatacgagctttcacagtatcgaatttttcttgataatcagctaatttatctttttctttttggacaacttctgctttagcattcgcaacaaaacgttcattacctaattttttattcactaaatctaactctttttgccatttagcaagttctttttcaagtcgagcaatttcttcttcgatgttaatcaaaccagccaatggtaagtataattctgctccagtaatgaccgctgacatcgcttgttctggaaccgctaagtctttagcaattgttaattctgaaggattagtgaaacggctgatataaggagagacagcattcaagaaatctgcatgttcagatttaatcaacattgggacagctttagacaatggagtattaacctcagcacgaatattacgaacagctgtaattaattcgattaacatcgctacaccttcgcttgctttgtcatcattaaattctggacgtacttttggatattcggcaacaacaattgaaccagaagtgtttggtaatttttcaaagatttcttcagtgaagaaaggcataattgggtgtaaaagacgtaaaacttgatctaaaacatggagcaatactgcacgtgtaatgtctttttcagcttcatcctcaccaaacatgacttcttttgttaattccaaataccagtttgcaaactcatcccagatgaaattgtaaagaatatgaccggctacaccaaattcaaatttatccatttgttcagtcacgcgctcaacagtatcattcaaacgtgtcaaaatccaccggtcagtgacattaccagcagttttatttgcaacttttgtcaaagccgaagaaacagcatcagcgctgacatcttctgcattcatcaaaatataacgtgaaacattccaaattttattgatgaaattccaagcggcatccattttatcataagagaaacgcacatcttgtcctggtgcagaaccatttgataggaaccaacgaagtgcatcagctccatacttttcaatcacatccattgggtcaattccgttaccaagcgatttagacattttacgtccttcttcgtcacgaatcaaaccatgaatcaaaacattgtgaaatggtgatttaccagtgaattctaaagattggaaaatcatgcgtgaaacccagaagaagataatatcataacctgttacaagggtactcgttgggaaataacgtttgaagtctgctgagttttcatctggccaacccattgttgaaaatggccacaaagctgaactaaaccaagtatcgagcacatcttcatattgtgtccaaccttcgccttctggtgcttcttcaccaacatacatttcacccgcttcattataccaagctggaatttgatgtccccaccaaagttgacgtgaaataacccaatcatgaacattttccatccattgcatgaaagtatcgttgaaacgtggcggataaaattctactgcatcttctgtcgcttgattagcaatcgcatttttagctaattcgtccattttgacaaaccattgtgttgataaacgtggttcaacaaccactcctgttcgctctgagtgcccaacttcgtgacggactggttttacatcaagcaattgacccaattctttgaggtcagcaacaatttgtttgcgggcttcaaaacggtcaagtccttcatattttccaccattttcattgatggttccgtcattattcatcatgttaatcattggcaaatcatgacgcatcgcaacttcaaagtcattagggtcatgagcaggtgtaatttttacaaccccagttcctttttccatatcagcatggtcgtctgtcaaaatcggaatgacacgattaataattggtaagataacatttttgcccactaaatgtttatagcgttcgtctttttcattgacaataacagccgtatcaccaaggaaagtttctggacgtgttgtggcaatttcaacaaactcatcacttccttcaatttggtaagtgatgtggtaaaaagccccatcaatttctttgtgaatgacttcaatgtctgacaaagcagtcatcgcttttggatcccagttgatgagtttttcaccacggtaaatccaacctttattgtaaagttgaacaaaaactttacgaaccgcttgtgaaaggccttcatcaagagtaaaacgttcacgagaataatccactgagattcccattttaccccattgttccttgattgttgtggcatattcatctttccactcccaaactttatcaaggaatttttcacgtccaaggtcttgtggtaaaataccatcttcagcaagacgggcagcaacttttgcttgagtggcaatccccgcatggtccattcctggcaaccaaagcgtatcaaaaccttgcattcgtttttgacggatgatgatgtcttgtaatgttgtatcccaagcatgacccaagtggagttttcctgtcacatttggtggtggaataacgatgctataaggcttggcatcgggatttccagaaggtttgaaaacatcagcttcaagccatttttcgtagcgtcctgcttcaacctctgtcgggttgaattttggggttagttcgtttgtcatatttttctccttgtatatcttacaaattttttaatttattttccgttcttagctctatcccattcatgtttcaaataggtacttatcacttcacgaaactttggtaaatatttatccaggtactcttgattgtcagaatatttttttagattttgagctagctgaataatatatgtatgtttatttttatttttgtcagacttttcattttctttttctaatttatttatttcttctaaacaaatttcaaattcatcactatttggtatagctgatgtttcagattcattcgtagtaaaaaataaacatactgtctcaatttcttttttaaaataatagcctgtgtttttatcagcatatccacgtgataataactctgctgtatggtttcttacctcctgaatccattgaattcgtgcctgcatttttatattttttttatcttgccatgtcttataaaatgctccaaaaattactcctcctaatgccactaagcctactattaaagaaacccaatttgtataactcatttacctcatcccctttacatcatatatcaaaaataccgcccacaagcctcctaaaaataggacgctcacgcgcggtaccacctaaattcctgacagatttactgacagacactcattttatgtcataattactgacaggattggttacgacttcgactagctactttagtagcgtagcgagaatcgatattcgaggcaaagccgaagatgtcagcaattatttcttgaaatgacgcaaccttcataaagtttgaatgaacactttcaccagccgtgttctctctataagtcttgctttattactcctcgtcaacttgtttttattttagcagaattcttgtttttttacaagatacttctaaatttttatttttctttgatgatttctaaaaaatgctccaaaccttctttggcttggattttctgattacattgttcagaatctaagcaaatataggtgccatttttagtataggtcccgtcagcacctctttttgttgtcgctagaaattgagtgacaatacttgttttttggcaaatggcacagatatttttcatactgccagagatacttccgtaaaatccacgaccatcagcagtcaaaagatattttcgtccgcttgaaacttcattccaagcaaagtaagtgacatcacgtaaatcccattgacttgtcgctggaatttttaactttttaacttttttgaatgcttttttcatttgagcttcgctcggtaaatgaaaagcttcgactaaagttttaagttctgtcagtaatttttcagattgttctcttgataatttaggattatcaatggctgataagtatttttgaatagcaacttttactgacagattattttcactgacaagactgtcagcattttcagcgatttgcaaaatttctgtggcgacttgggcatagactgcttcaacagtcgatttatcattgacagagtgatagacattgacgaggtcaaatgtcaggtatttaattcgattatattcatatggttttaacattttcttattccttaagatgtgaacccgactgctttgaagttatgaaatttaggaaaatgcggttctgggcaaggcacaggtcccgttttatctattttcactcaacttcaaggagggtgaactcaatttgttcttatccgcaaagaaataagactttgcggtaatctaagcgagagctcttactcgcacttgattaccaaccatcttcttaaaattcatttgaatctccttaagatgtgagcccgactgctttgaagttatgaaaattaggaaaatgcggttctgggcaaggcacaggtcccattttctctatctacgccactacgtggctacgctgtccattcgctctaagcaactaaagttgcaaggcgaatcgcattttcactcacttcaaggagggtgaactcaattattaattaaaatgtttttgttccaaaatctggaacgtcatggaaatctttcccatttttgtagttctcaaattttccttgcaaaaattggtaagcgtctaaacgactttcatagcgaatagcagcttctttcgcttcttttttaccatcttctgtggcaattttttcagcagctttcatggcaagttcagaaatttgaacttgttgatctacccattcttgaaaatcttttaaaaaattttgttcgtaagtcattttttctcctgtaaaatgtgagcccgactgattaggagggtaaactcacttcttttaaaaatattagtatctttatcttttgggtttgattaaatcatagctttgctcaaccattttgcatacttgctcatcagcgacatctccaccaagtaacacatcattccaatgtgttttattcatatgaaaggctgggttgatatctacaaagaaatctcgtaactctattgaaatttctggtttttgtttaatggcgatattgactcgtccttctcgctccgaaatataagcaaaagattttttattctttaaatgacgcattaccactgtcggttgccccgtctccattttagcaaaaggagtatccgcaaaagttggaccaagagataagcaaaaatcaatcaattcttttttattcatttattctgcctccaacttctagttggtaagcaaaacgttcgccttcaaactggacaagccctcgttttacaaaaccttcacgttcaaaaacatgttgcatcagtttattgactgggtgtgtatctaggcgaaaatctgagtatcctttagataacattaaagtaaaaatatttgaaaataaatatctcgtcagcgattgtccacgaaattcattagacagagcaattcgatgaatagttacataatcaagattttgatttgaccaagttccgtcagtaatttggctataagccggttcttcacctgtaataatggcacaataacctgctattttatcatcaactaataagacataagcctgttctttagcaaaatcctcttcaatatcaagaactgctggataagcattttgccattggtcactcccagaagcggccaaaaaagctctcgcttcttcaataattttcataattgcaagcaaatctttagggccagcttttctcatatatatcatatcaaacctcggattttttctattttatcataaaaataactaatgacagaaccgccagattttactgacggtccctttttattgacagtattcatcaactttactattaaatctcttatctgttagtaaattgcgccttaaacagtcctattttattgacagaaatcagtaaatctaacttctttagatatcataaaacactagtctaatgaaatttctggattttccttagtcactaaaagtacctgagcagttccacctaaatatttttcactcaattcggctaatttttgagtcgcagcttctaaaacatcctcacgttctgggtcaacagactcaataatcaaaaaagcattttttgtgtgttctgtcagcattgttctttgcccatctcgccagttccaagagcgacaaaccgccccttcgtcatcaagatagcagatttcaccagacaaagcattatcagcttcatcatcacctaaagccaaaaaatgttcgccaccaacagcttttgtcagtcgcaaatttcctgcaaaggtatcaatatcttcaccaccagcaggcaaaccatagttcaagctgatactattgtaaatatcaaccaaaggattgatggaacctacagcttttcctttatctactcgtttaagtagattttcaatcgaacttctagcccctttttttgttttaaattgttgataagccttgcgccaaacagagactacaggattttcgctaaaaacagctgcaccaagaaatttctctgcattttcatttgcttcatcaagatttttttgatttcagtacttgattccatactattatcaatatttttggctaaaacaattccgatttgagtttcaggaaaaagttcccaaaattcaggttcaacaataaattttttcattttttctctcatttttcctaaaaattactgacgaaaatttctcctcaaataaatgaatttatagccaaatagtcattttgtcagtaaatttctcagtatttaccatatttttgcggacgacgtccacgttttttacctttagcaaatgcttctgctttacgttcttcttccaaatgttcaaatttcacaattttcaacggttcatcgcgttttgtcaatttaacaactgcttcagtccgcgctgtatgtgggaacatatccactgattgaatgtattctactttgtaataattggccaaaacgactaaatcttttgctaaagttgatacgttacagctgacataaaccattttttccggtgggaatttagtaattgtttcaagcaaggcatcatcaagaccagtacgtggtgggtcaacaatcatggcagtcgcacggtgaccagatttattccagtttggaataatacgttcagctttaccaatttcatagtggcagtttttaagacccaaacgtttagcattttcacgcgcatcaaagattgattctggtgtaatatccattccgtgaactgatttgacttttttggcaactgcaaaaccaatcgtcccaacaccacagtaagcatcgatgacacggtcatcttttttaggattcaaagccttaactgcttcaccataaagtacattcgcttgctcagaattcaattgatagaaagcacgtggacttaattcaaactcatagtccaagaccccttcggtaattgtttctttttcattgaacaaaacttgtgtgcgttcgccatagatttcactggtttttcttggatggaaattgaccgcaaccgtcacaatttcttcaaattcttctgtcagtgctgacaacattttgtcaaatttaacaaaagaatttttttgacgttttgaagcttcttctcgcaattcaggccaaacttgaccgtccaaaataattggtgttgaagtcacaaaaataatttgtacttcgcctgttttttgggaacgacgaaccatgaccgtacgaattccgccgattttacgctcatcataaactggcaaatcaaatttttcaatcaaacgacaaatgtgattgataatctcttgggttttcggatcttgaaccaaacagttatctaggtttaccaagtgatgtgttccttcttgataaagtccagcaattaccgttccatcattcaaacgacgtacttggaactggagcttgttacgatatccaagcgtattttccattcccaaagtcgcgcgcaattcataattacgccatcctgctggtttgtatttttccaaagcttgacgcataacatcccgtttgaattccaattgcattggataagaaagatgcatgatatgagattgactcatttcatgataagctctatcctgcggtttcacacgatttggtgatttttcaataatcttaaccaattttgcgcgactgaaatttctagcattttcagtaatttcaactaacacttcttcaccaggaagcgcataaggaataaagacaagtcgtcctgaaatgacaccaatcccttcaccatttatccccattcgctcgatttcgagttgaagtttctgtcctatttttaaatttatcattcgttaattattttccctctagttcgtcaattaatgaccattttcaatccattataaaaaatcagcaataaaggattgtgtgatacactattataacatttcacaatttctttttgtagtctttttctacttgaattctaaaagatttaaagatatctttttttatttatcaatattaatcttcaaataaaaagcctgaccctgtcagaccttttatttgaagattaatattgttttttacgtttaaatagaatagcaagtggtgaagcaatcaccaccataattcccaataaggtcaaaacaatttgtgatttttgactatctccggtacttgggagaatatcttttgttttattatcttttacagctttagctgttggggtttttggttgattatcagatggtttacttggcttttctggaagaactggtggcacaatgattcccgcaggaactttatgataaacaacagttttttcaatatccgctgtatctaccgtaattcctgtcatttcatcaatcttaagttgactcgcaatgtaatctttaatgattggtgaaagaaccgcagcaaatcttccgccattgtcagctgtccaatcactattagttttctctccagttactttgtcagtagtaattgttcgactaaagacaattgttgccttatagttgtcagctgccttatctccattatcataaacataatgaatgacttcattaactgatttattttcagtttcaactactgtaccatgttttaatctcacaacataatgttgagggtcatcagcgaatttagttccatcttctggataatcactagaaaccaattcgtaacccttatctgtgtaagatttaatcgtatcaaccgttgtatagtttgaagaatctccagttccgcctgacaaatcttttgtagataacactttcccaattgtttcatcaatataagtgacatcaatcgttccttgatttcttgtataagaaaccgttactgaaatatctgctgtatcagaagtgattcctgtcatttcagagactttaagttggtcagctgtataacctttgagcactggcgaaacgacttcggaaaagctgtcagcattgtcagccgcccagtcgctataagttttctcttttgttactttgtcagtacttattgttcgactaaatccaagagtagcagtatggtcctcggctgctttatctccagtatctttataaacataatgaatcacttgattgacagcttttttgtcagtttcatttattataccatgtttcaatttcacggtataatgttgtgcttcatcagtaaagattgtcccgccatctggataatcacttgaaactaattcgtaacctttatctgtgtaagatttaatatcgtcagctgttgtataatttgacggatcatccgttccaccagacaaatcttttttagtcataacttgacctgtcgtttcatcaatataagtcacatcaatagttccttgattacgtttatagattacttttttctcaatatctgtcgtatctgctgtaacacccattacttcatcaatttgagcttggtctggtgtttcacctttgataactggtgaaactactttagcaaaactattaccattttccgcttgccattctccgtatattttttcacccgttacttgattcgttgttaccgttcttgtgaaattcagcggtgtcgctttatagtcctctgcagccttagttccatcttcatagacataatgaattgtttcatttacttgtttttgttccgaacttacaactgatttttgtattaaataaactacataatgctgaggagtatccgtaaatactgctccttgactcggataatcatcagaaactaattcatatcctttatccgtgtaagatttaatatcagcacctgttgtataattcgcagggtcattagttccatcagacaaatctttcttcgtcaaaacttgccctgtcgtctgatcaatgtaggttacatcaatcgttccttgatttctagtataaacataatttacagtttgatcattaaccgtatagtttcctgcttgtgctgctccatttgatgattgataagtatatcctggaatatttttttgctctgtcgtgtaagctgttgtaatgtctccacttgttgttactgatggagcaatcgtatttccttgatcgtcaacatagttagcaattactgaaccttgagcaaccgtataagtaaactcaacattacgaagttgttgtaagttcatattggcaccagttgacgcggcaattgaaaatgacatggcctgattcgttccaacaaaagctgaaacatcttgtgtccaagattgtgttccataggtaatcgacatcgttttagtcgcaccaatataagtcattttaaaatcaacgaaattattatttgttggttgtggaatctcttgagaacccgcagcaatggttttagcctgtccatctaaaccattgacaaaggcaccaaaagcaagtccgctcgcaattgtgatgggtcttgcgtaaaacttgggtcattaaaaccattataataagtgtcaagcttgaaaccgaaagctccttttaccccaccaataccggcagctccaccaggtgcacctacgacactcgtatcccctggatgaaaaaggaaaccaaccccatcagctccacccctgttttgagccttatttcctaagttaatcttcccggtaaaagtaaagttttgtgacatgtcaactttggtcatcaaagtaacatttcccgcttggcttcctttgtcaggcgtcaaagtttgagtataagttgataaatcataattaaacccagctgctgacccatttctttgaaaataagttaaaaagttggttggatatacagtcacttctctagaagttgctgcataaaccttttgtattttaaaaacatcaggcgaatgtgttagaacaactccaccaccagcaagaatcgttaaggttcccatggttaataaagcacttgattttttttcattagttcgtctccgtcataattgtaggttatttgttataattttactacagaaaagggcgaatatcggatattttgtatttaaaatattacatcaagtcaagacatcatttataaaaaattaaaaaaaatagtcatatcaagcctaagcaaagatttagcgataattttacaaaaacaatcatcttttacaaacaggtttatatactacattttttcatataacttatcaaatagaaaaaaatcagtctcttatcttattttttgtcacatttttgtcgtttgattcatcagtgacaaattcctaagattttcgtatataataaagatatgggaaaaatcacagcaataaaaaaattaaaacgactctaccgtgtcgatctctctgatctagatgaagaaaaaatctacctctgtgaagatacaatcatccatttttttatcacgattgataaagaagttagtgagactgatttagaggaaattctagcgtatgatcagtttgctcaagggaagtccttagccttgtactacatttcatttaaaatgcgtacgggcgctgaagtaagaaaatacctactagaacatgacatcaatgatactgaccaaattgaacaagtattatcagtacttacagaaaataatctaattaatgacaagtcctatgctgaaaattttattgaaggtaagatttcaatgggaagtagcggcccctatcaaattaaacaaaaattactgaccaaaggaattagtaatgatgtcctgtccgaagccctcaacgaaatttatagcgaagaaaaacagattgatgtcgcttataaacttgctagcaaattatccagaacctatggaaccagattaacactaaaacaactaaaagataaaatcatccaaaatttaatgaataaaggtttttcttactctgtttcttccatcgcacttgactctcttgaattagaagcggatgaggaaaatgaaatggatcttctctattcagagcttgataaagttgccaaacgttacaccaaaaattatgaaggatatgagcgtaagcaaaaaattacccaagccttagctcgaaaagggttttcctatgatgacattagtagcgcattgcgtgattacacattcccagaatatattacggctcttttttagaaggttggataatttttcatcacttgaccttccgaaactcccaaacatttcataaaggggagaatataatcaatgtcttcaatatttttctttttcatcaatgaaattcgactaatgccttgactcacttcaacggttactttatggtcgtcattgatgaaaagatgaatactatcgcaggctcccttatggatacttacgccaagaatttttccgtcatgtacttcacaagtttgagctccttgtaagtaactgtccacaactaatttcatgaccttagtttcaattttatgagttttcgcgatttgctgattgtcagtttgttcttgttgggctatttccatgttcatgtttttcatggtttggctcctttccatttcttagttctattttaccaagttttttattagaaaaaaatgatatgaaaataaaatttatttaatactttggtaagaagctaacttttactgacggtcaacaaaaaaactgacataatcagtctttttgtattttataaagaaaatcaatgaccgcttggttaaacttttcaatttcttccaaatgtaaaatatgaccacagccttcaaaaatttgaaattcagaatctggatttttttgtagttcacgcgctgcttgggcatgaatagccggaaaaataggggattgacctcctgaaaaaaataaatgtggcttttgttcctgagtcagttgagctcgccagtcctgtaaaattacattttgcaataagggacgaaaccgtttaaaatcaaatggtgtcataccatgtcctaaagtgcgtttaactgtatctgaaagttttttttgagtcaagcgagttttggggaaatcgtcaataaaagatgataattctgttagtgttttcccatattgaccatttaaccagtcagctgatttaaaaaaagttggcgcttggtcttctgtgattactgctcttacattttcgtcagtaaataattcttcataagccataattgttgccgcacccattgaatgtccaattaagatgacgttttttagttgcaagtggtcaatcaattcttttaaatccatggccaatcgatgtaaagtcaagccataatcaactttctgtgaatccccatgtgagcgatgatcataagtaatgacccggtatccggcatttacgaaagcctcaatttgtgcaaaccaagtcacctcacttgatgagtaacccccaatcaaaataataggaggattcattgagcttccgtaatcatgaaaatttatgtttactaaatcatttgtggtaaaaaaagacatttttttcctctcaagttttttcaatgctttcattgtatcaaaaaatctgccaggactggcagattctgaactcttgaattgctgacagactcgtcagtaattctcattttttaataatggacttatttaaattgaattaactcacattattcttccaactgattcccatttgaagcaaaaacttttttgaaccaataaaatgatttttttggaatacgtttaagacttttagggtcaacataaacagctccatagcgtttatcaatatttcctgatgaagcgggaatatcaattaagccccagccaagatagcccagtactttgactccgttagtaaatatcgctttttccatagcttccagatgtcttcgatgataagaaattctcaggtcatcagcaatttcagttttcccattccaactttctgactgaccaattccattttcaataggaaagactggtaagccaaattcattatataatctacttataattcttctaaagccttctgggtcaatggaccagtcccattgattatgttcaagcaagggatttaatttcatccctttagtcaaataagaatttggcgcatcattttcagacaattgactggcatctaataaaacggaacggtaatatgaaaaagaaataaaatcagaaataccatttcttaagatttcatcatctccttcttggaaattcatatcaatttcctgatttttaacaaaagtaataacttcatgtgaataatgtccaaaagcgtaaacatcacagagattccgattataaaattcatcaaattttctgagatataaattatctttaggagacggactggctggatatatctctgttgtcgctaacattccaccaatttttccttcaaaattctgatgcaaaaattgaaccaattcacaatgagcaagcatcgtatgatgaaaaacagtgtacatatcagagagcgttaggtcttttttcaaaactcctgagtaatgctcaaagccgtcagcaaaataaagattatgttcattgaaaacaatccaatattttactctgtcagcaaatcttctcatcatttcttgcccaaaccgaacaaaagcctctttgacctttcgactcaaaaaaccatcatacttttcagccagatttaatggcatatcgaaatgatagagacaaatcataggttcaattccgtgagcaagtaaatcatcaattaatcgattataaaaagcaattccttcctcattaaattcaccatcgccgtcaggtacaacacgtgaccaagaaatctgaaagcggtacatattcatattcatttctttcatcaactcaaggtctcgtgaatagtcatggtaattatcattagttacttgccaatctttagcccgacgccccgcagtatccacatcataaacggaaggtcctttccccccttcattccaggctccttcggtttgcattgatgaagttgaatttccccagaaaaagtctttaggcattttatctttcatttatttctcctttttattttattaactataaatttctaagtctatttctaataaaaagaaattccgaagaaaaaagcttcttcggagtttctaagctccttattagtttgactaagcaagagcttcatcagcgtcagtttttgcttcttcttctaacagcattttgtcatactttctagcaaatggaagataaatcaaaattgattctaaaagtgcaataacttgtagcaccgcatattgccaacctccgattaagaatccagagataatgggtggcgtagtccaaggagcagcaacaccattcattggcggaacaatatggaaataaattgcactataaaccgttgctgaaaccacaactggaacaaggaagaatggtagagcaagaacaggattcaatacaaggggcaagccaaataagaaaggttcattgatattaaataaacctgggactaactctactttaccaattgatttcatctgttcagaacgagcaaagaaaatcgtaaagataattaatccaaaagtaattcctgaacctgaaagattaataaagttattataaaattcattggtcacaatatgagcgccattagctaaacttagtttgtgtgactgataaagtgaagcattggcaaaagtatttggaatcaagaaagcagaggtaatagcccccataataatcccaccatgaaccccaaagaaccagaagaatggaactaagagtgagataataatgattccgccaaatgagccacctaagccttgtagaggaactgataaccagtggtaaataaaggttactgcatcagtatgtccaattttatcgaacaaagcataaataaccgtagcggcgacgacaattactcctgttggaatcattgatgtaaattgattggcaacatttgaaggaacttgctcaggaagggtaattttccaaccagctttcatcattgccgaataagcccaacctgataaaataccgataacgatggcggctatcattccttgaccatcattccaagttaaattgagcactcctgtcactgggttattcaagaaaacttgcatggcatgaggaagcttttcaaaagcagccgttgcttgggctcccgtgagatttccaatacctgaagcttcttttccagtggatagagccgccgtaattggatttgcaatacttagagattgaacaatgaaaaatgcagaaagagaagttaaaccaccttgcaaagccacatcaccaaaacctgcctctttgacataagaataaccaatcccaactgctgcccagatggctagaataccaaacgaaacactgaaagcttgtgtaaaaatagcggaccagccattgtctgataaccatttggcaacaggtggaattggaatgttcgccaaaattaagaaaattgacccaacaatgataaatggcatcgcaaatagcatcccatttttcaaagccgtcattgctcgtgtattcacgaatttcataattggcggcaatactttattatttatgaagccgttcataaataaacctcctttaagatgtgagcccgactgttctgaaatgaggaaaatttttggttctgcacttgtgcaggtttaaaattttatctatctacgcagcaagctgctacgctgtccattcgctctaagcgactaaagtccgcaaggcgaatcgcattttcactcatttcaaggagggcgaactcaattgattaagatgtgagaggtgctcgcttagagactatggcaaattttatcatttttcataagtttctagcacaccgaactcagttaaataagatgaagtaaaatgtcctttcagacttctctttcaccaattaaaatgtttacaatacaataataccccttacaaaaatatttgcaagaggtatttttatctttgtcacatgttacaagattagttacgattatcacttttttctattgcttgatgggccaaaatttcaataaaagcaatgacaggcagttgtgatgtcaaattttcaagagggtcataggcagaatattccgtttgaaagccataagtcagattgatatttgaaagtttggataatgttgtttctggatgattagtaattgaaacaatctttgcggaggcttcctctcttagtttaacgactcgttcaataattttatcagtttcaccagaagctgataagacgatgcttaaaacgtctggcgccccttttcctttgacggcttgataagggtcagaaatggcgtaagattccaggccaatgtttgtaaaataacgagctccatattcagctaaagcgccagatgaacccactccaataaagataatatagcgagcttcacgaattagtttaacagcttcttcaagttttatccccgcttccttagaggttatttttcgtaaaaacagatcgagttgcaataaattttcataataattaactggaatttctgataattgattttgatttttgagataatactttaattctacccaaccttcaaagccaagttttctagtcattcgcatgactgttgcagtcgaaacatgaactgcttgtgcaagttgtctgactgacattttatcgatagttgataaattagataggatgaagttgaaagccgcagtttctagttcattgagcgtacgtacttgctcaggtaagaaatcaatcatttttactgaccaaacctttctataagtacttctgagttatttttgtaagcctgtctttttaaaacgactatgatttactgacagaattctctgattcattgataagtactttttcaaaataaaataagctagctgacaaattcgtcaaccagcttagttcacttttatactttagctatcaaaatatatttactgacagccaatcttgtgggttttatctgatgaatattctaattgtcatttttattttacaacaatattaaccaatttatttggaacagcaattactttgacaacatttttaccttcaagtgcctcagcaacggcttcgcgaccaattttctcaagttcatcacgccctaagtctttggcaattttgatttttgctttcaattttccattgatttgaacaacaatctcaacttctgattcaactaatttactttcgtcaaaagttggccaagcgacataagaaattccagcttcattccctaattttacccaaagttcttcggcaatatgtggtgcgaatggtgccaaaagttgaacaaatccattggcatattccaaaggtaaaattttcgctttatttgtcgcattgacaaaaatcatcaattgggaaatagctgtattaaaatacatcaagtccaaacgctcagagacatttttcactgtttcgttataaactttatccaattctccattatttttgtcactaatctctgaattatcaatcatccgaacgacacgatcaaggaatttacgagctccttcaagtccttcttctgaccaaggaatacttgcatcaagtggtcccatgaacatttcatatacacgtaatgtatcagcaccataatgttccacaacatcatcaggattcacgacatttttaagagacttagacattttagctggtgcttgttcaagctcttcgcccgtttccatatggtaaaatccaccatctcgtttttcaactttgtcagttgcaacgagtgctccacgatggtcgcggtaagaagttcccaaaatcattccttggttaaagagtttttgaaaaggttctttagttggcaccactcctaagtcataaagtactttatgccagaaacgagcgtaaagcaaatgaagaaccgcatgttcagctcctccgacatagatatcaactggcaaccattctttgaggagctctggatcagccaaggcttcagtattgtgtgggtcgatataacggaggtaataccaacttgaacctgcccattgaggcattgtgttcgtttcacgacgaccttttacaccgtcttcacgtgtaacttccaaccaatctgtcaaattagccaatggtgactcaccagttcctgaaggtttgatgtcagaagtcactggtaaaacaagtggcaattcattttcgggtagagcagttgatgttccatcttcccaatgaataattggaattggctcaccccaataacgttgacggctaaagagccagtcacgcaaacggtaagtgatttttttcttcccgattttcttttcttccaaaaattcaatggctttttcaatcgcttgtgctttatcaagaccattcaaaaattctgaattaatatgcggaccatcttcagtataaacggcttcttctacatttccaccctcaacaacaggcaaaatttcaagtccataaactttagcaaattcccagtcacgttcatcatgagcaggtacagccatgaccgcaccatgtccataagaggcgagaacataatctgcaacccaaattggcatcttccgtccattaattggattaatcgcataagcacctgtaaaggcgccagttttttccttagcgaggtctgtacgagccaaatcagatttgaggctggcttgacgacgataatcagcgaccgcttgaacttgctccggcgttgtaattgcatcaactaaatcatgttcaggggccaaaacagcataagtcgcgccaaaaagagtatcaggacgagttgtaaagacttcaaatgatttgtccgttccctcaactttgaaggtaacgtctgccccaactgatttaccaatccagtttcgttgcatttctttgattgactctggccaatccacttcttcaaggtcttcaagtaaacgttcggcgtaagctgtaattttaagcatccattgacgcattggtttacgaacaactggataacctccacgttcagatgtaccatctggtagcacttcttcgttggcaatggcagttccgagctcttcaacccagtttactgctacttctgcttcataagctagtcctttctcataaagtttagtgaaaatccactgtgtccatttgtagaagttagggtcagtcgtatttacttcacgttcccaatcataactgaaacctaagctattgatttgacgtttaaagttagcaatattttcagctgtaaattccgcagggtcattccctgtgtccatagcatattgctcagctggtaaaccaaaagcatcccagcccattggatgaaggacattaaagccttgagcacgtttgtaacggctcaaaatatcagttgctgtataaccttctgggtgtcccacgtgaagtccagctccagacggataagggaacatgtctagggcgtaaaattttggttttgttttatctgtcccagtgcggaaagtttgattatccgcccagaatttttgccatttggcttcaatttcttgatgattgtattccatattaaagatttgagttcaacagtatcaaactcagttcctttctcatatattcaatgtttcaaactgattattataataaattgtaagcaagagttaggtcacttcctgaaagttgcaagccatatttttgctcatatttttttattttattaatcagggtatttcgatggacataaagtaatttagcagcttttgtttgattagcgcttgccttatacattgccttcactagtttttgatcctcaggattttctaataattctttacgaatctcatttaaaatattattttccaaaagatttaagatttctgataaaatatactcactaaaagtagactgattttcaaaaattttactttcttcagcataaacttccgagagcctatttttatcaacaaagcgaccgacataagcggtcacttcttcccccatatcttgggaaagtgtttgaaaaatatcaaaaagttctgaagtggtgggactgtcacttgaaaaaaattcaatgacaatcttttgttctctaagactcttcacaaaatcaggcaaaagtaactttaaggtgttttccaattcctcaaagttatttccggaaaattgtaaaatgcgatagcggccattaggaaggttgtcgatactcaattttctgtcagctgacttgggtcaaccttctcataaatttttctaattttttctagttccattttttaaaaaagcgacccctggtcgcttgaagtcttatcgtaaatccactttgaattctaataaatactagttaggcttagcagaataatcgctcatttagctaaattaatttaaaactagttttaaatttgttctgaaggaagatgtaattcaaagagtggagacaatggacgacgttcatgaatgcgaataatcgcatcagcaagtaagtgagcaattgaaagttgcacaattttttcactttgacgttcttctggcatttcaatagtatccaaaacaaccaattttgtaattgctgaattattaatccgatcaatcgcaggtcctgaaagtacggcatgagtacatgaagcataaacttcggttgccccaagttctttcaatgcgtttgctgcaagggtaattgttccagctgtatcaatcatatcatcaattaagatacattttttaccttgaacgtcaccaataatattcatgatttcagcaacattggcccgaggacggcgtttatcaataatagcaagcggcgcttttaggaagtttgccaacttacgtgcacgtccgacaccaccatggtcaggtgaaacaacgacgatatcatcaccagcagaaactaattgacgacggaagtattcagcaatcagtggtgaccccataagatggtcaactggaatgttgaagaaaccttgaatttgtggtgcgtgaaggtcgaaagtaattaaacggtcggcaccagcaatttgaagcatgtttgctacgagttttgatgtgattggttcacgggcacgagctttacggtcttgacgagcataaccgtagtatggcaagacaatgttaattgatgcggcagaggcacgacgaagtgcatccatcataatcaagagttccatcaagttatcattgacagggtcacttgttgattggaggataaacacatgatcaccgcgaactgattcgtcgatatgaacgacagtttcgccatctgagtgggcaccaacacttacttttccaagctcaattccaatttctttagccactttttgggctaattcgtggttagaagagagcgaaaacaacttcaaatttgaatacgacatgaagagcctttctttaattcctaaagaacacaggagttctattttatgtagttctattttacattaaattctcaattttttcaaacgctcatgggctttattttcatggaaacgttgacaagtaaaaaagaatctactaaagtctgcagattctttttaatttctcatcttattaaaactttataataattctttgaagagtcctctaacgaaaaattcttcatcaaaatcttgtaaatcatcaattttttcacccaaaccaatgagtttaacaggaatttttagactttgaacgatagagagtacaatcccacctttggctgaaccatcaagtttggtcaaagcaatccctgtaatcggagtaacggctgaaaattccttagcctgttgaatcgcattttgccccgtcgttgcatcaagtgccaaaattgtttcgtgcggtgcatctggaacttcacgtttaatgacttttccgattttttccaattctttcatcagattatctttattttgcaaacgaccagccgtatctacaagcagaatatcataattttctgatttagcttttgctagagcgtcaaaaacaactgctgctgggtcagaaccagctggttttgtaactacttcaacttgtgaacgattcccccattcaaccaattggtcaatggctccagcacggaatgtgtccgcggcggcgagaagcacttttttgccctcggttttatagcgagcggccaatttaccaatggttgttgttttaccaacgccattaaccccaacaaaaagcaaaatgctcaatccttctggttgaatatccaattgtgttggtaatttttcaccatcaaacttatcaacaattttttcaataatcagctggcgcaaatcatctgtcgatttagcattgattaacttggcttctttacgcaattcttcggtcacttccatcgccaaatcaacgccgacatctgacataattaacgtttcttcaagctcttcgaaaaattcttcatctactgtgcggaaattggcaaagagttcattgaaaccatcagaaaatgtcttacgagttaaagttaatgattgctcgtattttttctcagtttcctcacgtgattgagtgaaaatattagccaaagcatcaatgtcaatgacaatctcttcctcatcttcgtcagtaacattttcctttgcaagtgttgaaacttctgaatttacttctttgtcagttatttctgctgctttttcatcagttacagataaaacagttttttcatcagtaacgactacattttcgcgctcagaactaatcgttttctctttagaaacaggtccatcagcaatttcttttgaaacttcttcactttcaatgtcaattactttactgacagattcgtcagtcacattttctaggtcaactggctttggacttacttcagtaagttctgtagtttctcttatttcttcttcattcttaggctcttgagtgttctcaacaacttctttttcactgacaggctcgtcatgcttagtttcttcttgtttcttctttccgaagagacggtcaaaaagtcccatattttctccttaatataaatatcatgcatagatgataaagttcatttgtaaaatataaattttaaattaatttttttcttaaaaatccgagtcctaaaagtaggatagcaactgcagaaaaatcaatgatttttgaaattaaaacaaaagctgttgtctttacccagaaagctaacaaaatgactgacaaagcatgacaaacaaaaactagacccatgaaaagtgttaaaatcatcatttttttatgactctgtccttcattcgcaaattctaatagtggtcgattaaaaacaagtgatagtaaaaaaattgtcccaattgccgctgttaaaatgggatgccaaagcttgaaggcaagattattgccatgagtcaaataaacggtcaaaagtgaaattaaaaaaccaattattgccaccaaagaaaccggattaacttcttttctaacaatcaaagaccagaccatatgaataaccggaaaagcagtcgcgattccgagtgctaatgtgtctgtgctgccccaagttttcaataataagtaggcaacaacaggtaaaattattgagaaaattaaactcggcaaatatttctttatttgaacttcatctttcatttcaattccttaaagtacatatttttcaatcatatgggccacggcatgttggtcatttgttaaatcagaaataattctagcttcttctttaacagcgggcacagcatttgccattgcgactccataacccgcccatgatatcatcgataaatcattggcttcatcgcccatagccattacattttctgcccctaaattcaactgatttgtcaattgtgtcaaaccataagctttattaatccctttaggcataaattctaaaagtttagcctgcgttttaaaaatctcaaattcttcaaaataagattctggaattttgcttaattgagcatctagcaactctttatccgtacaagaaacgattttattgtaaacaacatctagtggaacttggtcaaaatcaactttaatgaaagtcaggagtttattcaacgtatcatattgagaaacaacgtcacttttggtcatataaaccttttcttcactcaaaacatcacatggaattcctagttttgtagttaattctttaatttcaagtatttcatcatgagtaaaactttttttagataagatttgtcctgtatttctttgaaccagaccaccattaaatgtaatagaaaagtcttcaaaatcaagcatttctaaggtcttaagaaaaggctgaatcgcaatcagagggcggccagttgtcaacacaacgtggacccctttttgacgtgccgcatcaatggccagtctattttcttttgagatttcttttgaagagttaagtaaagtcccgtccaaatcgagggcaatcagtttaatttctttatccattgctttattataccacaccgagtcactgaggttcaataatggtcaccaattgtgaggcaagctttcttttcttatttttagataattcacaaaaatatttgacaaatcaaaatcttttgattacacttaaaataagaaaacgaggtccaaaaatgactaatacacaagcttctattaacttgttgttgaaggagggctcacactagctaatttagctaaatgtgtgagtcctctttggcgttagtcattgacgaggacgaagagacgtcctcaggacgtctttttttaatattttattatcattttattagtcaatataaagagagacgtctctacttattgatttagaaagctaggaattatcgttggaaactaatcaatccttaaagaaaaaaatggcggcacgccatattacaatgattgcccttggtggggcaattggtgccggtctttttaaaggaagctcatcagccattgttgccgctggtccctctgttttaatcgcttattttatcggtggtatcgttctttattttgtgatgaagagtttagaaaaactcgtgctcagttcaaaaaatccccatggtctatctggacttgttcagccttatttgggtaatcatacagctgattttacagactgggtttattggtcaatgtggatgataaatatcattgccgaagccgttgctgctgctagctttttgcagctttggtttgctaatattcctacttgggtctttgttttaatcattgctctcttaacttctcttattaatttattttcagttgccctttttgccgaaacagagtattggttggcttttatcaaaataagtgttgttattttattgattatctttggggtttatcttgtggctaagcaagtattcaataatgatttaattactacattctccggaatgactaatcatggtggctttgccccacatggtctaaaaggagtcattaattccttactgattgttatttactcttatggtggttctgagctaattgctattactgtcagtgaaactcaagatccgaaaagagcaattcctaaagccattcgcggtgtaattggtcgtattatctctttttatattattcctatgtttttacttcttgtcatttataattggcaaactttggctgtttcttcaataagtccttttgtcatggtctttaataaaatgcatattccttttgccggagatattgtcaatctgattatcattctagctcttttctcctcaattaattctggaatttatgcttcgtctcgccttctttttttccgtttgaaaaatcgtcaaggaaaaatggcccaaacaatgtctcatttaaataaacaccatgttcctcaaagagctgtccttttttgttcgggtacactatatatcggagttgttctttcttattttgttggtgaccgtttatttaattacctagctggttcactttcctacactgttttggccgtttggttcttaattagtctcgctggatttggtctctcccttaaaacaaaatcactttctgggaaaacgatgagtctccttgccctaattgctctcttcttcattctcattggtattctatttactaacccaatcggagtgactgttttcactgcaattctttatatcatcatcttcatcagttatcgaaaaaagaatgacgccgtcagtgaattaaactaatcaaaaaaagcttgatttttcatcaagctttttatttttgctgacaatactatttgctcttatttttttgctcaaaagatttttgaacaaaataacctgaaagccaaatagcaaataaaatccctaacacccccaaaagcatcgctgcaacttctgccatcagtaattttgagttaaaaatatcggccaaacgataatttaaacgtacaaaccagagaattaaaccaactgtcgctcccaaaactccaaaaaatagcgtattgactgctgttcccaaaatttgttgagaaatgatttccctttgacttttaaattgctcaagactcatggactcatcttgctcaacaacttctgaaaggctggcagctaaagccatggctgattcagcaaccgcaccaagcatggaaataaccatgaccacaattgcgacatttgaaaaattaagacccacatttaatgacagattttctaattcatcaacatcttctgttgcaaatccttgaaattgaccaaaatgttgaatgattaaagccagaataagcaatgataagacaacaatgatactcgttttaaaggtaattaatgtgacttcactttcatcagcagacataaatatggcgattgccaaaataattactgacaggataaccagaacgactaccgcattaaagccccatgaaattaaggtaatcagaacaaaaatcgcaataaaattgaaagctaaaccgataagattacgtaagccatcttttttggcaactaaaatcatcaagacaattaataaaatcaagaggataaggagtgcattcatagtgaaatcccctttccttgatgacttctagccagagcaaaacttgtgaaaacagcggtaattggaacagccagtacaatcccaatggccgaaatgattgtttgcaataatccaagattaaggccaaccgtcgcaatataagaccaagaattgccatctctcaataataagagggtcattggtaaagtttccgccataaaaatcatgaacaaaacatttgtcaaagttccaataagctcttgaccaattgaaattcccgatttaatataatctttgctagtcatatttattttgtttaatttattttgtctatccaaaccaaaaagacctgcaacaatatcacctgttccgtccatgattgctcccaaaaccgaaatcattgtgccaacaaagaaaaattctgatggattttgggtcacataatctaaatattcaaagtgaatgccagaatttcctgtcatctttaaaacgaataaaacaatcgaaaatgttagagccgttgttaagactgtggtaataaatgtataaagcatctgccttgttggccctaagacaaacaagagcgatgaagccgcaaaaattactgacagaagtccaaaaagtaaaataaccggtggattaaattcaacattgaaggcgataacaatgacaaagtataatagatttaaaatcaaggataaaagcagaaaaagcgaagccttaaagcgttcaaaactgattagaaaaccaataaataaaacgacaagagcaataattaatgcatctctttttaaggttacaatctgataatttcccgaaattttctttaaaatcacttgctgaccgactcgatatatctgtccagttgtctgcgataaggttgtcgtattctctaatttcaggcttttaggttctgaatcctttgcattgaggacttttatcgataattcttgtgttatttggcggtctttattttggaaatcatcactaacttcatgattgcttagcgttttagcaacacttattttcccaactggtgccttatacaataattggtcatgactaacgagaaaaaatgcgacaagagcaaatataatgggcagtagcatttttttgaatatccattttatattcataagtttccttttacaaaaccaaaaataattatttttagttattattttttaaaatgacaaatcaaaagacgacaaagctgccgtcttttttattaggcttttaaatcactgaccttatcagaatgttctatcgtatcatgcaaagttgctaaagcttctttagactttccaaaagtgaagaattgataacgtttgccagcataagaaaatccaaaaccaaatttagttgtttttacggctgtaatatattttaaatcaattgttttcattcgcacacgcggaaaagttgtaaaatgaagctcatcatcagcaatgaagaaacgatgtggccaaatcaaagtgataaagataatatatgaagcaattgccaaaatagtcaaaaaccagttgccctctttattaaattcataaaaaagtgtccgctcgaagcttaaaataatgatgccccaaagcaaaaccaatcgatgattaagtgacactggaagaaaatatcctgttttcattggttcctctcttaatataaaatgctgataactttggaaagttgaataggtcattctaaagatttccgtcagcaatttatttatttaatttttattaatctttcacttttggtgaatcttgtcatctttggacttctggaatatcaactgaataatctggtaaagttgatttcccttgattttggctcagcaagctatttgatctagctgctaagtcttcgttttccttcttcagtttcttctcagttgctttgaccgtgtagttgtaatctttagggtcaacagccttgaagccttccggcgtgtagaatctgaggagattttgattatttaatttatcagatgctttcaagagatcagaaactttttgcttggtttctttgacatattgttcttgttgagcattaagtttctcaatctgcaagcctgtttgggtgtcataaaaacttccattcaaacttggctgcgtaattgttggtgtaacaaatccaccatttcgcagagccacaaagtcttgtcggccagaagcaaacatatcttgaccaaattgaacatatttcttcgtatcaattccaagtaaatgttctagcgttggcatgacatcaagttgaccaacataggtattgatgatatggccactggtttgtccaggaatatctaccataaatggtgttcgttgtaacatcgtagtgtcataactattaagcgtatctccgttataaccaacataaggagcaaaagccttattatcactaccagaaattccgtagtggtcaccatataatacaatgattgatttatcgtaaagacctgattgtttcaaataatcatagaactgttgaaccgcttggtccaaataatgagctgtttcaaagtaaccgtcaactaacttgtttcctgaatcaacagttgcgaagtttggatctttatcttcatcgtccattgtataagttaaatggttggtaactgttaaatatttaacataaaatggctgttgcatttgttcaagcaatggtactgaatcacggaagagtaatttatctttgattccccaaggactcatgtttgatgcggaattatcaaagaaactttggtcaaagaaattttgatagcccatttgtttatatgtattcaatcgattatagaaagcaccaacatttccgtgaactacggccgagctatagccatcggtttgattcaaaattgctggcattgcttggaatgtttgtgttgaaccatattttgcaaaaagtgagccagcaggcaaaccaaatgttgaagtttccaataagttttcggcatcagatgtttttccttgtccaacctgattaaagaaattactaaatgaataagtagaatttgaatgatagattgaatttaagaatggagtcacaacatgctctttaccgtctgtccctttgattttcaaatcaatcaaagcttgttggaaagattctaagtgaatttcaatgacattacggtttttagcaatcccatacattttcatatttggcgccaaataacgatttgaagcaatgtatttttgaatttcttgcaaactttctttgctagcatctttacgttgcgtatttgccaaatgagtatagtaactgtcagttagcatccatgggcctaagccaagataacgtacaatatatgttttatctgattgagctttgcgcaaaattaactgatgcttattaaaatcgccgaaccaaaagttcaaaccaaataaagccaagcccattgaaagataggtaaatgctcttttggcaccaactggacgttgatcaaatttgatttttttagcaatcaataacacgataatcacgacaaggtcaatccaataaacccagtccatcaaatgaacaggaactgaaccaaagtcaaaaccatgctggaacattccagctccacccgtcatcgtatcaatcgtgataaaatcggtaaattctcgataatagagaatattgaggtagagcaagaaatttgctgcaatggtcaagactaacgttgctagataagatagcgacgtccttctaataaagagtaatacagcaaagcaaatcgctgtaaagccaatcggattaataatcatcagcactaattctgctggaccaactccccgaagattaaaaactccgaagtaggcaatcatcgatttaacccatacaaaaaatacaataaaactaagcaaaccaacacgtgtgttgaaagcagatagtaattttatcaatttattatccccagaaaatatactcattcttccttaatttaaagaaaaactgcagtcaattcattaataattaacttattaataaatacgaaaaacgccagatttcatcaactttgaaattaatgaaattttttaaattcatgtttttattgcttaaattatacgactttccttgtttttaggcaaatcatataccaaaccataaattaggcagtccttcaaaaatcaatctatagtgtagcatttataaattaaaactatcttaaatttcaatttactgctgaatcaagcttaactgaaatcatcttagaaaccccagcgtcagccattgtaaccccatacatcgaaccagctgttgccattgttcctcgacgatgtgttacaacgataaattgattactattgtcaaagtgattcatataatcaccaaaacgtttaacattagcttcgtcaagcgcagcttcaacttcatcaagaaccacaaaaggtactgtgcgtactcttaatatcgcaaaaatcaaggctaaagctgtcagtgctttttcgccaccactcatcaaattcaaactagataattttttaccaggaggctgaaccttgatttcaacgccagcttcaagaagattatcacttgttaattccaaatctgccattccccctgcaaacatttgggcgaaggtcgttttgaaactctcacgaatggcatcaaagcttgttttgaaacgaattttaacttcatcattcatatcatcaattgtattcaatagcagatttttagcttctaacaaatcatctttttgacttgataggaaactaaagcgttcattcacttcatcatattgaacgatagcatctaaattaatcggacctaatgccttaatttgacgctctaactctttaagtttttgctctgctgctgctaaatcttccaatttttcaactgtagcttgcgctacttcaaaactcatttggtgttcactatttaaagtttcttgaagagtcattaattgaccttcaatttgctccaattgcatttcgtaacgcgtttttttcgtgttaagttcctgcgtttgttgaataaagtcttgattatgctgttctaaatcttccatttgagcagctaagtcctcacgctcgaattttagactgaccattcggacattaatctgactcaatcgttcttcgacttctgtcagttgttttgagaaattatttctctctgtttcgtcgaattggacaggatttaaaagtgctgtcagctgatttttttcttctgataatgctgacaagtcagccaataaacgtttttcatcagctttgatgaacttcaattcactggcaacttctgattgtcgaagttgggcatgattcaaagcctttgttttttctgacagtaagtttttgtgagtctgactatttgttttaacttcttcaagttgcttttcaatttcccctttttgttgggtaatttttgtaagaagctctgatttattttcattttgtcgagtcagctcaagcagattacttgttgattcttgagtagctgacagatctgtcagctgttctaaagtactcttttgttctactaattgttcgatttttagatttaaagattgctcaacaaaacgtttttcttcgccttgacttttcaaaatttcaacttcttttaataagtcttgacgtgttttttgggccttttgaactgcttgttctgctctttttaatttttgttcagatgaaacgatttgtttttctaaattagcaatttcaacagaagtaaaggtcgtagaattacgttttccagctcctcccgcataagaaccgccgggatttatttgtgtgccatcaagcgtgacaatccgcaccttataattcatcatacgcgcaatagcagtggcattttctgccatatccacaatcactgttgttcccaaaagtgagctcattgccttgtgcaatctctcttcaaaatggacaagattaatagccaaatcaacaaaacctgtcatattctgaatacggtttaatccattaaattctcgacctttaatagttgtcagaggaagaaatgttgctcgtcctaaacgtttttcacgtaagaaggcaatcgcccgctttgccgcattttcatcttctgtaacgacattttgactcccaccacctaaagcaatatcaatggccgttgtatatttagggtcaaaggtcaataaatcagagaccaccccaatcaatccgccaatttcagatgcattttgcatgaccgcgcgaactccagcaaaaagattactatggctgtcacgaatattttgcaaagaggccaaacgagctttatgttgattgagttcttgcagataatcatacatttcattttgtgctaaacgctctaattctgcttgtttcttctctgcttgattttgcttttcaaattctgctaacaagtggatgatttcggcttgtacagctgtcaatttttcttgtgtttcaaataaatctttacttattttttcaaatttagtcaagttttctctgacagattcatcctgctcggattggcgacgactcaaatcagctatttctgctttatttcttacaatttcattagagatttgagcttctttttcaaccaattggacaaattcatcacgcaaacgctccatgattacttctggtgattcagaaagggtcgctaaatccgctgacaaatctgtcagtaatttatctaattcatttttttctgtcagtaaaatttctgatttttcctgaatctctgacaaatcttgttccactgtcagcaaacggctttttaaattttcaagtcgttcttcacgttcagcagctgatttctctgatgaatctttttgaacatcaaagagttcgatttttcttgttaaatctgattttaaatttgaaaaattaagctggtccgtttgtaatttttcttgttcagcttcgaccttttgacgctctctgcgcaactgaccgacttgttcatcatattcttttttacgagctgacaattgctttaattcagtgaccacttctgctaaatcaagttcagtttggtcatatcgagcttttttagtttccaattgtccaactaaaaccgctagggataagtcagaacgcactgcttctaactcttgaaaacgaagtgccacatcacgttgcgattgtatgggaaccagctgactattcagctcaaaaataatatcttctaaacgatcaagattgtcctgtgttgaatttaatttagattccgtttcatttcggcgatttttgtattttaaaacacctgccgcttcttcaaaaatggcccgtctttcttctggttttgaattaaaaaccgattcaattcggccttgagaaataattgataaagaatcacgtcctaaaccagtatctgtaaataagtcatgaatatcgcgtaagcgacattttcgaccattcatcaaaaactccgagtctccattgcgatataaacgtcttgttatcacaacctcttcttgctcatcttgcccttgtaaataatggtcagaattatcaaaatgggcaatgacctcagcataatttagtgcttttcttttctctgttccagcaaaaataacatcaggcattttcccaccacgaagcgccttagcagactgttcgcctaaaacccaacgtaaagcttcaacaatatttgattttccagaaccattgggaccaacaaccgcggttatccctttatcaaattcaactttagtcttatcggcaaaggatttaaagccgacaatttccatttttttaagatacatggttttgcccttttattgcattttctgcagctttttgttctgccacttttttggattttcctagaccacgacccaattctttgccattgttataaaccgccgcaacaaatgagcgatcatgggcaggtccttcttctttcaagatgttataggtaattgtggtttcaccaccgacttgtagaacttcttgtaattctgttttatagtcaatcactttaacataatcatcatttttaacatggggaatcacgacatgttgaataaacttacgaacttcatccatcccttggtcaataaaaagggcacccaaaaacgcttcaaaaaggttttctagtgttgtctctcggtcacggccacccattttttcttccccatgacctaatcgtaagaactccccaaatccacaagaacgtgaaaagttagccaacgactctgtccgaacaatacttgaacgcattttcgaaagctccccctcaagtttttccggataagttcggtaaaggtaatctgaaatcaccaaagataaggcgacgtctcccaaaaattccaaacgttcattgtttgcaatctttgggagccgttcttcattcgtaaatgaagaatgtgtaaaagctgtttttaacaagtcttcatcattgaagactaatccataatcattttttaatttttcttgaagcttgagcataaaaatctccttcacttaaaacttctattcatttatagttttatcccttattataccaaaaaaaactttttttgtatgactttccttgtggaatggcacttttggtgcttaaagaaatcaaaaaaacattaaacatgagctattttcgcattgtttgatgtttttattttttctattttcaaaaactattttcacgatgtatatttagatttttcgtttctaagggtaaatttatcaaaggtttcccccaactataattactctgggcaaggtttcccatcttatcacggtgccacttattacccgcagcgtccgtaaaccaaatcttaccttcaataaaagaatacttatccacaggtaatgtctgattgtaggcaaggcgccagcgtcctggtggaataacgtaaattcccatcgtgtgtctactatctgcaaaatcatcatgtgagagaatcacattataaatcgggctgtgcgaggcattgttaataatgaagtctgtctgactcccctcatccttgctcccatgcagaatgtgagtttcaggcttgcccacttcataagtatgcacccatgttgatatttcttgggcttgcttactcctttcctcattttctgaaagggaaatcaattggcattgcatttcaatttgctcatttgcaatttttgtttgacgccacaaaatcagtgtctgccccgtcacagccaaggccgaaataattgtcgctaatacaatcaatttgtcaagcataaaaaatacatttttaaagttgacaaattgaatgaaagtgataaaattaagcttataagtaagaagagtaaattatttacgaaatttaagggagttatggtcaccgactgaaagccataatatggagtgatatttgaagttcaccttacgaataaaagctatttttgagaggaattctttagaaggataatcttaaaaaagttttatggtaattaaataaaaaaattaagtgataaaataggatggtaccgcggttttcgctcctttggagatgaaagttgtggtatttttttctttattaaatagaaattgctcaaatctccctaaagctccatattttatatggaccttgtctaattttaaatatatattttttataagttgaaaggataaaaatgaacttacaagaaaaaattgaagaccttcgcaagcggactttgtctgacttactctctgttgcagacgaaaaaacgctcaacaatcttagaacagtaatgcttggtaaaaaaggagagttgactgaaatcctaaaagggatgaaagatttaacaaatgaagaacgaccagttattggtgcacttgctaatgcttttcgtgatgaatttggagcgaaatttgaagcgaaaaaacttgaaattgaacaagcagtgatgaacgcggctttggagtctgaaagtttggatgttactttacctggaaaagctcaaaaaaaaggaagtcggcatattttaactcaaactcaagaagaaattgaagaaattttccttggaatgggttatgaaattgttgatggttatgaagtcgaaaccgatcattataactttgaacgaatgaatcttcctaaagatcacccagctcgtgatatgcaagatactttttatattaccaatgaagttttgcttcgtacgcatacttcaccaatgcaagctcggacaatggatgctcatgatttttcaaaagggggcttgcgtatgattgctcctggtcgtgtttatcgtcgtgatacagatgatgctacacacagtcatcaattccatcaaattgaaggcttggttgtagataaaaatatcacaatggctgaccttaaaggaacacttgaccttgtcatgaaaaaaatgtttggtcaagagcgtgaactacgctggcgtccaagttatttcccatttactgaaccatctgttgaggttgatatttcttgtttcaagtgtgggggtaaaggatgtaatgtctgcaaacatactgggtggattgaaatccttggtgcaggtatggtccatccaaacgtacttgaaatgtctggtttagattcttctgtttattctggttttgcttttggactcggtcaagaacgtattgccatgttacgctatggaatcaacgatattcgtggattctatcaaggcgatgtaagattcttagaacaattcgactgacgctttagtcgcattgtcgatttcgacattcgaaaagggaggactcccttcgatggagcgatttggaaaataaatagtataaaaaactgtgaatagaaagttgaaataacatgttagtatcatataaatggttaaaagagttggtgccaaatcttacggctacgccagatgaattaaaacaaaaaatgtcaacgtctgggattgaagttgaaggagttaccagcccacaagaaggtttgtcaaaacttgttgtcggagaagttctttctagtgaagatattcctgaaacacatttgcatattacacaagttaatgttggggctgatgaagcattacaaattgtttgtggagcgccaaatgttcgtgtggggatgaaagtaattgtggcacttgtcggtgctcgaattgcggataattataaaatcaaaaaaggtaaaattcgtggagttgaatctctcgggatgctttgtgcacttgatgaaatcggaattgatgaaaaaattaatccaatgaagcatgaagatggtatttttgaaatgccagcagatgctaaagttggtgatagtattttcccttatcttgatatggacgatgaaatcatcgaattatcaatcactccaaatcgtgcggatgctttgtcaatgaacggggcagcatgggaagttggagcaatctatgatttaccagttaagcttgagggaaaatctttagtagaagcttcagaatcagcagcaagcaaaattacagttaaggttgaaacagataaagttccaacatataaaatccgtttgattgaaggggttaaaattgcgaaatcacctcaatggttgcaaaaccgattgatgaatgcgggtgtaaaaccaattaataatgtggttgatgtgacaaattatgtattgatgacgtttggtcaacctttgcatagttttgactttgccaaatttggttctgatgaaatcttggttcgtcaggctaagtctggtgaaaaaataaccactttagaccatgttgaacgtgaattagatgactctgatattgtagtcacagcaaatggacttcctgtagcgcttggtggtgtcatgggtggtgcagacagtgagattactgatgaaacaacaaatgttgctcttgaagcagctttgtttgacggagcttcaattcgtaaaacttcgcaaaaatttgctttacgctcagaagcatcaagtcgttttgaaaaaggaattaatgaaggaacagttcgtgaggctcttgattttgcagcagcaatgattgttgaattggctggcgggaaagttctttcaggccttgttgaatcaaatgattatcaacctctgttaccaaaagtttcaattactttaagtcgtgttaatggggctttaggaacagatttatcacttgaaactgtgaagaaaatttttgttcaacttggttttggagtcgaagttgagggagaaaaatttacttgtgaaattccatcacgtcgttgggatattcatattgaagctgatttagttgaagaagtagctcggatttatggatatgataatttgccaagtactttgcctctttcacaaaatgctggtgagttgactgacatgcaaaaattccgtcgaacggtaagaactggacttgaaagttcaggtcttaatgaagtcattggttactcacttgtgactccagaaaaagcgactgaatttgtgggtgagcttgaaacaacatcgctcatgatgccaatgactgaagatcgtcaaacacttcgtgcaaatatgattccaggacttttggacattgttaattacaatcaaaatcgtaaaaatgctgacgtagcaatttatgaaattggtaatattttcttaccaaatgcagatgatattcgtcctacagaagtaccaaatcttgcttttgctatttctggaaatgttgtggataaatcatacaacggacaagctgttcctgtggatttctactatgctaagggaattgtggaaaaccttcttgaaacttacgaagaagttgaatttgttccaactaataatcaagcggcaatgcatccaggacggactgctgtcattaacatcaatggtcgcctggctggttttgtgggacaaattcatccggctacagctaaaaaatatgatgtagcagaaacttatgttgccagtctcgacatggaagtgatgcttgaagaattgacagcacaaaccatctttaatgatattccaaaagttcaagcagttcatcgtgatattgcacttttgattgatgctgaggttacacatgcccaaatcgtttctgtcattaaatcaagtcgcgttaaaacacttaagcaagttgagttatttgatatttatcaaggtaaaaatttacctgctgctaaaaaatcaatggcctatagcctaactttccaaccgactgaaaatacaatgactgatgatgaaattacggctgctgttaataaaattacaaaaaatcttgttgaaaaattaaatgtagaaattcgttaaaagaaaataagattactgacaaagctgtcagtaaaaaactctatcggtagttactgatagagttttttcatctttgatgattatcaaaatataaatcattaaagaaacaatgaaaataagcttgcaagggatagatagttttttataaaaatactttttgtgtttattttaaacttcagttaatattggtaattaaaatgcaattaaaaaccgtgggggatatgttagaatagacaaagtatgaagaatttaattcctgaaaaaataaaacaagttggaatacttgtaggagctttactgatgcttttatcagttctacccgttaatctcttaggagtgacgaaagtagatgctgacagctctcaaacggaagtcaaccaagaaatacaaaacttccaagcgcagctcgacagtaaacttgcacaggcaaataagatttatagccaagcgcaagaagcccaacaaaaagttaatgagtcaaagagtaagattactgaattggaaacaggaatctctgaaactgaaaatgacgttgttcagcttaaagcctctgtcgcgaaacaaatgcgagcaatgcaagcaaatggtgggggaactttatcatatattgatatcgttgcatcatcaaaaaatctttcagatatggttatgcgtttaacaaacttgcatgtggtattaactgctgaatccgaccaagcgaaatctcttattgaaaaagaagaatcgctaaagacaatgaaagtcaaattggaagaatctcaagaaactcttgtgaaaaatcaaaatgactatcaaggacaggttgacgctttgcaaagtaatatttctggactcaaagataaaattagttcaaacaaacaacttttgagtgaaatgcaagcaaaagctgcggcagaacaaaaagctcgcgatgaagccttggctaaatcagtagcagacgtgaaagcaaaagctgcagcgaaagctgctacaaaagctgaacaagaaaaaacaaaagattcttcaagttctgaaagcaataattcagtaagcactcaaacgcctgctgacactaacagtaatacaacaactaacaataacaactcatcgttaacgacttctggcggacgcacattaaacgtagaagcaacagcttatgctttaaatggaattactgcaactggaattgatttaagtaaaaatccaatttgtatcgcggttgatccaagtgtcattcctttgaattcgctcgttgaagttccggggtatgggattgcaattgctggtgatactgggggtgcaattgttggaaacatcattgacgtccattttccatcaaatgaccaagcaatcgcttggggacgtaaaaatattcaaatcactgttttgagttaaaaaaactttaaaaaataatgaaaggcttacagttaagcctttttttggtataatgagaacatgataaaaaatggacgtattgtcaaatccttggcaggcttttatgatgtcgaggcagaaggtgaagtttatcagacgcgcgcgcgtggtaatttcagaaaaaaaggaatgaaacctgttgtaggggattttgttgagttttctgctgaagaaaattcagaaggatatattctaaaaattggtgagcgaaaaaattctttaattcgaccatcaattgctaatattgaccaagcggtgattattatgtcaacggtaagtcctaattttagtttaaatctcttggaccgttttttggttttcttagaacataaaaacattcatccaatgatttatatttctaaaatggatttgctgacagaagaccaagggagttctgagaaaagtaataaaacttttaatcagcgggcagattatgagcagataaaaaggaattatgaacagattggttatgatgtcttctttgatgctgaacatttggtcagtaatttatcgggaaaagtaactgtttttatgggacaaactggtgctggaaaaaccactttgttaaataaaattgcaccggaaatgcagttggcaacgggtgaaacttcagaaaagctagggcgtggacgacatacaactcgccatgttgaattttttgagttagcgggtggattaattgctgatacgccagggttttctagtttagattatgaggtaaccaatcagccagatttaaacgctgcttttccagaaattttaaagattagtcataattgtaaattcagagaatgtacacatacgcatgaaccaagctgtgcggttaaagttgcacttgaaaatcatgaaattttagaaagccgttatgaaaattacttacagcttttagatgaaatcaaccatacgagggaaacttatgagaaaaaacgaaaaaaacaaggctaaagataatatttggttgaaacaggctggtttttttgctcttgttttagcttggattttagcaatttattttaaaaatgacttatccaaaacaatgatgattatcgtgtttattctcttagttcttgcgaccttctttgttattttttggttaaatcgtgtcttttttggcttgacgagtcagtcaaaagaaaatgacctagagagttcgcaggataaagaaaaatgaaaaaaagattgaaaacagaagcctttttagcggttctttttgcccttctttgccaagtattggaaatgtttgttttcaaaaatggcacacctaattttgtgatgaatttcttaacggttattgctttaggtttggcaattgttcttggcgttcgtgcggcaaccgttgtagaacacaaacgtgagggagatgcttggaagacaattgttaaagaagaacttcatgatgaatcatcagataatagtggtgaataagggttttgtgattttttttgttgagagttgttttttaaataagaatcgtagtattctttagagagaggataaaaatgaaaaataaaattgctccatcaattttgtcagcagattttggaaattttgcaagagatgttaaacagttagaggctgccggtgctgaccttgtacatattgatgtgatggacggacattttgtagataatttaaccttcggagccggagttgtttcggcacttcgctcgcaaacaagtttgttttttgatgctcatatgatggttgagaatccagaaaaatatgtggatgactttgcaaaagcaggtgcagatagcatgagtattcatgttgaagcaaccaatcatatccatggagcgctgcaaaaaattaagaatgctggaatgaaagcttcggtagtgattaatcctggaactcctgtagaggcgattaaaaccgtcttaccacttgtggatatggttttagtgatgacagtcaatcctggttttggcggtcaaaaatttattcctgaaatgatggataaagtacgtgaactcactcaaattcgaactgacaaaaagcttaattttgaaattgaagtggatggtggcattgacgaccaaacaattcaagtcgcaaaagctgctggtgccaatgtgtttgttgctgggtcgtttgtttttaatggtgaagtagaaaaaaacatcgaaaaacttcgtgagaacttataaagagctacgaggatgctgacagtttttctgtcagtaacttcgggctttcatttaaatgtgttagaaatataggaaaataaaaaatcaagatggaagttattattatcatattactcatacttttgattttactgtcccttgccaattttttcaaaaagactgacaaaggaaatacgagtcatcagttaaattatcttaatcaaaatttagcggaaatgcgctcggatgttaatcagcaactggcgcaaaatcgacaagaactttcaagtagtttacgctcggtcaataatgatttttcaacactgacagaaaatatcaatagcaagtttgactggcagtttaaagatttgcaaagttcaaatgagcaaaaattagaaaaaatctctgtaagtttggtagaatctaccgatagaacggtcacaaaactgtcagaactgacagaggcaatgacagacaaatttgaccgtaaatttaaagaattacaagattctaacgataagagattgagtcaaattcaggaaacggtcgatgaaaaattgcaagaaacattgaatcgcagaatttcacaatcttttgaacaggtcactttacatttgaaaaatgtcgaagagggcttgggagaaatgagaaatcttgccagtgatgtggacagcctgcaaaaggtaatgacgggtgttaaaacacgtgggattgttggtgaaattcagctaggacgaattttagagcagatgtttgcaagcagtcaatatcgagaacaagtcaatattcagggcgctaacgctgtggattatgccttgattttgcctggaaaatcagaggggtcagaactcttacttccaattgactcaaaattccccatggaagattatcaacgcttgcaaatggctttggaatctaatgaacccctggaaattgataagacgagaaaagcattgtttaatgctgttaaagctcaagctaaatcaatcagtgaaaaatatattgtcccgccaaaaacaacggattttgccattatgtttttaccaactgaagggctgtttatggaagtggttaataatcctgaactttatgagcaaatcagccgtgactataagatcaatgtgacagggccaacgacgatgaccgccgtcttaaacagtttgcaaatgggctttaaaaccttgcaaatcgaacaaaaatcagctgaagtttatgaaatgctaggagcagtcaaaacagagtttgataaatttgaaggttcgctcatcaaagttcaacaaaaaattcagcaatcagaaaaagaaattaataatctgattacgacaagaacaaatgtcatgaaaaaagcgctgacgaatattgaccggatagatgatagtgaaagcagcaaacttttggatttagattgacaaagtattaatattttatatcgcttggctaggtcacccaaagagtcgggcttacatcttaaaggagaaaacatggtgctcattaaaaacttagaaattggcgaattttttgaaggattttacctgattaaatcagttgaattacgtcaaacgcgggcggggaaagactttttagctttgagttttcaagaccgaacgggaacaatcaatggaaatatttgggatgctaatccaaaagcggttgaacagtttcgagctggtcgggtcgtgcatatgaaggcgctcaaagaactctataatggaatgcctcaagttaataaaatacaattgcgtttagcgacagatagtgaacccaatcaacctcacgattatcgggaaagctcacctgttcaagaaaaagatttacgtgaatatgttcaatcgattctttttaaaattgaaaatgcaaccttaaatcgaattgtacgcacgattttgaaaaaatttgataaggaattttatgaatttcctgcagccaaaactaatcaccatgcctttgaaggagggcttgcttatcatacaacaaccatgcttcatttagcagaaaaagtctgcgaagtttatccacaactcaacgaaaatctgatgtttgctggtgtattacttcatgacatggcaaaatgtttggaatttacaggtgccgaaaatacttcttatactttaagaggaaacttgattggacatattgttttgattgatgaagaagtgagtaaagccgccattgaacttggatttgatgatgataatgaagacttattgatgcttcgtcattgtttattgagccatcatggggagttggagtatggtagtcctgttcgtccacaaattatggaagcagaaatgattcatcaaattgatgtcatggatgccaacatgatgatgatgactacggcgactcaaacgctcgaccctggtcaatttagtcagcgggtttgggctttatctaatcgtaacttttataaaccaagaaaagattaaaccgtgcttacacggtttttttgctgacagaaatttttgtcagtaaaaatggtaaaatagaaagaagataaaaatattaaggagttttttatgaattacactttgaaaaatgaccaattgagtgttattgtggacacttttggggcagaaatgcattccatccaacatgatgatattgaatatttatggcaggccgatccaaaattttggggacgtcatgctccagttctctttccaatcgttgggaaattaaaaaatggccaatatcattataatgagcaaacttatcaaatgggtggacatggttttgcacgtgataatgattttgaattaattaaaaaatccgataatgaactcgtttttgagctccgtgataatgaagatagcttgaatcactatcctttccattttaactttcgagtttcttacaaattggtggaaaataaaatcagagtccgttacgaagtgaaaaatgaagacgaaaaattcatgtcttttggtgttggggctcacccagcatttaatgtccccttgaaaaatgggacttttgaagactatcagttaactgtttcaccagatgaaaaacgaacttttattccgcttgacccaccatcaggaacattgaaattagatgaaagagtggagacgcaagtaaatactcttccattaacaagagaactttttgataaagatgctctagtttatacatcatcagatgagatgaaagtttcattgaccaacaaattagatgaacgtggggttactgtgacttggaaagatatgccctattttggcttatggtcaccttatccaaatgaagcaccatttgtttgtattgagccatggtctggaattgctgacgatgaaaatactgacggcgacatcacaacgaaatttgggattaatcaattagcgccagagggaagcttctcttgcgaatatactattgaaatcaattaattgactactctcgtatttttacgggagtttttatttaaaaaaatgctagaattaatttagacgtgctgtcagtaaaataagcattacgaaattactgacagaagataaaactactgatagaaagtaaaactctaatgaccacaattcttctcaatgccttgagtattctgcttgttttgtttttagcccttttactcaaaaaaatcggtctgcttcgccaagaagatggagcccttacttctaaattggttgtttacttgaccttaccagcaacgatattaatcggagtaaatcatacaaagctctctggcatcttttttattctgatgtttatgggacttttttctaatctctttttggtttttctggggaaatttattggacgaaaggctagtgtggaagaacgtggcctttatatgtttgatttatcgggctataacattggaaatttttcaattccttttgtctcaagcttttttccagcggctattccttttttagccatgtttgatatgggtaattccttaatggtgactggaacgactcaagcaattgttgaactttcaagtggccgaaagaaacacggctttattttgcaagaaatatttggcgtcttatttcgtaatccaccctttgttgtttatatttttatgtttattttagcgatttttggcttatcttttcctgatgattggctgattccaattcgaccattggcaaatgctaatacattgttatcaatttttacaattggactttttatggaatttcgcttgccgaaaggaaaattaaaacttctgttgaaaatattgacttggcgttatttactagcttttattttagctagtttggtttattttttcgctccttttccagccataataaaagaagttctcttgttaattttttttgtccgatgtcctttttgcacatgattcaagccatagagcttgggaatgataaggctttggcgggacttgtcattagtttatccatgtttatttctttgattttaatgagtattattgtgattgttttgtgaggtgaaaaatgaaaaataaaatagaaaagttattagaaaattttgtgccagaaggtcagcaagaacaaattgaccttaaagtttttcaaaaatttgcagctgatgaagaaaatttaagtcgggattcaattgctcattttacagccagtgcttttgttcttaatgaagcccatgataagattttagggatttatcataaaatttatcaaagctggggttgggtaggtggtcatgctgatggcaattctgacttattagctgtggcagaaaaagaggttcaagaagaaacgggacttcaaggatttagaaagctttcagaaaaaccgatttcgattgaagccttgcctgtttttggtcacattcaccgtaagtatggttatgtcagcgctcatattcatctaaatgtcacttttttatttgaagcaaaggaaaatagttcacttcaaaagaatacagatgaaacagatggtttaggttggattcctttagaagaattttcggaaaaatcttctgagaaagaaatgagaatcatttacgataaaattatttctcgaatcataaaataagacttgccttaggcaagttttattattagattaaaatttttaaattatcccattacggaattataatacgaggctattgcaaataaatcatgaagggctataattgagtctaattctatgtgaaagttgagtgagagatgccagtaaaagtgattgaaggtctgcctgccattgatgagctgagagcagataatatctttgttttggataatgaacgagcgaaaaatcaaaatattcgccctttgaatttgctggtggtcaatctcatgccacgtaaattgattactgagcggcaaattttacgcttattatcaaacactccacttcaaattaatgtcgattttttgtttatggctagtcatgaattcaaaaatactaagcaatcgcatttggactccttctataaatctttttctgaaattaaagatgactactatgacggtttgattataacaggtgcacctgttgagcaacttgaatttgaggaagtcgattattggtctgagtttttagaaattgtgaagtggtcaaaaagccatgtttattctagtttacatatttgttggggagcacaagcagcactttatgcccgttatgaggtaacaaaagaaaatcttccacaaaaattgtgtggtatttataaaagctcagtagagcaacctaaaaatccattatttagaggttttgatgactctttttattatccatagtcgcgatatgcccaatcgaacccatcagtaataaataaaattcctgatttagaagtcttgtcaacatccaaagaaactggtttttctattttagccaaaaaaaatttacgtgaagtttatctttttggtcatttagaatacgaccgagaaactctagcttgggaatatgaaagagataagaaagaaggcttaaagcctgctctccctaaaaattattttccaaaagataatgataaggagaaaccacaaatgagctgggcttcagctgcctcactctttttttcaaattggctgaattatgccgtttatcaaggaacgccctatttgggagaacgtcttggtcatcattgcggtgaagagaattatgattttaatcaaaaagagtagaataaagatttttttataggagaaaatttatggataaaagattagatactttattggcacaagttggaattcggcaagatgaagctactggggctttagtcggtcctttgcatttttcaacgacctatcaacatccagaatatgggaaatcgactggatttgattatactcgaacgaaaaatcccacacgagcgactttagaagaagcacttgcttcaattgaatcaggacaattcgctttggcaacttcgtcaggaatggctgcaattgttttagcatttgaagtttttcctgttgtagctaaaatcgtggcctctagagatttatatggtggctcttttcgctggtttgacgaacaagaaaaagaaggacgtttttcattttcttatgccaataatgaaaaagaaatgcttgatttaattgatgaatcgaccgatattgtttatattgaaagtccaacaaatccaatgatgattaagtataacattgaaaagattgctaacaaggcgcaagcaaatcatgcgaaagtgattgttgataatactttttatactccaatctattagagaccattggagctgggggctgacattgtcattcattcggcgacaaaatatctgtcagggcataacgacgttttggctggagcggtcattgttcatgatgaaaagctttatgaaaaattagtctataaacttaatactactggagcagttctttctccttttgatagttatctcgtcatgcgaggtttaaagaccttaagcctgagaatggaaagagcaactaaaaatgcgcttaaaattgtggcttttctaaaaaaacttccgtcagtaaaagaagtgctctatccgggattgggaggaatgatttctttaaaggtgattgacagaaataaaattccagacattttaaatcacttacaagtttttactttcgctgaaagtttaggaggtgttgagtctttaattacctatcctgcagaacaaacccaccatgatattccacttgaaattagagaaagttatggtctaactgatgatttgcttcgcctttctattggtatagaagatgtacgtgatttaatagaagaccttaaagaagcactagaaaattaaatatttactgatgaaagaactaacatatctgtaaatagctatccatgggctctgagtttcgctgtgccttttctctatccactaatcttcgctacgctcgaatgtctacttgctgtaaggtgctaaagcaccgacacaagtcgtaagcgaatgataaaagggtaaggcaataacaggcatcttatgtcagtaagaaaataaatccgtaagtgttaaaattagactctgtcagtataaaaattactgacagaaaggaaaaagaagagagtataaaaatgacaaaatatgattttacaaccattccaaatcgacttgaacataattctgtaaaatggcaagaaataaaagaaaatccccataaacttcccttatgggtagctgatatggattttctggccttgccagaaattaaacaaagcatccatgattacgctgattacggtgtttatggctatgcttatgtggaagatagcctgatagaaagtgtgcaaaattgggaaaaaaatcaacatcagtatgaattttctaaagaaagtctaatactagttgaaggagttgttccaggaattggtctggccattcaagcactaacgaaagaaaatgatgctgttttaatcaatacccctgtatatcccccctttgctcgaacagttaaattaaataatcgaaaattggttgagaatgctcttcttgaaaaaaatggcgagtttttaattgatttcaaaacttttgaaaaagatattgttgaaaattccgtaaaattatatattctctgtaaccctcacaatccgggtgggcgcgtgtggaccaaagaagaattgctaaaaattggtcaaatatgtcaaaaacacaatgttttgttggtctcagatgaaatccaccaagatttgactctgtttgggcatgaacacaatactttcaataagattgctccagacttcaaagaattttcagttcttttatcctcggccactaaaagctttaatattgctggtgtaaaatgtgcttatgcaattattgaaaataaaaatttacgcgagaaatacttacaaagaagattaatgaataatcaacaagaaatcagcagtttaggcatgcttgcaactcaagttgctaacaataaaggggcacagtggttgagtgaactcaaagaagtattggaaaaaaatattacttatgttgagtcagaacttcatcaaaaaacgaaaataaaagtgatgaaaccccaaggaacttatttagtttggcttgatttttctgactataaattaaatgataaagaattggataaaaagttatcagaagaagtggaagttattttaaataaaggagcaagttttggacaggcaggacaggctcatgcccgattgaatgctgcagccccattttctttaattgaggaggcaacaaaaagacttgtcgaaacctttgctatttaacgattttagttgaaaaaggatctttaagcttcactggttataacatgctatcttcgcttcgctgcaatgtccactctcgctaagtggttaataccacaagtcgagccacactcacttcagcaggaaattatcgtttctagataaaacaactagcatatctgtaagccagtaaactggcaacagctatcctgtgcttcgttcggtcataagagataaaatcgaataagacaaaaactcgtttcgtcttatcggttatgatataatcaacttatgaatgatattttacaacttacaattgttttaattgcctcgctaattgcaacccttgcttcacggcgtcttaaaattcctgctgttgttggacagatgcttgtgggaattttgattgctccgtcagttttagggcttgttcatagcggacatgttttagaagtgatgtcagaaatcggtgtgattttactcatgtttttagcgggtcttgagagtgatttaacggttttaaagaaaaatttcaaagcatcaatgcttgtagccattggcggtgtgattgttcctttaatagtttttggtctagtagcttttagttttggctacggaatgtctacgagtttcttttacggaattgtttttgccgcaacatcggtttcaattaccgttgaagttttgcaagaatatggaaaactcagtacacgtgcaggttcaattattctaggagcagcggttgttgatgatattttagccgttttgattttatcaatttttaccagtttcaaaaatggagggtctgggactcatcttttcttccagtttttacttgaacttctcttttttgcctttttatttgttgtccataaattgattcccagattttggaagtttgtccaaaaactgccaatcgccaacaagaatacgattgttgctttgatcatctgtttaggattgagtttacttgcagatagtgtgggaatgtcagccgtgatagggagcttctttgcaggacttgctatttcacaaacagaagtcagtcataaaattgaagaatatacttcagccattgggtatgtgatttttatcccagtcttctttgtactcattgccatatccgttcaatttgacagtttaattcatcatccatggattattttgctctttacacttctagcgattttgaccaaatttattcctgcctattttgttgggaaatctaataaattgagtaccggggaaagtatgctgattgggacgggaatgatttcacgtggagaaatggccttgattgtgtcacaaattggactgacaagtgccattattactgatgaagtttattctgaattggtcattgtcataattttagcaactgtcctagctccatttttaatcaagttagtcttgaaaaaatatgataattaaggaaaaaataatttttaaaatttcatcttattccccaaaaaagactgaaaaagtggtaaaatagaaaaaatgcttttagagaatggcaccatctgctatgctctaaaaaattttgcctaaaattagcaaaattgccatataatggcagtttacaaatctgaactttgcttagcaaagggatctagcgaaaggaaaatcaaaatgtcaaaatttcaagtcgtagaacatccattgattcaacacaaactctcaatcttgcgtcgtaaagaggcgtcaacaaaagaattccgtgagcttgttgacgaaatcggaatgcttatggcctacgaagtatcaagagatttacctctcgaagatgtcgaaattgaaacacctgttcaaaaaacgacagttaaacaaatcgcgggtaaaaaattagcgattgtgccaatcttacgtgcaggtatcgggatggttgatgggattttgaaattaattccagctgctcgtgtgggacatatcggaatgtaccgtgatgaagaaacacttaaaccagttgagtatttagtaaaacttccagcagatattgctgaccgtcaaattttccttgttgacccaatgcttgcaacaggtggttcagcaattttggcagttgattctcttaaaaaacgtaatgctaaagcagaaaatattaaattcgtttgtcttgttgccgcaccagaaggtgtaaaagctcttcaagaagcacatccagatatcgaaatttatacagcagctttggatgaaaaacttaatgaacatggttatatcgttccaggtcttggtgacgctggtgaccgtttgttcggtacaaaataagaaaaattcccttatttttagataggggatttttttattttataaaaaaagtaattttttgaatcaaaatagtttacaagtgtaaatttatttgataagattacagatgtaaacaataaaacaaaaaaggaagtaattattatgtcattcattaaatcattagaaaaccgtcgcacaatctacgctcttggaagaaatgttcaagatgaagcaaaagttattgaaacaattaaagaagcagttcgtttttcaccaacagctttcaattcacaaacagggcgtcttttgattctgactggggatgctcaagataagctttgggatgaaattgttgcaccagaacttaaagctgctatggaagcacaaggtgttccagaatcagcttgggataacacacgtgcaaaacttgatggatttaaagcggcatttggaacaattctcttctttgaagatcaagcggttgttaaaaaccttcaagaacaatttgctctttacgctgataacttcccagtttggtcagaacaaggttcaggaattatttctgttaacgtttggacagcacttgctgaacttggcttaggtgctaacttgcaacattacaatccattgattgacgaagcagttgctaaagaatggaatcttccagaaagctggaaacttcgtggacaactcgtatttggttcaatcgaagcaccagctggtaaaaaaactttcatggatgatgctgaccgtttcatcgttgctaaataatcaattatttttaatgaccgtcagtaaaatttactgacggttttttattttgtaaggttgaactctcaaaagctccatgctataattgtccaaaaggaagtggaaatgaaaaagataaaaatgaggcgatttttacaagataaaagacatcctgcacttgattttttgaaatatgttggtcctggattaattgttgcggtcggctttattgaccctgggaattgggcggctaacctagcagcaggctcgcaatttggctataaactactctgggtaatcactttatcaacaattatgttggcgtttcttcagcataatgtggctcacttgggaattgtcacagggaaatgtttatcagaaaatgcgacccaatatctcaggccctggctcagtagaactattttggggacaggagtcctagcatctatttcaacagcagttgccgaaattttgggtggagcgatagctttgcaaatgctctttaaattaccaattgttctaggtgcaattttaacggctggcttggttatctggtttttattcagcaattcttatccaaagattgaaaaagtaattattggttttgtaagtttgattgggatagcgcttttgctagagatttttattattcctcatattaactgggggcaggcagcaaaaggaatggtcattcctttcgttgatgcaaaatccatgcctattattatgtcagctttaggggctgtagttatgcctcacaatctatttttgcactcggaagtcattcaaagccgtcagtggaatttaaaagacgaagctgtaatggaaagacaattacgttttgaattctttgatacaattttttcaatgtttttaggttgggtcattaattctgcgattattatcattgctgccgctttatttttcccacgtatcgtcaccgaaattagtcaggctcaagaaatgcttgttcctctgcttggtccagtagctgctattctctttgccattgcctttctttttgcaggagttgcttcgtcagtcacagctggaatggcaggagggtcaatttttgcaggaatctttgcagaaccttatgatgcctaagatcctcacagtaagttaggcgttttaattacaattattggtgcaactcttgcaatttgtggattgagttttgtaacgtcatcattcaatattttaatttattcacaagttttcctgagtattcaattaccaattaccatctttttaaaaatttatttgacaagttctaaaaaagtgatggggaaatataagaacgtttggttcactaagtggcttttattagcaacggggatttttgtaaccctactcaatatcgtattaatcgtcgaaacttttaaataattctaaaaaatttgctataatagttttgtaagaagattaaaaaatgaggagaaaatgatgcaagcaaaattagttaataaagttgtcatcaaacgtaacggtcatgtcgttgactgggatagtttccggattcaaacagcagtatttaaagcagcaatcaatggtaagtataaagacaaaccactccatgccaatatgattgccaataatgtcactaaggtcgttgaaaaagtaattgctgagctatcttttgaaaaaattgagattgaaaccattcaaaatcaagtgattaaacaactcaatgactttgataaagatgttgcgcgcgactttctcgcttacaaaacaaagcaaaatatcgagcaaagacattaaaaagttcattatatacaaaaagaacctaatcggttctttttttgaaaaatctactgacaaaaggactaaattgaacaaaaaaatatctgtcagtaattttgaaagagtaaaaagagcaaatagaataaaaagtaatttttagctattttattgacgcaacttgctgttaattaatccaaaaaaagttttatttatgaattttataagaaacttaaattcattcttgacaaattttagagcaagctttacaatatagatagagacatgtttttagtgaaaatttctaagaaatcagacggttgatgcgagtctgaaaatggcaactaaaaataccactcaaccttacaagcttgacttgtaaaataaattctttctggacaacagaaaagcgttgctgacacgttacgtcaaagaagagaagtttactgatgaaaattctagcatgaccatgagcgctatggcttcaatggctatcctaggtcaagaatccaagcagttctgtaagtagtaattgtggtgattgttggcataaagaagagtcagtaaatgaaacaaaggtggtaacacgcagatagcgtcctttaagggatgagatttgcgtttttttatttccataaattactgacagcactactaatagataaaaaagttttgtcagtaaactaaaaacgataaaaagaaaggcacataaaatgattaaaataacatttccagatggcaacataaaagaatttgagtcaggtgtaacaacatttgaaatcgccaaatcaatctcaccaagtcttgccaaaaaaacacttgcaggtaaggttaacgggaagttgattgatgcgacacgtgcaatcaatgaagatagcgattttgaaattgtaacgccagaccatgaagatgcgcttggaattctacgccattcagccgctcacctttttgctcaagcagcaaaacgtcacttcccgaatattcatttgggtgttggaccagctattcaagatggattctattatgatacagataatgaagcaggccaaatttcaaatgacgacttagcaacaattgaagctgaaatgaagaaaattgtcaaagaaaacttcaaatcagagcgtaaagaggtcagcaaagaagaagcaaaagaaatttttgcaaatgacccttacaaacttgaactcattgaagaacataacgaagatgaaggtggactcactatctacactcaaggggaatacactgacctttgtcgtggcccacatgttccgtcaactggtgtcatcaagtttttccatctccttaatgttgccggtgcttactggcgtggaaattcagataacaagatgatgcaacgtatttatggtacagcatggttttcaaaagaagaattagaagcaaatcttaaacttcgtgaagaagcaaaagaacgtgatcaccgtaaactcggtcgtgaacttgatttgttctttaacgacgcagaacttggtgcaggtacagcttactggctcccagctggtgctactattcgtcgaatcattgaacgttttgtcgttgaccaagaagtgaaaaatggttatcaacatgttatcacaccagtcatgatgaaccttaatacttacaaacaatcaggtcattggcaacattaccatgaagatatgtacccaccaatggatatgggagacggcgaagaaatggaacttcgtccaatgaactgcccaagccatattgccatctataaacaccatgtccactcttatcgtgaactcccaattcgtatcgccgaatttggaatgatgcatcgttatgaaaaatcaggtgcactctcaggacttcaacgtgtgcgtgaaatgactctgaatgatggtcatacattcgtgatgttagaacaagtccaagaagaatttagtaaaattcttcaattgattatggacatgtaccgtgactttggaatcaatgattatagtttccgtctcagctatcgtgaccctaaagatacagttaaatacttcccagatgatgaaatgtgggaaaaatctcaagcaatgcttaaagcaacaatggacgacatgaaacttgactatgttgaagcagaaggggaagctgcattttacggtcccaaacttgacattcaagttaaaacagccctcggaaatgaagaaacgctctcaactattcagttagacttcctcaatccagaaaactttgacatctcatatgttggggctgatggagaaaaacatcgtccagtgatgattcaccgtggtgtaatttcaacacttgaacgtttcattgcctaccttatcgaagtttacaaaggtgctttcccaacatggcttgctccaactcaagcaacgattattccagtaaataatgaaattcatgcggattacgcttggaaaattcaacgtgaacttcaagacaaaggcttccgtgttgttgttgatgaagccaacgaaaaaatgggttggaaaattcgccaatcacaaactcacaaaattccttaccaaatcgttattggtgaccaagaacaggccaatggtacagtaaatattcgtcgttatggctcaaaagaaacagaagtcattccgtttgaagattttattgaaaaaatcagtgccgatgtagctaattttagccgagttgactaaattaaaaaagactgttgaaaaatagtcttttttttatactgttgtatcaatataaggtataataaatggtattaaaatgacaataaggatagaataaagagaaatatggaagtgataagcagtttttacttgtttttagaaattttagggacagtggcatttgccatttcgggaacagtagtcgggattaaccataaattggatgtttttggagtgctcgtaatgtcagttattacagcggtaggaggaggaatctttcgtgatttgcttttgggagcgactccgccttcagcattgaaatcaccattttttattataatttctataattgcttctataatagccatgtttgttgcttggattgtaaaatctaaaagaaatgccttgaatatttttaaagcggctcgcttctataataatcttctcttagtttcagatgcaatcggtttgggaatatttaccgtattaggaattgatgcaggaatagcccatggttattcacataatatattttttgttgtatttttaggagtacttactggtgttggtggcggaatgattcgagatatcatcgctaatcaggtcccaatgatttttagagaaaatatctacgctttgccttgtataataggaggaattctttatgtatatctccaatcagaaattagtcacaacctctcattatttatctctgtcatttttatcgtacttgttcgtataatatcagaacaaaagaagctaaatttaccaagaatagaatattaaataaaggttaagaacttgataaccataggctttgtcgaacgaagataaaaaaagattgaaaaagtgacattaaattcttgacagggagagataggttaaaatatgaacgccaaattaagggctgagcaaatagggttttatagccctctaaactccaagatttcggccaaaaccaaactgcgcctgttgccacatcctgtgggttagaaaaagaggcgataataacgaaccaaagaggataaataatgagtaaaataagcaaaacagccatgccatataccagaacatcaaatattttttcttgtaaactttttggccttctcgatttatgtgtgattttcatcaattctcctctcagaataatccagttttagttagccgacgtgaaataaaattaaccgtaactaagataaccagattaatgaccgtttgaaataaattaatagctgttgaataagaatattggaaagatttcaaaccgactttatagacataggttgaaatgatttctgagcccgatagattcaatggattctgtaagaggaggaccttttcaaaaccaatatttaaaagttgtccgacagctaaaataagcataatcatcatcgttgggactaataatggtaaatcaatttttatcatttgctgcaaacgagatgctccatccatagttgctgcttcataataagtagggtcaatagcagaaagggctgccagataaataatcgaattccaaccgacatgttgccaaacatctgaccaaacatatagactcgcaaaagcattgggatttccaataacatctggcattttcaaattaaagattcctaaaaaattagctaccaatccattagatggagaaagaaatagtagaatcattccacacattaccatcgttgaaataaagtgaggtaaatatgttgtcacctgaaaaaactttttaaaagcctgtactctgatttgattacaaattaaggccaaagcaattggcagtgtaaaaccaaagacaatactataaacagcaatttttaatgtgtttaaaattgttggccaaaactgataagaattgaaatattgaataaaccatttaaaacccacccaaggacttccacttactcctagagcaggtgaataatctttaaaagccatcagtaaaccatacattggtacataagcaaaaaggataagtaaaatagttgctggagcaagtaaaagatataaagaagtattattttttaacttctcttttattctgccattcctaccctttttgagtagaattttcacttgagatgtcggtgtcatttagaacctctctttttagtttaacgttaaactctttttgataaactaatcataaacttatcaaataaaaaagtcaatattaaataccttgtatattcgttttgaaagcgttttataattttgtggtaaattttctaaaatttttatttttgaagtaaaaaagtgattagtaaaatttcactaatcacttttgccatattatttttaaaaaaaatcgggccccctataaaggcttttctccgatcttatcaaccattttccctaaaaaaataaacctcaaattcatcagcaaccttaacacttccagaaggaagaattctcatttttactttatttttgttaataactttataacggaaaaaagcctcttctcctctttcattaatatttattttaactggccgaaaaccatctttgtctacttcattcaaaagatgatagacagaattttctctcacaaaatctccgtcaatatttccccacccattttccaactctctaaatattagttcgacttgttctttaccatatttaaaatagggctcgttacccatattggcccgataaaattgtcctttgagttttttagacattggtaacttcacatctgaaatccaagccccctctaaaaagcgaactgaatctttttcatttttcatacttcggtttttatctgaaatttgacatgatttaaatatccctaacgaaatcaggagcgctactaaaactaaaaccaaccatttcatatttttccaatttccatttttcataaaactcctcctcaatcaaggttatgattatactttaacataaattagaatacaaaaaaaagagcacataagttccatacttagtgctgctaccgtcaggtcctgacacgcttcgtaagaaacttattgctccgaaaactattataacacaatttatttttttcgtctatttttaaagaagtcttgcataatttttgcacactcgtattctaaaatccccgattctacttggactcgatggttcagtcgcttgtcttctaaaatctgatagagactgactgttcctccaaatttaggatttgtcgccccaaagtaaacttgtggaatccttgctaaaccaatcgctccggcgcacatgacgcaaggttcaatagtaacaaagagcgcacaatcaagaagtcgccaatttcccactgcctgatttgctgcttcaattgcacaaacttcagcatggtgcgttgcccgaccatcaagctctcgcctattgaaatcacgcgcaataatttcgccgtctttgacaatgacaaccccaatcggaacttcctcattttcagctgctttttgcgcctctttgagtgcttccgtcataaaaaattctttttcttcttctgtaaaattcatttatcctaaaaatttctcttgttcaagacaatatattttcactggaactgcttcaaactgttctaatgttccattgacaatcgtattatctaaacaaatatagtttggatgcttaccaaacaagattccactgacatgaccaacgaagacctgaacgtctgtgtttggtacccctaccgccttagcaacactatttcgccgctcaaaagaatctcccggcaaatgttcccaaaacaaatcagtttttttctctttttcataagagaggttcatttttgcactatgagagagtaccacccacttatttccaattttcgattgaatattgccaaccatttggcggagccccttcataaatatcaatcgttccaattgcattagaaagttgctccgcatccgttttaccgtcacttgcaagctctgaccacatttgttcatgatttcccatcatgactgtcacatgatagcccgcatctggcaaagttttcaacaaataaagcaaaacatcaaaaccaaatcggccgtggtcaatactatctccaagcacgaagagtctgtcacttttactaaagtgaatctctgtcagtgtttttttcaatcctggcaagcgaccatgaaattctgaaacaaataaatttcgctgataatgctgaccgtcagtaacaaatctcgttttaggattgtcagcacttgctttaactaattgttcaatctgccttttagtctttggaggattataattaaggaaatgatttctgatactgacagaaaaaatgataataactgtcaataaaaggacagacaaaataataattattggctttttaaagcgtctcgttaaagttgccattttttatggggaaccgctaaatcagtagtgacagtatttcccgctgcttctttggcttctgtcagtaaaatatccaaatcaccaaattgaggcaaatgagtcaaaattaattttttaactttcgcttctttagcaatttgaccagcttcaattgatgacaaatgattaggcattttagctttatccttaaagaaataaacatcggcaaggagaaggtcagcctctttggcaaattctgtcaattcatcaaaataaccagtatccccagtataaactaaaacttgacccgttctacgttcaacaatgcgcatggcataattaaccacagggtgtactgtttttaaaaatgtaatgtcaaaaggaccaacttttgtcccattttcgacatcataaagatgaccttcagaaaccttatccaaattcaatttagaaaattcatattcattttcgccatgaccataaatcggtaacatcataccgtcccaaccgtcctgtcctaatggataaagttgacgatattgacgaagtgctcccaaatcagcaatatggtcttcatgataatggctcaaaataaccgcatccaactgagtcggttgtaactcatgttcaagctcagtcaccgcacgagacccgcagtctaaaagcatgttgaagccagactccgattgtaaaagataagaagttgttcctgcatcacgagtggggtaacctccccaaacacctagcgctgttaatttcatttttttctctctttctattttttttcttaattctattatagttcaaagcaccttaatcttagtgctagacgtcctatattattctaaatggcactttatccacttcaattataaacctctctcaaaaagtggcatttaccagtatcaacactttaattataacacattaaaaacaattaaaaaccactccttaaaagagtggccctaatttatatcaagggaagtgtgagtttcctcttgctgcgctaagtatatcataagattttataattacaagttttaataaaaaaaacgaagcaaattgctccgtttttcattaattacttttatgctttttcgatattaacagcttgagggccacgttgaccagcttcaacatcaaaagttactttttggccttcatcaagtgttttaaaacctgaagtttgaatttgtgaaaagtgtgcgaacacatcttgaccatcttctgaagtgataaagccaaatcctttatctggattaaaccattttacagttccttttgtcatattaattatttcctttcaacaaaaattgtaaaccttattttgtgaaaagtgaatataatatacatttaactcatgacaaaatctactcgtctataatatcattatataggctacatgtcaacctataaaaaaaccacctcaataatgaaggtagtcttgataaactgttaggaaagcaactattcttcccaagactagtataacattttaaaatctaattacaacagcaataaataaaaaaagagagatagtctctcattttcaaaatttatactttatgtatatttgaagcataacgccctcgagctgtcattgttacatcaaaagttaccttttgaccttcattatactttttaaaaccatttccttgtatagacagtagataagcaaatacatcctgcatatcctctgtaataataaagccatagcctttgtccatattgaaccattttactgttccatttatcatcttaatacatcctttcgcattaattgtaaatcctattttgcgaaaaagtgcattcctgaaacatttaaactcacgacaaaacctacctcttgatagtaccacctctctgatagaaagtcaaattatgctttccgtatcttcttatggttacctatattatcatgcggatttgcttttgcaagagttaatgtttctctatcaactaccctcacatcatgattctctaattctacaatgagagcatgcttataggtgttaatatctgccgaaactatcgttgctttttcgccgtttgagagggtgataatatctcctgttttcatgttattacttccttttctaggctttgcctatttaacgaagaacttttcactacataagaggctcattttactttttaatgataagaaaaataagggccccctacagcccttaataatattgcgggaataggatttgaacctatgaccttcgggttatgagcccgacgagctacctaactgctccatcccgcttcgcaagtataacactatgttcaactaaagtcaaatccattaagaaatcatttgactgggacggtcatatttttcgttcaacagaaaaaaacttgaagagaaaaacttcattttttcactatcaaatgctaagttttggagctatctcttactcccaaattttatccacaatattttttatatgtgccaattttgcccattgctctgcttgtgttaacgagtttccttcttctgttgaggcaaatccgcattgtgttgagagggctaagtttttgagaggcacagattcaagagcttcatctaaacgtgctttaatttcctcatatttttcaagctctggatgttttgaggtgaatagtccaagaacaattaatacatcatttctttgattccagatttcggctaaaggagcaaaagagcctgagcgagcatcatcatattctaaaaagaaagtatcatagttaagttgtcccaagtattttgcgacaggctcatatgaaccttcaaaaagataagttgatttgaagtttccacggcaaatatgagtcgaaactctcaaatcttccggtaagtcttctaaaagtttgttgacaacataaacaatatcttcacacattttgacatatttttcatgattttcaggatcatctaacaaacgtgcaataagataagcccaagttgtatcatctaattgaatataacgagcccccagctcataaaaatgaagcaaagtttcatgataagcttgagccaaatcatctaaaaactcttcccaacttccataaaactcaggccagcggtctgaacgaccatcacgattcggaattaatgatggtgatggaatcgtaactttaggttcaactccttctggtaaaatacttttcaaatattcaaaatcagcaaaaaaaggatgctctggattaaaggctacttttcctgtcagttcaatattagtcgttcttgtttttgctccatgaaatttataagaagcttcttgttcataaactccaactccatttagtccccagagaaaatctaaatgccaccacgaacgattaaattccccatcagttacagctttaagaccaacctttacttcttcttttaccagtctctcaatttctacttcttctacttcttgaacttttttaaatctgtcagtgaaagttgaccttcggaataagccgaacgtgcatcttttagggcttttgggcgaagaaagcttccaacgtggtcaaaatgataatgattataagtttttgtcatgagtttacctagattctattagtttaactctctccattgtaacaaagccttttttctttggtcttagaaatttttaatgttgtgatgaaaatatataatattaaattcaagtgattgacttaggagtcacactggtatacacttttacttataagtgaggtagaaaaatgaaagcaatcggaacagttgactctggtcgaaattttattgactttgaaatagaaaagccaatcttaagaccacatgatttactaattaaagttgaagccatttcaatcaatcctgtcgatacaaaagttcgaaaatcaatcaaagggacactaactcagccaaaaattcttggttgggatggattgggaactgtggtcgaagttggcagtcaaagcaaactttttaaagttggagattctgtttttttgggctggagatgtcacgcgagctggttcaaacgctgaatttcaagcagttgatgaacgaattgttggctttgctcccaaaaatctttccaaagaaaaagccgtcgccatacctctaacaagtttaacagcttatgaacttctttttgaaaaacttcaagttaccagtgagtcaaaagggaagtcaattcttatcattaatggcgcgggtggcgtcggttcagtagcaactcaaatggccaaaaatgccggattgacagtaattgctacagcatcaaatccccaagccattgaatgggtcaagaattttggcgccgattataccgtcaatcatcatgaaaatctggtgcctcaagttcatgagcttggctttaagtttgttgattatattttaattttaaatgctgttgttgaacatatgcctgcagtaaatgagttaattgctcctcaaggttcgattgcaaatattgttgaaccagggcaagctattaatttagataaactggctcataaatctgctcgttttaactttgagtggatgtttactaaagtggtttcagacactgatgatttacaaagtcagcatgacatattaaatcaagcttctgaatggctagataatggtactcttacaagcacaatgactcaaaatttaggtgctcttactgctgacaatgttagaaaagctcatgagcttattgaagaaaatcataccatcggaaaaattgtcctcacttgaacaaaaaaatcctcatttttgaggatttttaaatttcatcaaaacgaacaattaaataaactgcccctatcatgaaagtggagcccatcattgtccaacttccaaaccaatttccggcaagggttgctattgctgctccagcaaagaaaatactgatgagcgctgcatagataccgactgaacgaagtttttgtttatctttggtaataatatactgtgcaagatttgctgacatagacttcatattacctgtcataaagatacttccgtaagctcgtccgtgaaccttggtgaaggtatcatattgaattgccataaaataagaaaaaattccaacataaaacgaaacaggaatcttcaagcctaagccataagctaaggcaaaaatagtcacacctaaccattgaaccaaaagcaaataagaagcatcaaaatgacgtcgcttcatcaaataatgagagtaaaaaccgcgagtcattacccctaatataaagaaaataatcggaatcgcaaaatcccaaaatcgagcaaaatctcctttggcaatattaatccctgcttgaattacattccctgattgtgccccaataaaacggtcattaaaatgaaagaatgagaaaccatccataaatcctgcgttcaaagcaaaaattaatgctatccgcagtttttccttaacttgtctatccataattagaattatatcacaaagcttattctctttgcttttcaattatgaagcaaatttaacttttttattttgattttgatgattttaaggaatatataaaataatagagcggattcaaaagattaagagaataatgttttttgagttataatggatttaaacgattagctttccaaaagcatttccagttcaaaatgaggaggaattaaaatgaacggttatcaacaacaatatacttgtatcaaatgtggcaatcataattttgaagaagatcagcttcaagcaactggtggaaatttttcaaagctttttgatgtgcaaaacaaaaaatttattacgatttcttgttctcaatgcgggtacactgaactttataaatcacagacaagcaacggaatgaatattttagattttctattgaatggttgatgatgaagtcaataaaattaaaaataagacctaagtcttatttttatttaagaaaattaagttataatgtaaagtacatactttaagaaaaggaatagagtctttatggccgttttggaattaaaaaatattaggaaatcttattttcttggaaaagaagaatttcctgtcctcaaaggaatcgacctcgagtttgaacgtggtgatttcgtcagtctcctaggggaatctgggggaggaaagtcaactctgatgaatatcattggggggcttgaccgtaaatatgagggggacgttatcgttgatggccttgctcaaaaaacaaaaaaagaaaaagatatggatgcttatcgccgagatactatcggttttatcttccaatctttcaaccttgtcagctatttgagcgttttagataacattttaattagtcttaaaatgactagtttatctgacaaagaacgtcatgaaagagcgattgagctgaccaagcaagttggactctatgaacatcgtaagaaaaatccatcacaactttctggtggacaaaaacaaagggtagccattgcgcgtgccttggcttctgaccctgaaattattcttgctgatgaaccaacaggagcgcttgactcacaaaatacaaaagaagttttagcacttctacgtcaaattgcccaatctggtaaaacagtcattgtcgtaacccactcacaagaagttgctgactatggaactcgaattatccgtttggccgatggacaaatcataggtgacgaacgtctaaaaccgccttaccctgttgaatcacatcaacgaatgcaatcaaaagcactctcatatcgtgatactttcagaacggcctttaaacactttacccactcttggaaaatcaatttattaattgcaatcggaaccgcaatcggtcttttctcagttatcttcttcttaggactaggaaatggggcgaccaaatatatgaatgacaccatcacttcgagtgtcaatccaaatgtggtcaccatcttcaagcgaacaacaacagataataagttaggaaatgagcaagccctgcaacaaactcaacaagagcttggaaatgcttctaccaatcttgacagtgatcatctttcaaaattgaaaaaagtagataatgtcaaaaaagttgaaccaacctattctatttctggtttaggcacacttactaacaatgacaaatctaaatctggtttaattactcttgatacttggacacaatcaaatattaatgatgattatgtttctggttcaaaaccagctgatggcgaaattgcaatctatgcgaaggacgctaaagagttaaataaagattataaatcattagtcggtaagaaaattactttgaaaattccagctaaaacagctgctggcgcaagtgttgaagtgacaaaagaattcactgtttcaggtattttgaaagaccctcaaggtcctgcaggttcttctagcagcgttattgctacttataatactgtaaaatctgctcttgaagctgctaatgctgacactgatgcaacttatgctgtagtaacagttaataaagtagataatgtcaaatcaactacttctgatattcaagacttgaagattgatggaacaaaagcttttgttacttacagtgttacttcattccttgatgtaatcactaatattactaacattgtcagctatgtccttgcagctattgctggtatcagtttgattgtttcaatctttatgattgtcgttacaacttatatgagtgttgctgaacgtacaaaagaaattggtgttatccgtgcacttggtggacgtaagaaagatatttctcgcctattcaccgcagaaagcttgattcttggtctttcatcagctgctattgccatcggatttgcttatctgggacaattcctcattaacaaagttttgagtagcttccttgaaggagcaagcattgttcaaatctctggtggtcacatcatctttgcaatcatcattgccgttttgattgccctcttggcaagcttagctccaagtggtcgtgcagcacgtttgaatacaattgaagcacttgcttctgaataatcactcaacttacaaaggcttctgtcagtcagtcacatttactgacagaagcacaacaatattctagcgactgacaatccagtcaattgctatgaactttctatcagtaaataaaagaataaccggctctgctggtgattctgtcagtgaaaacaatcatttcaaaaaatagaccttgcctaaagacaaagcctattttttgtactttatattgtttggaccccttccagccttatgttagaattaaactaatagacaaataaaaggagtactaatgcaagaaataattatccaagtcatgaatcaatttggctactttggtgttgcttttctcattatgattgagaacattttcccaccaattccttccgaagtcatattaactttcggtggtttcatgactaattatagcgaactggggattatcggcatgattatcgcagccactattggttctgtgcttggtgcattgatactctacttcgtaggtcgtcttttgagcgtagaacgccttgagagattagtttcaggtcgtttaggaaaagttcttcgccttaagccagaagacatcacaaaagctgaaaaatggtttttaaagagaggatatgcaacgattttcttctgccgtttcattccattgattagaagtttaatttcagtcccagcaggttctgcaaaaatgaaacttcctagttttcttattttaactactctgggaactctcatttggaacattgttctagtttcacttggggccgcactaggtgataactgggagatgattgccggaattctcgattcttactcttcagttgtcgttgcaattttaggggtcatctttatccttggacttcttcactttgtcaaaaaacgcttcttccctaaaaataaaaattattcacctgactcagaaaaataagccttcgtgcttatttttttatatgaaaatttcttatcttttgttataattgggcaatataaaggagaattttatggtatctaaggggcgtttagccggatttattgatgcaattattgcggtagtaatgacgatcatgttgttagagtttgaattaccaaaaacaggtgggattattgagtttttaagagataatcttgtctatttgattgcttacctcttaagttttatctatgtcaccacctcatggtttaatcaacaatacatgctccaacaagctgaaaatattagccgtcggatttaccacagttgcatgctctgggttttgtcattatccatgcttcctgttttatctgcttgggctggacggacaatcgacttctttcatgatttcgggcttcattctccaaaagcccctgctttactttttatcatgatgatttacctctggggctttgcttatacttatatgacaaaatgttttattgaggacaacccaaaggaaaaagccgaactgattgcccaaatggaagtttatcattatttacgtcatcccttttggaaaatcggaatgattgtcagtttcatactaacatttatctatcctccctttgtcttcatttatactgccggagaaatgatttttgcaacagtacgcagccaaaataaaaaaactcaacgatttaagttgagcttttttattttattgaccaacagtcaattgttctgaaaaatatttagcatagagtgggtgagttgccacaagttcattgtgtttcctactacctgtgatttcccctttttcaatgaagtaaatcttgtcagcatcaacaattgttgaaagtctatgagcaatgacgagagttgtccgtcccttcatcaaactatctaaagccctttgaaccattgattctgattcactatccaaactggctgttgcttcatcaagcattagaattgttggattacgtaagaatgcacgcgcaatggccaaacgttgtctttgtccaccagaatttttgactcctctttcaccaacttcggtattgagttggtcaggcatattttcaacaaagctacgtgcaaaagcaaggtcaagaacttgccagaggtcttcgtcagtaaagtttccttcgagtccgtaagttaaattttcacgaatagttccagccataatcgctgaatcttgactgacaaaaccaatttgactccgccaattttcaagagaaacactatcaatcggttgaccaccgatagtaatctctcccgctgttggttgataaaaacgttctaaaagggagaagatggttgatttaccaccactagaaggaccagcaaaggcaattattgaattaggttgagcttcaaatgagatatcatgcaatatttgttcagaatcatcgtaagcaaaatcaacatggtgagcagagagggtctttccttccaaatcaaggctttcaccttgatgaaggacttcttgttcttcatcaagtaattcagtcaaacgaccagttgatcctgacgctttggcaaattctgtaaagaaagttgccactgttgggaccgctccgattaaattcattaaatacatcatcattccaagcaaagttccaagactcataactcccgttgaaatgagatagattccgtaagccaacaatccaaaaatcatcaacatcattgataacatcatgactggtgacatcaaaccatcaaaaacggcttcttttacaccaattttataaagggcattgacatcattttctgcttttttagaagcttgtttttcagcatttgaagatttgactaaacgaatttctgataaagattcactggcaatcccttggaaatttgctaaagagtcttgcctagtccgccctattttttgaccaaaagtcataattggaaacatgataagcatgacaatcggaaccgaaataatcatggcaagggttaaacgccattgcatttacagcatgaatacgattgaacctaccaagagtaaaatagaggtaaaagcttgaggaatactatttgcgattaagtttttaacttgcgtggtatcgttagctaagcgagaactcatttcacctgttttaacttcatcaaaatattttactggcaaatgaatcattttatcccagacacgagttcgcaaatttttaacgaccgactcaccaaatatccccagaacgatggccgcaatagcagaaacggctgctgaaccaatataaagagcaatgactaaagcaactttcccgccatttacaccatgaccaaaactattaaccagtggctaaaccattttaggaacttgcaattgaatgagtgtgccaatgataccagccacaatcccaatcacaaagaagagataacgtggttttgctgcacgaattaatttgacgaaatgtttaatggatgttttgtcaaccgcttttccttcaacgcgattggccatttgtggacctctttccattgtttgcttacttccttttttctaattattgaaattcaagactaaaagaacttaattcaatcacttttatccttaaatcagtttttatttttcattcttccaaataaactttgaggttttctaacacaatgctataaccagctggattaagatgagcgccatcgaaagtgagttctttctttaaattgccatctttatcggataagccatcattgacatcaataaagtgaaaatgatgtttttgagcaagtttttcaattttgtctgatgctttttgaaatttttcattacttctcgtttcaaacaaagttttttcatctgaatcttgtccaaaatcaagggtattgattgggtaatagcgcatgacataaacttgtgcttgcggtaatttttccccaatttgtgtcaaaatttcattgtagttgctcataaattcagcttctgggacttcaaatccgatatcattcgttccaatattgataaaaatttttgacggctcaaggttaataatctgactctccagatgttttaataaaaatgcggtcgtggtagcgcgaactgcacgattataaatgtattttgaaaatttgacctttccctcttcttcccacttttcaataggaaatatttccatcagtgaagagccaacaaataaagtctgacctttttttgctgatagattttctttgtcatattgggcaaggagtttttcttgaaaggcttcaagttgagggtttaacgtaagtgctttagtttcttctgacattttccttttctccttttagtcccaatttactttttttaattcttcaataaatttttgaggagcttctgataaaaattcaatagggtgttttttagattctaacttaatcattgattttgcaacgattttatcatgccaatcaaatggagttaaattattaacttctccaccaaaatttgcaatcgctactgcatttttacgtaaaggttcagcaatttcttttgcaatgactttattaaaagtaccatactctaccatcgttacaaaagcagcgaaaagtttattttctaagatattttgataagttcttagaaaaatttgaactgagctctcgaatttatggctatatactggactagcaacaatgactgcatcaaaatccttgggactaacttcttcaacattcaagtcaataagggtcacattttttaaacgaattgctaaccttcttgcacattttgctgtatttcccgtttttccagcgtaggcgatgagtgtattcatctttcacttcctaatctatttactgtttagaaatcatcccagttttctggttttttaggttctgcatgtttatcagagtgtcctgctctagggtcaaattcatcaaattctggacgatgatgtccatcaaaatcaccaaaacgatttttcatttcatctgagaaatgttcccaatgttcattaaactctgcttcatctcgtttaccaaagctattgcggaaattttcttttatttgttttccaaaaattttccagtcttcaccaaatggtgcttgtgaacgatcatcatgacgcatccgattttgaccacgtttcatttcttgagaggaacgacgcatttcacgttgccaattttgcatttcacggcgcatatgatttccaaaagcatgacgatcatgggcattcatcatattttccataaatgggtttccgaaaaattgtgtcattttttggaaatctcgatcttcatgtgcatcattcgtttctactaatttttccattagatttgccagttgtttttgttcttcatctgtcaaattaccaaaaattgtttcggaaatatcattgtgcattgtatctcgtgtttcttgggcttcccgtcctttttctgttaaaaagatacgattgacgcgtttatcattttcatcttgtttacgaataaccatttctgcttcttccaattgtttaacttgagccgttacactcgaaggcttaatatcaagcagttcagcaatctcagcatttgttaagccatctttgttccataattcgacaagtaatccttgggcaccattacgattccctcgatttttcatctgttttgaaattccatctgctcgcaaagcaaatagaacgcttggattgtgcaatagttttgaaaataaatttaataagttatttgtttgttctgacataatttgttctccttagtttagattggttgtagttgttcatcaaaagcgtagacgagtaacgcatctggttgttcaattagcctgatgaaccaattgaatttctgaattaatttttttatcatcttaagcattggttctcctttaagatttttattcactttaaaagttcccttattattgtttagtgaacttttattttagagagagatttttaaaattagttagtttatttatttattaactaacaaaaatgattataaatcatttaattagttttgtcaacaataaaactaactaaattaaaaaaatcagcccaaagactgattttttattttattcatttcctaaatcaatctgataaagttgcttaaatgtcgggttactttccagcaatactgctggttttccatcaaatttaatcgaaccattttctaaaaatagaacacggtccatttggtgaactcctaataaatggtgagtgataaagataattgatttatctcttaacctttcaaaaaagagtgttaataattgattttcagtaattggatcaagcgagacggtaggttcatcaagaataaccacatccacatctgacagtaaaactcttgcgagtgctaaacgttgtcgctctcctccagaaaaacgttctcctgcttcgtcaactggcgttaacaatttttgtggcaacgattcaaccattttacggagtccgactaattcaagcgcctcccagatttcttcatcagtagcatctagttttgccaaagttaaattagaacgaaccgttgttgcaaagagatatggagattggttaatcacacctatcttttcttcaacattttttgcttttgatggttctacacctgaaaatgtgatttctcccttttgcggaattaaatctcctcgaatcaaagaggcaagggttgattttccaactcctgaacgacctagaatcgcaatatgttcaccctttttaacctctaaatcaaaatcattgaatattttattattttcttcaaaataaaattgtagattattgatgaccaaatcagtcctagtgatttcctcactcctaatttcttcatcttggtctggtagtgcatttaagcgattaattgaatcaccatagcgatttgtttcaaccactgcatcagacaaaggagaaaaggcatcaaatagtggaaaggcagctaaactaaccgctgcaatataattgggagcatcccctaattttaaaattccagaagaccaaatcatcaaatatattactaaagccccataaacaacctgtaaaaagagatttcgtcttcggccaaaagctaataatttagcttgaatctttctggcagataattctgatccccgataggccgttaaaaaatcttcttttcgaccagaaaggacccagtcttgtaatcctaaaatatcatcagtcaaatgagaaaaaagttgattccgataaattttaagttcttcatctagttttacagtaaattttagagaaattaaaggaagaattacaatcaagaaacctagaaaaattgctaaaccaaaggcaaaccacagagataaaaatccgccggcaataattaaagcaactgatagactccccgcaatcaaaactgggaacaaggttcttaagaaaaggtcttgtaagtttccaatatcttcattaagaacccccaataaatctcccaaacgatagcggtctgctaaggtcactgctgttttttccaatcgtaaataaagtttttgacgcagcagacttgtgatttttaaaatccaattatgtgaagttagtctttccacataatgcattacagggcgtccaatcccaaaaatccgaacaaagagaactggaacataaatcatcaagatattttctggttttgtcgctgattttgaaataacataaccagaactaaacattaaaagtcctgccattgaaattgtaatcgttcctaagaaaatagacaagataaaccccgaacgattttttttcaagaatggagaaatccaatcatttccaaataaaatattttttaatttcattattcatggcctccattttctgtcagtaattttttatcatcatcaacacctcgcatttgactgagcaatttttgatagtagccattctcagccaatagctgttcatgggtgccaattccttcaacttgtccttcattgagtacgatgaccaaatccattgataaaagccaatggagccgatgtgtagcaataaaaacaagtttattctcaagcaaaggtaaaatgtttgccttgatttctaattccgtttcaatatctaaatgagccgttggctcatcaagaaataaaatgttacgtgtacgactcaaaaaggctctggccaaagccacacgctgtgcctgacctccagaaattgtccggccactagcaccaatttgcccatcaagcccaatttcattcagtaaacttcctagaccagcaagttctgcagcttgattgatttgttcgtcagttgattcggactcataaaaggccaagttttgacgaaaagttcctgcaaaaatgtaagttttttgaggaataaattgaacagattgtcgatacttttcatcagtcaaacttgtcaatgtttggtcattaagcttaaattttccagctgtaggttctaaaaatcctgctaacatagaaagaagggttgacttaccagagccagaacttccaactaaggcaacttttttaaatccttttactgtcaagttcacttctgaaattccgcgtccagtatcgtaaatttttgctaaatctgtcagtttgaggctagaatcctcagtccaagtcactctgtcttttagcactgacagggtattttcgtcagttgaaagaacttcatttactgcagacaaagcatttttcccgttaagtgttgcatgataatcactagcaaaatcacgtaaaggtaagaaatactcaggtgctaagattaaagctgcgagggctggaaataataaaatgtctccactcatcaatcttaagcctaaaaaaagtgcaactattgcaacagaaagactggcaaagaaatcaagagcaaaagttgaaagcatagcaactcttaatgctcccattgtttctttccgaaaatcctcagacgttttataaattgaattagaataatctttagacagaccaaaatatttcaaagtagaaattccgcgtaatgagtctaagaaatgatttgataaatattggaatgttttgtactgacgctcggctcttccttgcgcagcataacccaataaaatcataaaaatgattgcaaaaggaaaagttaaagttagcacgattccactttgccaatctagaaaataaactggaatcagaattaacattgggacaatcatcatatttaaaaccttagataagaccagtttaatataattttcaacttggtcaattcctgtaataactgttgtcgcagcagaaccagaaccaagatttgcaatagctacaggtcccaaacggaaaaatttatccaacatatctccgcgcaattttgttgctaaattgtaagcaagcttatccaaagattttgcacgtataaaattaataatttctcggctcaaaaagcagactaaaaagcccatgacccaaggaataacatgagaaaataattgcccttgccaaagtttagtaattgcagcagccaaaaacaaggcctgcccagcgatagcaacaaactgcagaactgccaacattccaagaattggaaacatctttcttactcctggcagttcaaaaagtgatttatcaatcatatttaaagttactgataagcacattttttattgttcaaacagaaaaaatctaaaaataattgaagaaaatttctgtcagtaaaaaaaacagagcatcagttcctttctaaaaaatttaggtcagaaaaattttctgaccagaataaatggttacctctaattaattatatcaattaaaaaactaatctgaaaataactggcttaaccagttattctcataatttatttttgaattctttttctgaaaatataataggtccagcccatgtaaataagaacaaaaggcaagattgctaaggtaatgattgtcattgttttcaaagtataacctgttgaactagcattttttatcaaaatactatgagcaggattggttgcaatcatcactcgtgggaatattccttggaagattagagcaactaaagcgatgaaagtcaatcctgacgccaagaaagctgacatttctttacctgaacgaacagataaatgagcgacaagagtcaaaatcacaatcaaagcaagtaaaagcaaagttccaatgaaatgtttttcaaagaaatcagtgaagacggccagtaagattgcaaaaactacttctccagcatagaggacaaagtagaggaagtttgctacttttgcagctcttttacgcaaatctccttctgttttcaaagctaaatagtttaaaccatgaagccaggccaagagcattacggcaacaccacccacaactgacaagaagtttacataagtggtaaaagtcgcagttacattccctttagcatccattggaacgccttgaatcatacccgtaaacatcaaaccaaagagaaatgggattgcaaagctagctactcctaagaccttggtccaaatcattttccctttttctgtgtgtgagtgatgacgaaactcaaaggttactccccggaaaatcaaacctaccaaaattaagaatagaatcagatagaaacctgagaataaagaggcataccaataaggaaatgaagcaaacattgctccaccggctgtcaaaagccaaacttcattcaagtcccaaactggaccaattgatcctatagcttgctcgacttcacgtttatcctttgcaaccgtaattgcactcattcctactccgtagtcaaaaccttcaaggaagaaaaaaccactaaataatactccaacaataataaaccaaaaaagttgtaatccagtcattattcatccactcctttctctttagtttctttttgaatttcattttcttctttagatgaagaatcaaaattttcttgactaaatgaatctaaagaaacataagctgtttccgcaccttctactccttctctcattcgttgaagagtaaagtagaccatcacagccccaaggaagcagaaaaggaagaaatagacgatgtttgagaacaagagtgaacctacagaaatatttggtgaaactgaatccttcatcgtgaacaatccatacaccgtccaaggatagcgtccaagttcggtcactaaccaacctgaggtaatcgcaagaaatggtgcaaataacatccaacgatacacttgcaaaccaaatttatttttatatagacttggttttttcttccttgtccaaaagagacccagtgccgaaagtagaatcattaacattgacagaccggccataatccggaaagtccagaaaagtacagtcactggtgggaagaaattccctccaatttctttagctacatcaggatacttcttctgaagttgagcattaatttcattcataccttcaacagaaccactaggacggtgataagtcagaattgaaagcatataaggaatttgaattccaaacacttctttatgatcagcttcattaaagaaagcaaccatatcccaagccgcagggtcaggagtcgtttcatagacaccttcagttgcagcaaatttcataggttgagaatttttaacttcaatcatttgttggtcaccagctacaaagttacctacggcaccaattaaagcaaccaaaagtcctaaacgcaaaactggtttaaacatatcaatttctcgatttttaagaatttgataagctgcaatcccagcaacaacaaaaccaccagttacaaggaagcctgttgccacgtgactaaattctaaaattgtttgaggatttgtcaaaagagccgagaaacttgttaaggttgctcgtccaccttttacttcataacccactggattttgcatccatgagtttgctgccaaaatccaaagtgaagacaagaaagtcccaacaaatacaatccatagcgttgcattatgcagtttctttcctaacttatcccaaccgaacatccagactccaaggaaggtagattccaaaaagaaggccagaagggcttcaacagccaaaggcgcgccaaaaatatccccaacgtaacgagaatattccgaccagttcattccaaattgaaattcttgaataataccggttactacccctactgcaaaggataagagcataatagatccaaaaaatttcgtgcgttttttccatttttcatcaccagtttttacatagattgtctccatgattgccgtcatgagaaccattccgacagaaagcggtacaaagaaaaagtggaagattgtagtcatcgcaaactgaaagcgtgcgagattttcaatggttagcattgtttatctccttattttttatttactatatatatcaaatagatataccagcctaagatatttggagttcagagagagcgcgtttgattttcaaacttcgcaacagaaccaaatattttaatgcacaacttattaccgtcttaactctgtggttagaggccgatattccgcttgaattagaaaaatttcgaccaaaatttctctttttcatgaattcttctgtccatgagctgatttttaaaggaattgattaaaacaaaaaaacgtaaatcaaaagatttacgtttttcaattaaagttttgtttttaaggagcaatacgttttcgagctgctctttttctgcccatttcaattttttcttcttttttcttgataggattgataacttttgctttaacaccgatagctgcagcagtaattcctgctaacaaaagtgcattccccgccaaaaagcctttaataaatgtacgattcatttctttctcctcctaattttatagataaatcatcaactaagaaaacttcactgagattttcttagttaactctacaagcatattttaacataaatgttataaatctaaaaataataaacttagaatgaaataataaaaaaccttctaactataatgtcagaaagtttttttaagttaataataatcttattatttaaaccatttatcaacttgtttttgatggtctttaatccaagcttttgcagctgcttctggtgtcttaccattttgaatatcaagcataacagattccatatctttagtggtccaattaaaattattcaaaaccttataagcttcaggattttcttttttcaatcctttgcgcacaattgtattaatattttctgaagtccccattgttcctttcggatcagctaagtatttcaaatcatatttattgaacatccaatgaggagaccaaccagtgattacaatgtctttatgttgtttaatggcttcaccaagagcaacagtcattgcaccagatgatgaaggaacaagcttccaatctttaagattactatagctcttaagtgtattttcactggcagccatgacacctgcaccaggctcaattcctgtgattgttttattggcctgattagtcaaatcttcaattgaattcacattcatataacttggcacaacaaatcctactttagcgcctttaagatttggacctaataactcaacagacttaccatattttttccattgggtcttatgagtgtttggcaaccaagcagaaaccattccatcagcttgactattagccacagtttgccaagcaactgcgttatcaagtgcagtcgttgtaacatcaaaactatgttcttccattgcttgggtcaaaacattgattgacgcaacttctgagtcccagttcatataaactaaatccacttttttatcagaagattttttcccaaaagacattcccgaaaaagcaccaacaattaaggctaacaatgaaacgatagcaatccaacgtttccattttttgagcttaggatttccttgtttttctaaaggagaaacattaagtttttgcgtaaagcggtcaataataatagccaaaataactaatgaaatcccacttacaaatcccttaccaatatcagctgattgaacagcagctagtactccacgacctaaaccaggtgcaccaatcatagaggcaataacgaccatagaaagagccaacataattgtttggttaacaccagccataattgttcctttagctaaaggaaattccaatttaaataacttctgacgggcagtcgaaccaaatgaatctgctgcttcaactaattcagttgaaacttggcgaatacctaagttagtcattctgacagtcggtggcaaagcaaagattactgaagcaaataccccaggaacaaccccaataccaaagaaggcaactgctggaatcaaataaacaaaaccaggcatggtttgcatgaagtccaatataggttgaacaatcttagctactagttcagattttgccatccaaattcctagagggacccctatgataattgataacaaacttgaaagtaagacaagggtaatcgtactcatcaaatctgaccataagccttgattggcaattaaacaaagaccaataaaagtaaacaatgggaaggcaaactttttacctgaaaccaaaattgctaggatagtaacaacagcaatcatcagccagaatggaactgcagttaaagcacctgttattccgttcatcaacactgttcctgatttttgaatcacatcaaaacccgaactaaatgtacttgtaatccaatctgttgctgacgatacccagttggctaatggtatttttccaatcactaaatcaatcattcttctcctcctctttctctatttcttctacttcatcaggaatgtctgccaatgcttctaggacaattccccgaatcagaattccttttaagtagccttgatcatcaacaacagctaatggagttggagcatcatagataattggcaagatatctcttacaagcatttctttagtgactgtcccaacatcagttgtcatcacatctttcaatgattgattgttttttctagcagcaatagcttgctcactagtaacaaccccacggaattgacgttttctgtcaacagccattaatgagctgacttcttcagttttcatttttttcaaggcaacacttggaccatcgacatcaatgttagttgttaaggctggaatcatgatattttcagcagtaattactttggcacgatctacgtcttcaacgaaagttttaacataatcgtttgctggatttgttaagatttcttcacccgtaccaatttgcatgattttaccatccttcataatcgcaatacgatcaccaatacgaagggcttcatttaagtcatgggaaacaaaaatgattgttttttggaatttagcttgaagttcaagtaattcatcttgcatttcacggcgaattaatggatcaagcgcagaaaaggcttcatccattaacaaaatctctggatcattggccaaggcacgtgcaagcccaacccgttgttgcatcccaccagacagttgcttaggatattggtctttaaaatctaaaaggttcgcattatctaaagctttctcggcacgtttgcgtctttcttcttttggtacattttgaacttctaaaccatattcagtattttctaaaattgttcgatgtggaaaaagaccgaagttttgaaaaaccatactcattgacttacggcgaacttgaagcaaatcttctttattcaaagtggcaacatcttggtcatcgataaatattttcccactggttggttcaatcaatcgattaagcaaacgcaacaaagttgatttccctgaaccggacaaacccatgataacaaaaatttctccctcattgatttcaaaatttgtatcataaaccccaacagttgcaccggtttttttcaaaatttcatttttgggttcaccttgctcgaccatagtcaatgcagttttaatccgtttaccaaaaattttagttaaatgttcaattttgacttttactggcaaaataactctccttcattctattactcatgagccgaaaactttttttagaaaagaatttccaaaataaatagttaattataaattagaagttttaggttacacaagtgattttctcatttaaagtgaccactcaatactaacaatatgtagtcactatgtcaactaactaaatttgaacttaaaaaaaagcatcgttttgtaaacgatgtcattagttgccataaaagaagttttggacaatttgtcctgtatcagaagctcctacgaaatataaggtatctccttgatttaaagttgcataaggacccggtgaaactattaattcttcattctgtaaaattgcaacaactgttgctcctgtattttgccaaagattcatttcacccaaactcattccgaatttttcagaatctctttctagttcaaattcaatcggggtcaaaggatttattttttgaaaatgttcagtttgatcaaccaatttatctaggaaagatgaaaaatttgccaattctcttctttgactctccacactctgcatgatttgtgttcgcaagtcttgcattgtttctacttcttgatattgcgctaaatattcttgcgctttttgttttgatgcaataattacaccacttccatgaacagggtcaacaattcccaaatctcctaagacgcttatagccttacgtgctgtttctggtgagacaccaaaggttgttgcaagagtcgatctggcatatatcttctgtccaaccttaagttcatttcgaacaattctttcagctatttgcagggcaatttgttggtatcttggctgtcttgctatccgcactttaattctccttatcacaaaacattgaaaatctactttacctaagcaaaacaaaattccctcataattatagcgctttatttattatttttcaatctataccacatcgccccactttcaaaagagctggactaaaaatagcttctcaatatgagaagctatttttttataaattcgtaccgttagaatcaattacttgtttataccaatcgaacgattttttcttaaatcttttattcgttccatttccgctatcatctaagtcaacatagataaaaccataacgtttactcatctcccctgttgatgcagaaactaagtcaatacagccccaaggtgtataacccattagttcaacaccatcttcaactgcttcactcattgattgaatatgttttttgagatagtcaatccgataatcatcttgaatagttccgtcttcttcaactttatcaattgcccccaaaccattttcaacaatgaagagaggaatttgatagcgtccgtacaaatcattgagagcataccgaagaccatcaggatcaactgcccaaccccattcactttcttttaagaaaggattttttactccgccaagaaccatattccctgaagcttggacgccttctcccgtttttgattcaaccgtcgacatgtaataactaaaccctatatagtcaactgttccttctgcgattatcttaagatcttcttcagaaatttcaaggacttctgaatttactccatgtttccgatgaagtctatttgtaaacgcagggtaggctccgcgaacttggacatcattacaaaaataattaaattcttgaatactttcttgtgtcgccaattgattgactggattagcatcaaaggaataagttgttgaataaatgctcatgcaaccaattttcaaatttttattcaaatcatgaccaaatttaactgcttgagcacttgcaacgaactgattatgccaagctttaaatacattagttttatcatctccaccattagatggaacaagtccttgacttaagcctgaaaagaaagtcgccgagttaatttcattaaacgtcatccaatattttactttgtcttgatagcgttctaaaaggacttttgcaaaccgcacataaaattcgataagttcacgatttttccatcctccatatgatttagccaaattaagtggcatttcatagtgagaaattgtaatcactggttcaattctatatttcaaacactcatcaatcagttgatcataaaaaagcaaacctttttcattgggagttgtttcatctccctttggaaaaattcttgaccaagctactgaaaaacgatacgctttaaaacccatttccgcaaataatgcaatgtcttctttaaaatgatgataatgatcaattccatcatgatttggataagtaaaatgttcagtatcaatcgtccaatcaaattccggacttgcaagaattgccaatctttctttacctcctggcattgcatctgctactgagagacctttaccatctatatcataagcaccttctaattggtttgctgccgttgctccaccccataaaaagtctgttttaaatgtcattttataattttcctatctaatttttaaagtttttcatcaatgctattttaaactggattcgccactaattcagttgtttgtgcattaactgcagttagtaacacttcattttgatgaatcgtcgattgatttgtaactagaatatccatataatcctgagtatttgttacaatgattggaacttgagtactgtatcccgcattttgaatacgctcaatatcaaacttaaggagtaagtcgcctttttttacactttgaccttgttttacaaagctttcaaagtatttcccttcaagttgtacggtatctattccaatatgaatgagaagctcagttccttcgcttgaaattaaacctactgcatgtttagtcgggaacaaaatcataatcattccatcaaatggagcacgaacttcgccaagcgtgggttcaatcgctgctcctttacccattactcctgcagaaaaagctgcatctttaacttgtgatagcggaataacttttccttcaagaggacttccaattgtttctttattcgttttttgtttgttaaattttttgtcaggacttggattatcaataacatcatcttcaaatcccacaagataggtcactacaaagccagctataactgcaacagctgatacaatcatcattttaatcgcacctgaaacttcacctgtaagggtaatattagatgtaaaactgaagattcctaaagctcccattgtataggctttaattcctaaagccatggcaacagctgataaaattccacttacgatacatgaaatccagaatggacgtttcttagggagcgtaattccgtaaattgctggttctgttacaccaaaccaaccagaaataaaggctggtattgctaattcacgaagtcgtttatcttttgttttcaacatcactgctccaacagctccagtttgcgcaaacgatgcaacacttgcagcaattaaaagcgcagttggttctccttttgctaatgcaataattgcaaatggaacaattgcccaatgtagtccaaacatgactaagacttgccaagcaaaccctagcactaaaccaaagataatcggattaaatccttgtaatgctaataaacctttacctaacgcatctgaagcaaggttcattactggtccaataactaggaagcccagaggaattgagataatcgccgtaaagaatggtgtcaagaaaagtttgactacatcaggaataattttctttaactggtgttctaaaaaggctgcaaatgctgtaatggcaataattggcattacagatgaaccataaccagctgttggtactgagaacggtatcccaaagaggcttagcccaccactttctgcaaatgtttttgcgacagttccatctacgaaacctggataaacaagtgctgcggcaatcatcattccaacaaacggtgaaccattaaattttttcattgaagtataaccaatgaaaattggaagaaataagaataacccatcacccatcgcattaaaaacagcgtaagttgctgacgattgaaaactttgtcccaaggcaaaggataaaattgcattaacccctttaatcatacccgctgctgctaagggagctaaaattggttggaaaattcccgagatcaattctacaaattgatcaaaaagatttcctttttgtgcagaatctgctggtgaggtatcaagtactccaagaacagcatcaacgtctgcacgtacttctggtacatgattcccaataacgacttgatattggccaccagattgcattactgtaactacaccatccatctttttcaggacatcggtatttgcttttttctcatctctgagtttaaaacgtaaccgtgtaatacagttaatcactgaaatgacattttctttgccacctacatttgctacaatgtcttttgcaagagcttcatatttgcccattacaaacctccaaaataatatattttttagaggtttcgccaacttaatgtcacgatccaattgttaccatagttggtgatgactaaagtcatcttaaaaattaatcttgtattttttctaaaatacgtgcgagatgaacggtcatatatatttgttcattttgagaaacttcgtatgaccttgtttgtttaagaaactcactgactttctttgttcctatatatgctcttggatattttcccgttattagaaggaataaatcttcatcggtgctttcatcactttttgtattagaaagtattctttcggtgaaaaatttaaggtgagtaatgaacctttgaaaataaatatcttgctcattaaagtttacttgtaaagtatactttagagttgttaatatttcttccattaattttgttaattccgttgcatattcatgaccacttcccagggttccattaacaatatgcatagctagaaaacctgcttcatcttctggaagggagatgttaagcttttctttgactttttgtaaagtttcaagacaaagtgcaaattcttctggaaaaaatctcttaatatcccacaaaagaaaattttttatcgctatattgtctttttcacgaataattgctgcattcaaatggtcagcaaaggcaaccaaaacggtatcggaaattgttttatcgaattttgtttttgctttttctaaggttaatatcgaaagttctacgattccacttggaatttccgacaataattctgaaaaattttgttgctctgaagttaccttcaatgcgaaaatcttttcaatttttttatcttcaacaacttcacctgcttttttaccatatcctagtcctaatcccataagaatagtctcttcatcattagtattttgagcaatgacaacattgttgtttaaaacttttttgattttcacatttttctccatttcacaaaaatagaccttatctccctataattataggtctgataaggtctagcttaacttaataatcactatccaatttttgtaaccgttttatttaataaaataaaaccatttgtaaagtggactgtcaaggatatctgattttattaatttttcaattcttttaaaaattgattgcgttctcaataaatttaataacatcactttctttgttttcgtgtaaatccctaactatttttgaaccaacgattactcctgctgataccttattaaaacgttcaacatctgttaaagttgaaatcccaaatcctgtcaaaacaggaatatcagttaatttagacaatgtttctaaatgatggtcaagttgattactataagcattttcttttccggttactccattgatcgcaacggcataaatgaatccttcggcatctactacaagttctttctgacgagaaattggtgtggttaatgacaccaaaggtactaagcaaatatccttatcagtaataaaaggcttaatgtaagcttcatgttctttaggtaaatcaggaataattagaccttttactgctgtattctcaagagctgcaacaaaattttcaattccaaactgatagacaggattaaaataagtcataatgacaagaggaacttctgtttcaattgattttaagctgtcaagaatctttgatagtgaaacatttttggctaaggctcgtaagccagcttgttcaattactggtccgtcagcaacggggtctgagaagggtacaccaatttcaatggcagaactcccggcttgttcaagaagttgaatggtttcattgagcccttctaatcctctttcatggtcacctgccataatataaggaacaaaattattttttttattgctcaattttgcttgtaaagttttcattatttcacctctttttctgcttcaagacgttctttaacttgaacaacatctttatcgccgcgacctgataagcaaacaatcattgttttttctgaacctaattctttagctaatttgaccgcataggcaatcgcgtgagagctttcaagggccggtatgattccttctgtgcgagataagattttgaaaccttcaagggcttcttcatcagtaatatcaacatactttgcacggccgaccgcattgaaataggaatgttcaggtccaattcctggatagtctaaaccagcagaaatactgaaagcttctagtatttgtccattttcatcttgaagaacatccataagcgtgccgtgtaaaacccctggacgccctttagtaattgttgctgcatggtgtggagtatctatcccaagcccagctgcttcaacaccatacatctctactgattcgtcattaacgaatgggtagaaaagtcccatcgagtttgaaccgcccccaacacaagccactaaagcatctggtagtttattttctttttctaagaattgtgcacgtgcttcttgaccaatgacggcttgataatcacgaacaatttgtgggaatgggtgaggtccgagaactgaacccatcacataatgtgtatcctcaacttgagcaacccatgctctaagtgctgcatttaccgcatctttaagcacgcgcgaaccatcagtaactgaatggacttttgcaccgagcaattccatccgaaaaacattaagagattgtcttttgacatcttcttcacccatatatatggtacattccatgccaaagagggcagccgctgttgccgttgcgactccatgttggcccgctcctgtctcagcaatgactttgttttttcccatttttttggcaaggaggacttggccaagggcgttatttattttgtgagctccggtgtgattaaggtcttcgcgtttgagataaatttttgcaccaccagcatattcggtcaggcgtttagcaaaataaagtgggttttctcgtccaacgtaatctttaagcaattcttttagttcagcttgaaaaactggatcttttttactgtcttcataagctacttctaattcttttacggctgtcattaaagtttcagggacaaattgtccaccaaattgtccataaaatccttggttattgggttgattgtaggtcatgtatttctcctttttgtaaatgttatattttaattgttttatttttactgttcttctcgtaaaattccatattttactgaatcatgccattcttcttgtcaaaagcggacttttctgattcgtccttcaagttgtaaaccacacttttctcctaatttcatcatgcctggatttcctgaccaagtggtaaagccaagatgttgaatttctggatagtttttaaaaagttcttccatccataaagggataactttctgaccaattccttgtccccacattttagagtcataaattacaatgccaaactcaagccatttttgtaattttccatctacccaggagctagacaggcttccaatgattcgatttttgaaactgataagtgcaacattggtttgattaatctttgaagtcgtcttttctgaaaattcctcccagcttaaaactgaatcttgaaaataggggccattgaaggccatccactctaaatcagcttgaggtccatagctgacttcccaaagttctaataaatcccctttttgaatggtcctcagaatcaaatctgttccagattttcggtagtattcaaaagaattcttttgtctgtcatctttcattattgttccttttttgataatcaatcagtttgtttaggataacttggtctttgagttttccggctcgccatgaatcttttattgctgtttgatagattttaattgattgttcaagatttggaaaccagtatctttccttagttacttgcttattttgttgaagttcatgataatcaatattcgcataactatcgattgtttcaacatttgcaaagccaacatgaaatcttcctttttcaaatttatgttcgtgtaggtcaatgagttgatagcctaagtcttccattatctcggttaatttagcaaaattttcatagtcatctttctctagctgaatatcgatatcgtctggatttgtaaaaaaatttccaagttgttcaattgctaagctccccattaaataaggactaatcttaaacttatttaattttccagtgattcgtaaaaattccgcaaataattgttgtgatgaagcaagactcgccttttgaataaaactttttattttaactacatcttttttcccagcagtctccactcctgaggatacgtctaccccaaaagcattaggaaagtgttgaatcgctcttcctacgttctctggactgagtccaccagcaataaagtaatcagcaccaagatgctcagggtttatggaatcccaatcaaaagtttgaccacttcctccttgtgggctatcaaataataatatgacctctttgtagagcagaaaatcttggtcaggacgtacagctttaatgacaggaaatgacagctgattgatataattcatatcctcgtcgccgtgaagttggacaatgtccaactgggcaatctgtatggcttttttgacaaaatcaagggattcattaacaaagattcctatttttttgactgttatggggatttcctttgtcagctctgctactttttctggagaaacttgacgccttgagggactaagaataaaaccaagatgtgttgcgccagatgctactgccgtatcgacagcctcttttgttgataagccacaaattttaatgttcatcatttttccttttgatttttaaatctgtcagtgattttgtgagattatttgcttgcatcagtgctgttccaaccaaaattccattgaaattttcagcaactttttgtgcctcttttttaccgaaaatacctgattcagaaatataaacattctcttctttaaaataaggaaccaaatctgttgagttttgtaagctcacttcgaaggtctttagattacgattattgaccccaataattttagcagcaagttgatgggctctgtcgagttcggccttattatgcgtttcgactaaaacttcaagtcctagtgaaattgcataattgtagagttcttctaatttttcaaagtcattttcaaaacaagcgacaatcaataaaataacagttgcaccagcattgagtgctcgattaatttgctttttatcaatgataaaatctttgttaagtgttggaatttgaacatttttagatatttcacggaggtattcaatgtttcctttaaagaatacagggtcagttagaacggaaatcatggcagccccagcttgttcataatttttggcttgggcgataatgtctacttcgagattgatatctccaagacttggcgaagctttttttacttcggcaatgacttgaagttgatcagaatgtttttttaggtaatcatataatctataagtttgacgaattggtttggaattttcgtcaggcatttgagctatctcttgttttttttctgctaaaattttttctaagaattttccttcttttatgttcatattttcttactcttttccagtgtgacagactgcttcaattcgataaccgtctgggtcaatgatgaatgccgcatagtaatatttttgatcagagggacgattgcccggtcttccattatctttcccaccattttctaaggcgattttgtaaaactggtcaacttcggctttggtcttggcttggaaagcaaaatgaaaagggtaaggctcgccttcttcaaaccagatatagccgtcagtagtttctcctgtttgataagtcagactcgttttactttcgtcaattaaagaaccgccaagcgttgctaaaactgctgtataaaaaaattttgttcgtgataaatattggacatgaatatctaaatggtcaatcatttttttctccatattttccaatgatgaacttgaaattatttcgatttttctttttaaatgcgaagtgtggatttgcgctgtctataaccaaaacctttttacctagccaaattcgtaaataatgagattttactttgagagatttactgacagaacggtcagcaaatttgaaacgttcttcagttccgtcagtaaattcaatttcgatgcttctgccaaaaccaaattggttattgtctaaatcaaaaccaatttcaatgaatatttttctgtcattttcgtgtgcctctccattgtgttaagctgcttcaatctgataatcattagggtcaataataaatgatacgtaatccccctcttgatagctttcttggtagactcgtacatctttattttttcccattttccataaagcaaggcaataaaattcatcaatttaggcatttctttctcaatagctacacagtgttcccgcacaattaaatttcaattttttcattacttattctttccaaactatctgctctgcccatttggctctaccggtaacttttatttcaggataatccttaaccaatcttttcaaaaaccacttccatatccttccttcaaatgagggctgtaacgcaaaatacaattctttccccctcttgagttaatttatgtgcacttattgggtccttaggcaaaagctttttacctttttcatagacaggatcaaatctaaaaagatcctcttcctcgtaatattttttatcagaaaactcagactgttttaatcctttttcaaattttgggcgtctaaagtaagcatattgaaccatatccaaatcaaaaagtctaaatatacctatatcagacaaatgttcgaaattttcttgaaagttttcacttgcagtattccaattaaatcggcttatatcaggataatattcatcatcttgaccaaataaactaaccacttgtggaaaaatatatttttcgtctccctgccgttgtcatcataaaataaaatttcagaaaaatagttatctaagataatcgcttcagtagatgtcagtttatgtaataaatccaatgttcgtaacgaaacactactgttttctaaacactcttgaactaacaattttgcccaaaactcctgaatagaatcatcatcttcttgtgacgccaaggtataccaattaattttaaacttagtactgatgttatctaaatcagccgaagatactccaaaagttttcattctttcactagcttttgaaagtatctttactaaattttccattcttttagtactaaaatagtcagaaatcatcttcgtcaaatcatttttaaaaataggttgtatttgatctattaatttattaacgtcaactatcaccttgagtggtaagtttggtgtattcatttttctctacttttcctcataacaattctaattgctcgtcaaatttgccccctcaaaagcgagcaattcccgcttgacttcaacaccatctgcatgtctcgtcagcatattcaatttcaatacttcttctaaatccaaatatattattatccaaatcaaatccaatttcaataaatattttttatgtcagtaaatttttaaccaatttgttctgcttgtaattcatgcaatttttcaagtgctgcgccttgcgctatgacttctcttgcaagttcaattcctgatttgatggaatcaaccttgccattggcatagaatcccaatcctgcatttaaaacagttgtttctaaaaatgctgacgaacaattttccagaacatttttcaaaatctcggcattttctggcgcttcaccaccgcgaatatcattgagcgcgacttctgacatgccaacatcggcagctctaaacttgtgcaaagtcacttcgccattttccaaaagggcataatgatttagaccaaatggtgttgcctcatccatccctccttcgcctgtaataaccaatgctcgcttacgtcccaagcctttgaggacatttgccgtcagctcgagcaggtcaggacgtgacgttccaaggagttgcgtatcaagtggaatcggattaatcaaagggcctgtcaggttcatgatggttggaatttcaagctgtctgcgcactggtgtgaagtatttcatggctggatgcaaattttgagcaaaaaggaaaactagaccaactttatcaaacacttgagccaatttttctgcggggagataaaggttgattcccaaagcttcaagaacatcagccgagccagatttactggtaattgagcggttgccgtgttttgccatgttgacgccaccagctgctaaaacaaaggccgatgtggttgaaatattgaagctgaatgaacggtcgccgcctgttccgcaattgtccatggcattggtcaagtttgtcggaatactgatggctgctttttgcaaagcccgtgcaagtcctgttaattcgctggcggattcgcctttcattttgagagctactagaaaactagcaatttgaacgtcgctcaattcgccttgaataattgaattggctagcatattcatttcattttcagtcatatcacgacctgccatgactttttcaagttcatttttcatttgattacttctttattgcttttacttgattgacaaaattttcaatcatgatcatgccatccagcgtcccaattgattctggatgaaattgcagaccgtaaatctgttctttttcattttcaatggccataatctcgccatcatccatcgcaagcgctgtaattgcaaagtcaggtaaagcaacggcttcgtccatgacaatcgaatgataacgcatgacccaaaattttgaaggaagttgcttgaaaattgaatttcccgaagtttgacgaacttgcgaattttttccatgcatgacctgatgtgccaagcggagtttgccaccaaaaacctcaacaatagcttgaaaacccaaacaaatgcctaaaattggtttttgtcccgcgaattcttgaatcatggcttccattttgcccgcatctgctggccaaccaggacctggcgagaaaatgagtgcgtcagcattttgcgccattttttctaaattttcatcatcatttctcacgaccgcaacgtcagtcagagcgccaacatattgcaccaaattgtaggtaaaactgtcgtaattatcaattattaaaatcattttttctcctgttagttgagttcagtgtgctcgcacacttcacatccttttttactgaccaacttttagcagtccttgtgccttgttcaatgtttcttgatattcatgctcaggcactgaatcataaacaattcctgcacctgcttgaacgtgtgccttattatcttttaagaccatggtccgaatggcaatggcaaaatcacaatttccatttttggtcagataaccaatggctccgccataaatcccgcgtttttgattttcaaactcataaatgcgttgataagcacgatgtttcggcgctcctgatagggtgccagctggtaaagtcgctgacagggcgtccatggccgtaaattcgggacgaagctttccagtaacttcactggtaatgtgcatgacgtagcgatatttttcaactttcatgaaaacagggacttcaattgagccatattcggaaatttttccaatgtcatttcgtcccaaatcaaccaacattttgtgctcagcaagttctttttggtcattttccaattcttcaatcagcgcttggtcttcaaattcattgtcgccacgttttcttgttccagcaattggattagtcgaaacttgattgccatgaaccgcaaccaaacgttctggtgagctgccaatgacatgaaaattgtcgaattccataaagtacatatatgatgccggattttcaacacgaagttttcgataataatcaaagggcttgtcagtaaaatcggctgtcaacctttgtgataaaacgatttgaaacatatcaccatttctaatcaattcctttgcggctgttactttttcctcaaaagttgcttgagtcatattgctgacaaaattcattttatttatttctgtcaactcattttctgcttctgtcagttccgataaagcttcaatatttgctgacagagcagttactaactctttttctgaacgctgactataaacattatcctcaataaatatcaatttttcttgtttatggtcaaaaatcacggctgattcgtataacataaaatacatatctggggtcccaattgtatctgtcagttcaggctgaatcccttcaaaaattccataagtatcaaatccagcataaccaattgcaccgctcgtaaagggcaaatccaatttttcgtccgtattttctgactgacagaccaatttttctagaaattccattggatggtcgttgctaatgatttcatcattaatggttaaatttccatcagtaaatttaatatgttttactggatttaaggcaataattgaaaaacgtgattggtcattttctctaggaatggattctaaaattactttatttttacctttcaggcgaagatacaccgaaattggcgtcaaagtatctgctgaaatttctttaatttttctcatgttttctctctatcttttgttttgcggaattaacttccattgattatgaaataaaatttaagcttagccatcgttgattcattttagaaatcctttcaaaaaaatacaaaaaagcccgtagagtatcaaatactctacgggcgtattccacgcggtgccaccgtaatttaagagtccttaaaagtattacaaaaatactagaaaattctcttcttttcctcgtctaacaacaagtcgcttggtatcgggagcatccgtgatttttattgtttcaaatcaaattgcgaaaaataagacttttcgactttaaatcagcccattcgctctgatgaatttatctgctcgcacaaccgcagacttcctgaaaaaattctatgatagagttactcttctgatattgaaaacaattgtaaaactttttatgacacttgtcaagccttttgaaatatttttttagaaaaaagaagaaattagtgcaagaatcgctaagccaccttgcgtaagaataatctttttattacttgtcaaagaaccatagatggccactaaaataatataaataagcagtaatctgacaatttcgagtgaagctgaggcaaaaaacaaaccataaaatagtccgatagcaatcaacccattgtacactccttggtttttaaagagcgtttgaacagattttctttctaattctttcttctccatattaaaaactcgccctgtagtctttgagcttgtggccacggtctctaaatacataatataaagaaactctaaggcaactaaaagtgtcaaaatcattgtcaaaattgtcaaattttttctccttattatttaaaagtcgtaattttatcagcgctcatccgaacagattcatagccttcttccaccgctttaccaattgataaaatcatcactggaacataacgctctttatccaaatcgaatgcttcagccaattgatctttctcaaaaccaccaattgggtttgtttcatagccatgtgctctagcaactaacatcaattgcatggctgccaaactagcatcaattttaacggcatcattcatttcttgtttagaaaagctcttgtaataaggaataattgctccaatttgttgatctcttacttcttgtggcattttcccttcagcgacagcttggtcataaatttcttcacctaattcataattgagcatatcaccaaaaatcaaaatcatcgctgacgaactttcattttgacgtgtattaaaacgaatcaaaggtttcaattttgcttttgattcttcagtttcagcaacgataaaacgccaaggttgcatatttactgacgaaggggccgcagttgcttcttgaatcatttctaacatttcttcatgagaaatcttataattttcatcataaagtctaactgattttcgaccaaaggtaatttctgtgaaatcattatttttaaagtttttattcattttttcctctttcattttactaattttgttaatagttctaaaagttcttcttcttccgaatcacttaatccaatatttaaagtttgttcactttcatgaacagaattatcatgttctctagcacaacgctccaaatcagccttggcctcgtcagtaatttcaacaaacacttcacgattattgtctttatttcgctgacgtttaacaagatttttttcttcaagcagtttcaaatgtcttgtaaccgcagcactatcaatcttcaattcattttgcagttgggtctgtgaacatctccctttgcattttaaaatcatcatcagttgatatcgtgtaatactaaaaccagttgatttttcaaattttgctgtcatttcttgatttacaattttgagttggtaaagtaactggctgactttttcaagattcattctttctcctttcattgttgattagtcaatcattgattagtcaattataatactaaaataattaaattacaaataaaagaatttgccaacaaaaaaactaggttttaacctagcatttttcccagtaaagcaactcaaatataactaatctttccatatcacgattctcgttttctttaaaaaataactgctttaatgcctctaattcatcatttgaaatttcatctgagaaataatcagaaaaaaattgtgaactaatactttctgataaaaagaatcgaaatgttttgcttttatattcccaatttaattcttccaaccaggctttatagagcaacatttgagcttctttatgttgttcttgagctggaaaatataattgttcaacctgactgaaaagattatcttcgtcaaagattagacgtagaatgcctacatttctctgactaatccgatttaattcaatcaatgcttctttcgagtctaaagctggattcatggcagtaaatacaaagtcataagcatctttctcactttgctctaaaaattcagcctgctcttgatgaataaaagcaattttacttgcatcggcttttttattttgagcaaaatctaacattttagctgataaatcaacgatattgtacttgtcagtaaaatcggaaaaatgcggaatatatttccccgtccctcctgccaaatctaaaaaatctcgcgcaggtagtagtttttcagccaatagaaattcacgcaattcttgaccaatattgactagactttcattttgtatttcttcgtattcttgcgaaaactcatcccaatacttttctaattccttagtactttcatccatatttcagcctctttttcaataattataagtcctatctataattataacagatgcttttagttaagcctaggacctttaacccaaaatacgaccaataaaataatgaataaaaattgtcatcagcccaataataatatttctgaaaatcgctttaatcaccaagccatcagaaagtttagcactaatcatgccagttaaagccatcgcaaccattgttgctaagatcgtcgctggaaattgccaaacccctttcactaaaatcattgtcagtaatggaaaaagtcccccaatggtgaacgaaattaatgatgaccaagccgcttgccaagggttcatataatgtcccaaagtaatatcatattttactgacagaaccgtttctaatggttttagagcaagcaattcatcagcaatcttcattgaagtttcagaactaatccccttttcaatataaaaatctttaatcgcttctttttgatttttaaaatctttatttagtaatatcttttcttgttggacaactactttctcgctatcagactgtgaactgacactagcgtattcgccagatgccattgaaaaagcaccagaaattagattagctaaacttgcaatcagtaaatcaaaactactccctgacgctgctgatacggaaaaaagtacaccaaccaccgttaagattccatcattagaccctaaaactcctgcacgaacactatttaatttttcatctattgtcatcgtttgttttttcatcacaatcctccttgtttaaaaatcaaaccaaccaaatatgtaactaccattgtcaaaattccggctacgatatttctaaaagttgcatgttttttatcggctccgttcaaataagctgcagcataaccagtaaagcctaaagcaattaatacggcaaaaaaagtcgccatggcactccaacttttaggtatcagagaaattgcaagcatgggtaaaagtgcccccgtcggaaatgaaatcattgacgcaatcgctgcacctttggcacttaattcttgcccaattgtaaatccatgacgttctctgaccgttgtcgctagtgcatcttttttcatcatttcatccgttgccgtatgcgcaagttcttttgaaattccgactgaagaatatttctcataaacaaaatcaaattccttttgataatcattagcaagtgctattttttgttcctgaacaattttttcttgagcatctctttgcgaactgacagacacatactcacccattgccatacttaccgtaccggctaaagttccagcaaaacctgccagtaagattgtgccaatatgtgaagttgctccggatacaccaattacaatgccagcaatggagatgataccatcgtttgcccccataatactggccctaacaatattatttctttgaattaagttatttttttctttcattattccatctctttagaatcattctaaactatattttagaatcattctacacaaatgtcaagttattgaaatgattttctgttgatgatataataaaataaaataataaagataggagtgctgattttggaacaagacttaaaagaactattacaatctcatggtttaaaagctacaccacagcgtctcattgtcttagaatacctgataaaacatcaaactcacccaacggctgagcagattcacgaagacttagaaaatattagcttggccacggtttataatacacttgataaattagtcgatagtgaacttgttattgctatcaatgatggaagtaagaggaggtatgattactacggtgaacctcattatcacgttgtcaataaaaccactggtgagataatgaatgttgataattttgattttcgacctctcatcgaagcggcaagaaaagcaagtggtctcaatattactggctacaaagtagaaatttatggtgttgaagattaattaaaaaaatactgatcaagatgattagtatttttttattcttttataccatttccagtgaatattttactctcgcatgtaatttatatagtttatagtaaggggtgaaaaatggattacacagaatttagaaaatatgttgaagaaaacactcgtgcccaaggtaagtttttggaaaaagctacaatatatttattagacaaaaacgtcagcagacaatcatctgcaaaatggcctgattctcgcattgaaaaagaagctaacaagatgtgggatatgaatataagcggtgcttttatcagcgtatccgaaggaattaaaaatgcagaaaacaagcctcgctttcataatcatgaagagcaagtgtcttactggataaacttcatgaacgagtacgagtttttagaaaatttcactgatggtattgatgatatggaatttgaataaataaaactttaatactatcgctttctccttaatcatgtcttgcccgacaatagaacaggagaaaaaatgaatattaaagaagttcaaaaaaaagacggtacaaccgtctataaagtaaatgtctatcttggtgtagatagcctaacaggtaagcaagtacgcaccacggttacagccaagaaccgtaaaacgtgcgagaataaagctcaccaagctatgaataagtttatcaaaaatggctctactgttgcaagagaaaaagtttcatttgacaattttaatgccttagccactagttggtttgattcttataaattgacagtaaaagcaaacactatcagaatcaatagtaattttttaaaaaattatattttgccagcactcggaaactataaagttgagaaaattacaactgtactattgcaaaatattgttaatgactgggctagaaatgccaatactgctgaaatagttaacggtaatcgtgaaaagggaaaaagtaaagattataaattgttactcaatatcatcaaacgcattcttgattatggtatgcaattaggtgttatctcagacaatccagctataaaagtattttctccaaaactcaagacaagaacagtcaaaaaaataaagtattttaacaatgatgaactcaaacgcttcttggattaccttgactcgttacaatcaaccacagcaaatataaaaagcactactctatacaagcttttactttctactggtttgcgtatctgtgaggctttagccttatcatggtctgatattgattttgtcaataataccgttagtgtatctaagacactcatacaatatagcaatgagatacaagacagtgcaaaaacaaaagaaagcaatcgtttagtttctgtagatagcgagacaatttcaatgttgaaagagtggagaaaacaccaaaattacggtgctatatctttgcatgattctctagttttctcatatcatcaaaaaatgagaacttacgaactcgaaagacagcacttagttcgacactttaaaaaagcaaaagttcctaacataggttttcatggtttccgtcacactcacgcaagcctactaatgaacaatgatgtaaatcctaaagaaattcaaatgagattaggacatgcagactattcgttcacaatgaatttgtacagtcatcttgctaaagagaaaaagaaagaaactgctgaaaagttcgctaatatacttaaagcactatgatttttctagttttttcccgaacgtaactaaaaacgtaactaactaatataatgacaactgaaatccctttatataagggattctagggatttgttgtgatacagagctattatacccttagtagtcaatagctgtcaatgacttttcttagatgattgctctataactaataaaaactaagctacttattctctttcttgtattatatagcttacttttactctctttatttgaactaaaattatttcaaagataaataaaaaaactggcattatgccagtttttttattgattttatttcacacgggagtcatcacccatatcatcaactttttctttaactttgtctacctgatcagatgtaaatttccctgttgtttgagctgcgccaaccacacgatcttgtaaacttttttcatcatctttttgttgttcttttgtcttaatatctacgaccgttacattgacttcaacaacttccaaatcagtcatatccgaaacttctttacggataacttctttgattttttggtagatatctggaacattctttttatattctgttactaccttaaggtccacggcaacttgctttttgccgacttcaacgccaacaccagcagtgacatcctctgtatttacaagttttcctgtgagatttgagaaaaatcctccatcaacagcaagtaatccattgacagattcaagggcaagtccgacaattttttggatgactttgtcttcatatgctaagttgcctttaacttcagttgtttccgtttttgtgttttcttgtaccataatttcctcctattttttcttctttatttgttcaatgattcccgtgcgttgaagatagagacctacaaaaatccctaacccaataagcaagaagagaagaatcattttccaaaatccgattgtgaagatacaaactgcaataatacagcctattattccgccaataatcgggtatcgatatctttcgaaaagatccatttctacctccttagactacgcgtggacttgtcgagtctttcttttcaacaattgagctgactttgatttttaatttcacctcatgattcaaaccaaagaaattttttaaactttctttgatttcttgctcaatcgcttttgttttttcaacaatctcaactctgggaataatttctccttgtacatcaatttttattgtggactgatataaagtcacatttattttagggtttctaatatagccattatcaagcacgagctctctaactaatccttcgattgctgaacgttttagagtcaaacttcctgctttatcatctaataaaatctccatataggttttgggataaaagatgacaatcagtaaggcaaataataagagtattcctaaaattgaagcgctgataaatatatattggggaagtttttcaccaatgtaaggaatttctgatgagggactaagctcccaacgaaaattcatttgattaaaataatcccataaaattggtatgagaatggtgaggaaaaataaatcagccagaataaaaataaatttttttccttttgacacgatacctcctctctgttattgtttcttctagttgtttgccttacctaaaaagaatgaaacaacagctacaacgatgacagcacctataatagagggaattagagccattccggccaactttggtccccatgttcctaggagtccttgacctactgcagccccaacaagtccagctaaaatattagcaatccatcccattgatttgcctttattggtaatagctcctgcaattacaccaataatggctccgacaattaacgaccaaatcataaagcacctctttctagtacagttcctgtacatttttactataacaaactttgaggcatttataaaataatccgctttctttttattacatttaaccttttttacgatattttagtaaacaaaaaattccatcattagaaatgatagaacttttttagagataaattgtacctcaggtctcatacttttagtttctgtggataaatatttctatttgaaatatcttattttttatctaatccccaagtttatccccaacttgcattttttgacctaaaccattaagaaaactaacaatgtccattttaggtttgcctgccggttggaccgttaaaagctcaagaattccattgccagtagcaacttttaatgatttttttgttttttccacaatttgaccggcctgtaagggattatcagaattgttaacaatttcgtcagctactttgctttcataaatcttaaagcgttccccattccacagggtatgggcgactggaaaaggattcatgccacgaactttattgaaaatttcacgtgcggatttgttccaatcgattttttcttcttctggtgaaatatttggactaaaagtcacttcatcttcattttgagcttgagctttgagttgaccctccagatacttgggtaatgtttcaaggagtaaatcacgtcccacaaaagccaatttttcaaacatagtgccgacattgtcttcttcaagaattggagtagaattttgagcaatcatgtcaccggcatccattttacgaatcatttccatgattgtcacaccagcttctttttcgccattcataatggcataatgaatcggcgctccaccgcgatatttcggtagtaaggaagcgtgtgtatttaccgcaaaacgagcgacatctaataatttccctggcaaaaattgtccaaatgcggcagtcacaattccaacttctcctgattcaaggagcgtcataatttgagtcatttctactgagccagatagcttttctggttgaagaacaggcaagttaaccgttaaagcaagttctttaactggcgtcattcttaattcctgttttcgaccaactttacggtctggttgggtcacaactgctaggatttcatattgattagagtcaatcaaacctttcaaaacggtcgcagcaaattgtggcgtccccataaagataatttttgtttttgtcataagttttcaaactcctcgataataattttcttttgtttcattaatacttgaacggccttgtcaccttttgccattaattgacccagattttctggaatgatttgccaagaaaggtcaaatttgtctttgcaccaaccacactgttcggcttctttaacatgagaaagttttgaccaataatcatcaatttcggcttgatttttacaagtcacagtgaaactgactgcttcattaaatttaaaaattggcccaccgtcaagacagataaactcaagtccattcagactaaattcaccatttaatacttttccagacattcctacgaaatgctcatctagcttttcatcaggataatattcgatgtttttgatttttgaatttggaaatacagatacataatagttcattgcttcttcggcattattgttaaaccaaaggcttgggataatttttgcttccataattgaccttccaatctctgtaaatttcggctttatccacatggggatagttattgacttcagcaattacttttaggacaagtggagatgaattttctgctgacaattctgtcactaatttccaaactgctctgtcagaatcattttttccatcagcaacaaattgtggtagttttttggatacatgatttaattttacatcaaaaaggttaaaaatgtggtgactaacgactcgacggtcattttcataaatccaagccgaaaagaggcgactcttagcacttgaaaggacagtaaatccagtttcttcaagaatttctcgctctaatgtgtcaaccattgattcaccaacttcttgcgaacctccgggcaaatcataacgattttggtagggacctgaatttttttcaatgacaagtaatttatcattgtcaattgccactccgtatactccaaaatgtttcaataaatcaaatttctcaaccatattttacctcattttacttcaaaaatggacgaaatttttcatgtttttgttcaaattcttgaatttgacaaattttatttccagaaaatttaacaagagaaattccatcaaaaatattttcttcccctttatagacataatggaaagtccatgtgaaaaaacaagtttcattatctacataagacttatccacagaccatgatttcacttgattttccacaggattattccactgacagaaccacttttcaatttctgcttttccttgatattgagcgccgtaacattctgtgtaaataatatctgctgacagaacacttaataacttattgatatctttggtcagccaagcgtcaattgtttgttgaaaaagttcacttttggtcattttctttgcaccaacctttcacatattcgactttttcacagtgattgaatgctctaaaaacttctacacatgtggaaaaagcctccttgcgtgacttgttaaaaacttcgttttcttctagctaaaagtttttaacaagcaaaactttttctttagtatgtcgctcaatttccagacggccaacaaaacgattcttgtaaaggactggaagaacatatgccccatattttcttttttcctttggagtgtaaatttcccatttgtagtcaaaatcaaagatttctcgaatcaaatttcggtcccaaagcaaattgtcaagcggagcaaggaattccattcgtactggcgcttttggatttactgacagactgtcagagcgatcagggacaaggtgcgaacttgtcagcaacttttcatcttcttttttcatataaaaaattgttgaaattccttcaatttgaatttctgtaatttttttatcttctaaaagactttgaaaagcttgatttctctcaaaagttttgaaatgctcaatccccaaccaagcatcacttcgcttgttccataaaaatccaatcgtgccaattcgtctcagaacgagttgctgatgataatcaagttcactttcaaaaggacttttcgcgctcaaaagttttgctgacaaaaatttttctgccaaggcataagctttttgccgtccatttttatgatgaataatcagctcacctttaaaatacatggtttcaagcgcggctcttgccacagatgaagaggcaccccaatcccaaatcaaatttccactttccaaatgacgcaaatctttggcaaaaatatattctttttcagagagtatttttctgatttcaatcatcatttgtagaacaggttcactttgtctacgcgccattgcttctgcatagctgattcccgcatatttttgagtaaaaactgtcaaatcttctattggcaaaatacaaagatttttgtcaaaaaaatcaatcaaaagacggtcttgataaagtaattcatcaagcatttctttagtgaaatactcaattcgcgcctgcaaagtcagttctggactagttccacaaacatccaccggatcaaactgtaccgaacctgcctgcctgacaaaatccataatcccttcttttcctgaaaaatgtttatgaccaagcaaaccctgcttagtcaataaaaaatttctggcttcttctttggttaatctaatcatttttaacctcatcaactctgattttatacaaaattttgtggttcgctatcaatcaagattcgtaaatttttattgtcacgaagttgggttaattcaagcacttgattcaaagcggactctaattcttcttcaaaacgatatttaactaaaatttgataatgataaagattatgtgttctggcaattggtctggcagttggtcccaaaattttggctttttctgtcagattttgctttaaaatttgagaaatttcataagatttttgaatggcaacttcttcatcttgatgagaaacaagcacttgaaccgtgaaataataaggtggataggaaagttcacgacgaaatctcatttccatttcataaaatttttcataatcttgagctttggtcatttcaatggcataatgatgtggattaaaggtttgaatcaaaacttcaccttttttatccgcacgtccagctcgcccagccacctgcatcagcaattcaaacgagcgttcactggcccgaaaatcaggtaaatttagaccggtatctgcattaatgacaccaactaaagtcacgtttggaaaatctaaacctttggcaatcatctgagttcctaaaaggatatcagcttcatgattaccaaatttttcaagaattttttcgtgagcatttttcgttcgagttgtatctacatccattcgcaaaactcgtgcttcaggcatgatttctcgaagttcttcttcgactttttgcgttccagaaccataataacgaatttttcgtgattgacagttggggcaagtttggggaatgccctgaacgtgaccacaataatgacaattcagagttctggtgtccatgtgaagggtcaaggaaatatcgcaattgggacaatcaacaacgaaaccacattctcgacacatgacaaatgaagaataacctcgacgatttagcatcaaaatgacttgttcgtctttgtcaattttttctttaatttttgccagtaatgattgtgagaaatttgctgactggtcagaaatttcactgcgcatatcaatgattttaatttctggcaagattgctgcttcatttgcccgctttgtcagcaataatagctcataaacgccacgcatggcacgcgcccgtgattctaaacttggcgttgctgaacccagaacaagggtggctccatgccattttgctcgcaaaagtgcaatatctctggcatgataacgcggactagaatcttgcttataggaagtttcgtgctcctcatcaatgatgataatacctaaattttcgactggcgcgaaaatagcagaacgagcaccgacaacgacttgagctttgccagacttaattttacgccattcatcatatttttcaccgtcagacaaacctgagtgcatgatggccactttgtcaccaaaacgagcaataaatcgattggtaatctgcggcgtcagtgaaatttccggcacaagcatgatggccgtttttcccatttgtagaaaatggtcaatggtctgtaagtaaacttctgttttacctgagccagtgataccttccaacaaaaatggtttgtcagaagaagcaattattttttcataagctgattcttgttcagaattcagcactttggcgctatcattttcaatcgcttcaaatttatcttttgtccgagaaatttcaacttcctcaatttttaccaaatcatgctcaataaaaaatttgataatttgtgatgaaaaatttaaagattttagagcaattttttcatcggtcattcgtaagagaaaatattttagctccaagcgttttttcgctcgtttttcaatttcaaattcatccaatttttccaaatccggaatagataaatatttttcggtcttccgattttctttggatttagctaaatattctactgacagctgtccagcacgcaccgcttttgctgacgaaattttttcttcttctgtcagctgagaccatttgctgacagctccgtcagcagatttcaagagtttgtcataattagaattcaaaagattaggcagcatcgctttcaaacaagaaattttatatgaaaaaaccgagtggcgcatttcatcagctaaccatagttgttcttcggtcaacaccggttcaaggtccagtaactcagcaatatctttcaaatttactgacgaattttctgcatccttttcttcttcaatcccaacaataattccttgaaccaaacgatttcctgtcccaaaaggaacatgaacccgcattcccagttcaatcaaactttgaaattcttttgaaatggcataagaaaaaggcttatcagtctgcatcagaggcaggtcaacgattactttagcaattttcattcagttttgacctccgtaattcttcttttaattataacacagttcactatttgatatttgccaattacgattagacaatggaataaactttgattctgtcagatgtcctatatccgctaatattaataaaaatcagtaaaacaaaataaaaaaagcgccaattgacgcctaaaaaattattctgcagcagctgctttagccgcacgactatttttttgttttgcttcttcttcagcttcttcttttgcaatttgttctttgataagttgttccttcattttcgcttgcaaacgttccaactcacgtttttcaaccaaagtttcgcgcttcaattcaggtgctgggtgaattttaactgttccatcagcaatttcttccaaagcttgcaaagtcctttttacggatttaaattcttttgttggacgttctttatcacgcaattcatgagcgcgttttgcttccaaaacaactaaagagtattttgagtccacttgatccaataatttgtcaattgaaggttctaacatcataatccattacctcattttctaaacttttcattttaatatttctgacttggctgtcagtattttttatattaagcttttacatcatcaatcatatgaacataacgttcaatcacgcggtccactcgataatgttcagcctcaataattttcttgacacgttcagcagcaagttcaactttatcattgacaaccgcataatcatattcactcatcaaacgaatttcttcttttgctttttcaagtcgtgaagcaatgacctcagctgaatctgttccacgtcccaccaaacgtccacgcaattcttccaaatctggtggagtcaagaagacaaaaacaccatctggaactttttctttcacttgtagtgcaccttgcacttcaatttctagaaaaacatcttttccttcatctaatgtctgattgacataagttaaaggtgtgccatagtaatttccaacatattcagcatattcgagcatttgtccattgcgaatcatttcttcaaattcatcacgtgtccggaaataataatcttttccatctacttcaccaggacgttgctttcttgttgtcatcgacactgaatattcaaagttgttatcactttcaaaaattttagcacgaactgttccttttccaacaccagaaggcccagaaaaaacaattaataaaccacgctcacgcattttttcctccgatatatctttaattctctatataaatcaacgattaagttcattctatcaaaactccactctagaaactagcttttgtaacctaaaagatatataacttagtaatccgaaataaaaaaaccgtcctaagacagtttttttattttgcgtagtcaatcgctcgagtttctcggataacggtaactttaatattaccgggataatccatctcatcttcgattcgatttttcacatcacgcgccaaaattacgatttggtcatccgtcaatttatctggtttaaccatcactcgaatttcacgtccagcttgcagagcaaaggctgtttccacaccatcaaagcttgttgaaattgcttcgaggtctttcaaacgtttgatgtaattttcaattgattcacgacgagctccaggacgtgctgctgacaatgcatctgctgctgcaacaagtactgcgatgttacttaatggctctgtatcgccatggtgactagcgattgtgttgattacaattggattttccttgtacttacgtgcaagttctgtaccaatctcaacgtggcttccctcaacctcatggtcaagtgctttaccaatatcatgcaagaatcctgcacgtttggcaagagcctcattttctcccatttcaccagctaaattaccagcaatatgagccacttcaacagaatggtcaagcacattttgaccataagaagtacggaagtgtaaacgtcccataatcttcatcaagtcaggatgcaaattatgcgcgcccacttcaaatgcagcttgttccccatattcacgcatcttgtgatcaagggccttacgatttttctcaaccaactcttcaatgcgagctggatgaattcgaccatcttgaactaattgttcaagtgtcattcgagcaatttcacgacgaattggatcaaatcctgaaagtacaactgcttctggcgtatcatcaatgatgacatcaattccagtcaaagcttcaaaagtacgaatattacgaccttcacgaccgataattcgacccttcatgccatcatctggtaaattgacaactgaaacagtttgttcagctaccgaatcagatgaaacacgttgaatggcaagtgaaataatatttttagctcttttatctgcttctgcttgagctttttcttcactttgacgaattgtttgagccatctcttttgttaaaccatcacgggtttcactcaagataatttcacgagcatcatccatgctcaaatttgaaatacgctccaattccagtcgtttcttttcttcaatatgcgctaattgttcttctcgcttactgagcgtatcagtttttctaacgaggttttcctctttagaatctaagttttcttcttttttcgttaaggtatcatccttacggtctaagatttcttcacgttgttttaggcgcttttcagtctcctttaactcctgacgttcctgcttaaattcatcttcgatttcgcgacgttgcttttgttcttcttcacgaagggtgtaacgggcttcttttttgaaggcttcagcctcccttttcaaagactccgcctcacgtttagcactcgccatcacctcatttgctttattttctgcttcgttaaaaagagattcagcatcttgcttatttttcttaatattttgggcataaaaaataaatgcgacaactaatacaaccaataagaacaagagaacgatagaaataatgtccattagtctcctctaaagtgagtaatcattccaataaattctactcacagtttgattataaattaatgtattttgcatagcaaaacactcattaattatatcattttaagcttcaatattcaatgaaagatagtgtaacgctttcagaatattttaaagtcatttatgtcatgataaatagacttcaaagaaagtaaataaaaacagctacttcaataactgtctttatttattctttaatcttcaagtaaagctgctgctgcctcatctaaaataaatgtaatatttggatgcgttcgcaaaatcgatgcaggaacttcctccgttattggcccttcaagaacttttttcataatctctgctttattttttccatcagcaaagactaaaagttgcttgcttgctagaactgttcgtggcccaaaagtgacataaggagaagccggttctttatctgtcagctctttgattgaccgataaatttcatccccttcttcaaatggaacagcaaaaacttctcgctcaaaacttgtatgtcctggcatatttgcacaaaaatgaccatcttctcctatccccatgacaatcaaatcaatcccaccatcctgcaagattttttgatcaaaaacttgattattttgagaatttaactcatggagattcccatcatcaatatgcactcggtcataaaaagccatttttaaagcactcattgtcaaaccataacgttctccagcaagaggcacttcatcaaaattataataatggatatttgagcggtcaaaattcattttttgtagtcgatcaaagagaatttcatacatcccaagaggagtattccccgctgttagcgaaagattcactctttttggctgcatcatcttatcaagaacaatcgctgcagcaagttcactcatcgttgcatagtctttagtgattatttttttcatagaagctcctttttttattgttacttctattttacaggattaagtattctattgaaagcaactctactcgttgaaaataaaaaagcggaaatccgcttttttattatttttcaagcattgctttcaattcattagccttgtctgtttgttcccatggcaattcaatatccgtacggccgaagtgcccataagctgctgtttgtccataaattggacgaagcaagtcaagcatttggataattcctgctggacggaggtcaaagaccttgcggatcgcggccaaaagttcatcatctgaaactttacctgtaccaaaagtctcaacattgattgatgtaggagtggccacaccaatcgcataagaaagttgaatttgagctttatcagcaagtccagcagccacaatgttttttgcgacataacgagccgcgtaagaagctgaacggtcaaccttagttgcatccttacctgagaaggccccaccaccatgtggtgcataaccaccgtaagtatcaacaataatcttacggccagtcaaacctgagtctccttgaggaccaccgataacaaaacgtcctgttggattgataaagtattttgtttcatcatccaaaagttcggcaggaataatagccttaatcactttgttaatcacatcatcatgaatttcttcatttgttgctgcagcagcatgttgagtcgagataacgacggtatcaacacgttttgcttttccattattatcatattctacagtcacttgtgattttgcatctggacgcaagtatgaaatttcacctgatttacgcaaatcagccaatttcttaactaatttatgtgaaagtgaaatggcaagtggcatatattcggccgtttcgttagttgcaaaaccgaacatcattccttggtcaccagcaccaatcaaatcaagtgggtcaactaactgaccatttttatcgcgaacttcttcagcttcgtttaccccttgagcaatatcgcttgattgctcaacgagtgagacgtgaacaccgactgatttgtaatcaaaaccattttcgctatcagtatagccaatttttttgatggtttcgcgaacaacatgggcaatatcaacgtaagctgatgttgatatttctccaaagacattgactgtccctgtatatacgaccgtttcacaagcaacgtgtgcatgtgggtcttgtgcgagaatggcatcaagaatggcatctgagatttggtcagcaaccttatctggatggccttctgatactgattctgatgtaaataaatgtttttctgacattaaaaatgtcccccaatctaaattttggttacaaggcgtctttaaacttattcaattttactgacagaaagttctgtcataggatagctgttattacttcagcaatttccagatatcttagtattttcatcataggatagccgttggcgcttcagcggttacggatatgctagttttttcatcagtaatttttaaaataggtcaaatcctttcgggactcgtaactctcttattttacctcttttttggaaaaaatgcactctttccttaacatgttttaaaaataaatttactgatgagtttcatttctgtcatagaatagccatggacgattcgccctacaagcaaatgcttcaggtagcacgaagtgcatagatagcgattacggatatgctagtattttcatcagtaaatttgaaataagttgttcttatgataattcagacccgaaacactgaatggtcttgcttttcaacttatcaattatcaaacttaatgttttttaaacatgtattcgcgtgtcattggcaagccttgtcctgaggctcctttggtcaagagatattgaacgacgtcaatatttccagcttcaaaacttgcggcacaaacttgaagataaagagtccacatgcgagcaaatggtctacccatttctttttcaacttcaccaaatacttcaagataattctcattccaaatttcaagggttttttggtaatgacgtcgaagaggttccaggtcgtctatttgcaaaccagctgtcatgatatgttcaacattttcagcgatatttggaatatatcctcccgggaaaatatatttttcaataaatgggtccactccggcaccacggtgttgaccagtaatcccatgaatcaaggcacgaccatttggcttgagataatcagacactttttggaaatacatttccaagttttctttaccaacatgttcaaacattccgacagaggtaatgtaatcaaatggctcttctttgaggtcacgatagtcaactaagtaaactttaaccttgtcagaaagtcccaaatcatcagcttttttacgaacataataatattgttcttcagaaagcgtcactccaactgctgaaagtccgtattcttgcacggctttaaacatcaaagttccccaaccacatccaatgtcaagtaaacggccaccaggtttgctatcaagtttgtccaagatatgatgaactttagcaatttgtgcttcttcaagtgtcatttcttcatgttcaaaatatgcacatgagtaagtcattgttggatcaagccatttgttgtaaaagtcatttccgatgtcataatgactatgaatatcttcacgagattgtttttgagaatgatttcccaaaagtttgagcattgatttacgaaagccagattggtcagttaaaaaactgcccgctttacgataagctgatgcaacaagctcttggatactcccttcaatctcaatttcttcattcatataagcctcagctaataccaaggttggcattgatgataaatcgctaaatgagaattttttattgaaagtgatgtgaacctgagtttctccttcaccatacttttctgtttttccatcccaataagtcactgcaatggggatatcgaaagcaactgcaagtgctttgttcaagactgttttttcaaataccaagttattttccctttcctaactttgttctaataaaactatactccgtagacaattgaaagtcaaatacttactatcgttagacttttctgaaaactttcatcagctctaaaatcgtaaaaaagaataagagaatagttttttgatataataaaaaaatgaatgacaaactcgaaaaatctatcatcttacaaaaaaatccttggctatctgatgttaagattgttgctgaatctgaatcaactcaaaaagatgccaaattagatggccaagaaaattgtctctatctaacagaaaaacaaaatcaaacttatggtcgatttggccgtcagtattttgctgcggactccggtggaatttatatgagtttgtctcttatgccatcagttgcaccagaaaaattaccagaatttactttacttactggtgccgcggttgtatccgccattgaaaaacttactgacaaaaaaccacaaatcaaatgggttaatgatctttatttaaataataaaaagtttgtcggtatccttgccgaaacttctctaaatctagctaaggaaactcaggttgtaattggagtcggaattaatttttctatttctcaatttccacctgaaatcgagaataaagcaacttctctattttacaatgaaaagccaaacatcaatcgttcagaattaattgccgaaatctggtcagagtttcatcgcctatccactggaactttttttgaaatctataaatcacactcttttattcttggaaaagaagttgagtttgtccaatctggtcagaacttttcaggaatcgctacagatttgacttccaacggtgagctcattgttaagctagctaatggtcaacaaaaaatactttccagcggtgaaatatcactaaaaaaatggacttaatcaagtccatttttccagttattattattatattatataggaggccagttttaggtcatggtggaccagttatgaatgactgacagaacaacttatgatgaacttgcagttctgtcagttaaatttattaaaaatctgaccagtcatcttctttttctttttcaactggttgatcttctttagtcttacgacttttgggttcttcccacggatttccccattggtttgaatcttgttgattttggcgccctttatcttcataacggcgtgcccaattattcattttatctgaataacgttctgaccaacgatccattttttcatcaaaatgttgcgctttgcggttccatttttcttgataatcattttctgaatcatcatagtaatttcgtggtctagcacttggaataatccaacttgctacgaaatacaagggaatcaagccaccccagctaccaaaagctaggacgacaaacaatatccgaagaatcgtcacaacatcacgacctagaccaaaatattctgcaatccctgcaatgacaccgctcactcgacgatttgtcaccgattttgttaattgtctttgagacataatttatcctttcttttaataattgagttatccctgtgacggtgtcattaatagactcgcaatcacataaacaatgagtaatgttccccaacttccgaaagtaccaagcacaatcagaacccgaattacattaattactgcacggctcaagccaaagtattccccaagtcccccgacggttcctgctatgactcgattgctacttgatcttttcagaggtttcttagccatttctcacctttcttctcaaaatttactgacagccatcttattttactaacaaactctgacagacttgtcataagctgttagcggcttcatctagtagattttaattaattttcttctttgtcagtcatttcggtatctttaagccaaattgttcctgattttgtttcgaattcgaaggttaatgattctgctccttgacggacaacagctgcaccattacgtcctgcttcaaatggactatcaagatttaaacgtgttttgtaaccgccaaagactgtccgaacatgtccaactaagcctaagctttcaggcacagaaactttaatgtccccatttacatttttaacgtttaatttgtgagccgttcctgttttttcggtcagcaatatatttccgttaacgagagagatatcaccagattcgaaagccgttgtaattctaatattaccattaacagcagttaattccaaatctgaatttgttccatcaagaaccttgatttccccatttttattattaatttttaattcatcactatttacttcgacaacttcagctgtcccattaatgagattaatgtttaatttttgagttgaaattttttcaactttaagttctgcatgaggtgcattgatttcgatattttcgtaatctttaattggtaaatagagttcaatatctgcagaaattcgaccatttgcttcaatttcaagcacatcatcttcaacttcaagtttagttttttcagcgatataagcttctacatttccatcttcaactgccccgtaaactttgtattctacttttacatgagcattctcacctggcaagatacttaccttaccacttttaagattgagatcaatttttttgaaatcttcttcaatatctttttctacgatatgagaagttgatttaacttttggaaagccttttgaaaaatcaatattatcatcaactgatttagctaccccttgaaaaatttcttttcctctagcaaacaaactttctgcaacatttttcattgcatcaggaaaatctacatcgtgattaacatatccttctttgtctgtatatgagaattcttttgaatctgttttttcatccgaagtttctgaatcaactgaaccatttttttcaagtagctctaaagcttcatcttccgtgataattccacgacgcatcaaatccattattctatcttttttattagccatttttttagatcctttctctgctcattcaagcattcaatatcttaaaaacttttttttattgagattgtctttatctcgtacacttattatctcaaacttctgccaaataaaaatcagcctttgggctgatttttaatctcttcttttttataattagataaagtattcctaattttaaatttttgatgtttttttattctatcattactaattatttaggttggatataagttgctaacgcggcaacaccagcagaaatatggcgttcactgacaatattatttccttttacattcatttcagaaactaaaatagaattatctggataaactttctcaacaaaagctacatgtccatattctggactagaaccagctacacctggtgggaaactgacagcataaccctcagtaggaacagttgtcgtaaagtaaccttgagcttgagcattgataccccattctccaccattacccatatgagtcccaatttgtccaccaagctgaataattcgattataaacatattgagtacagttaccgaaagcataactatctgctccaggataatccaccccattataatccggataagttgatgaatctaattttgaagcgacaagtggactttctggaatattactatctaaaacttgagtcgtactgtcgacattatcataaaaattcaagttatattcttcaataatttcaatcaatttttgagcatattcagggtctgtagcaaagataccttgtaaagcttgagctgcttcttgataagttttcgcatgagatttccaagcaccagcataaatttctgaattccaagttgtccccttaatcattaagttaatataatcatctaaagcttggtcatagttgctataaactctaaaactttgctcgatataataaggattattcccagaaaattcttctgttttaaatgaaattgattttcctaaataagcccccgtaatattgaaaatattaaaatattgttgggtcatattactttgcccagaaccagattccaaaatcgcctgcgccaaaataattgaagcatataaattatttttacctgctaaaattcgtactcgatcggcgatacttttaataaaagcttctgtgctagaagaatcaattttttcaattggtttagcagcttcgttttttttcaatacaggcccactatatacagaggctgctgaatctgatgaagaattaggaatttgcgctgcagttgacgtttgattataagagctattttgataataattagaaggtgccgttgtagatggtgttgctgatggtgccgtcgtagatggtgctactggaggcgcttgtgtcgttgtagaaggcttagtagctgaattattatttgatgatgaattagatgtacttggttttgatgatgaattagacgtacttggttttgatgatgaattagacgtacttggttttgatgatgaatcagacgtacttggttttgatgatgaatcagacgtacttggttttgatgatgaatcagacgtacttggttttgatgatgaatcagatgtacttggttttgatgatgaatcagatgtctcagttttttgtaatgaatcagaaccatcactagtccctgaaatatttgattgagtacctacactaatcgtcttagaaggcgcactttcagaatctactgttgaagtgactttacttcctggtacagtatttgcattctcagtcgttgatgaaacaccttcagtagatgtttttacactttcctgattatcattatctacttttgagttatctactccaccatttgtatttgaagaagaaaggtcatcagccttaccaaccatcccaaatgttgccatacctaaaagcagagcagtccctgcaataaatttttgctttttcactcgcttcacttgcgtatttaccaatgtattttatcctccatgcttacaatagtataatttcaacatcatttcttcaagacgtttacatttacataattgtaacacttttaatcattcaagtcaacttaacaacttttaattatcacttgtatattatatgatacatatctactgaaaatcatcttcttttgagtaagtagtataatatagaaaagacttggaacacctatatcacattttaacacttaataaattgagcaactaaaccattagttctcatttcatattctattcttattctaccgtaatatgcactcttaaatcaaaaaaagaaactgcttaatagcaatttcttttttatattagtttaacaagcaaattaagctttgtttgctgaaccgaatacatcgatacgttcttcaactgacgcagtaattgcatcgaaaccaggtttcaagaatttacgtgggtcaaagagttttttcttcatgtattctgcttcattatcgtcaaattcattaacgaatttacgagtagcagctgcgaaagcaagttggcattcagtgttaacgttaactttagctacaccgttagcgatagcttctctgatttgatcatcagggataccagaaccaccgtgaagtacgattggcacattgtgtcccatagcttcaacaagtgctttgttcaatttttcaaggtgatcaatgtggagacctttccagttttctgggtaaggaccgtggatgttaccgatacctgctgcaaggaagtcaacaccaagtttagccattgcaactgcatcatcgataggagcaagttcaccttcaccaacgataccgtcttcttcaccaccaattgaaccaacttcacactcaactgaaatgcctttagcgtgagctttagcgataacttcttcagcaagtttaaggttttcttcgattggaagatgtgagccgtcaaacatcaatgatgagtaaccaacttcaatacattccaatgcatcatcaaaatgaccgtggtcaaggtgaattgcaactggaactgtgattcccattgattctacaagagtttcaatgagaagtttacacattttgtaaccacccatgtatttagccgcacccatagaagtttggatcaatactggagtctttttagcttctgctgcgcgcaagatagcttgagtccattcaaggttgtttgtgttgaaaccaccgatagcgtatccgttatcacgagcggcttgtacgaatttttctgctgaaacgattgccatttcaaaattcctccgaatatttttttacctacctagtatagcattttgtgaagtttttttctagtccaagctcataaaaatccaaagtaaccactttattaagccattcttaaataaaaataaaaaaaaattaatagctaaaactattaatcttatcatatcccgaggaccggtttcgaaccggtacgaaggttacccctcgcaggattttaagtcctgtgcgtctgcca

SEQ ID NO: 46 - DNA, 2546955 bp, unidentified (residues 1,273,479-2,546,955 of 2,546,955)
  source 1..2546955: mol_type = genomic DNA; note = Lactococcus cremoris
gttccgccaccccgggtattatacaaaaactcccatagggagatttatcaagtttcaattcattaccattaatatgatcgttttcaaactgtttcaaagcgtctgttaaaaattgttcattttcaaaagaacgaccatttttctgttcttcatatgcttcaaaaccattgatataatcattatcctcatcaacaatgactaatctcattttaaaataatcaataggattctctttaaaaccttccaactttttgtagcgtaaaatagcttctttcagtttttctaagttagaataatatcctaataatttaaattcatattctacatacttatcatgctcatgactaagacgataaataattttcttgtccatcataaaatcctctcttgaaactggcagtcaaaaaaatcaattcccatattcattatttcttttaattttaatatttcctcttgcgaccaaacaggaatgtacttttcatcttcgggtcttatcagtaaatttagtccaaaaaataatttatcataaataccaacatacagcttatcgtcgccaataaaatcttgttcaactgaacgcattgcatcattaataatgttccaaaaatcaagatataaattataatttgaaacatcatttttaaccattaaattttttaattcaataatattatatgtactaacatctgaactcgaaagttcaattttattttcagcacagtattttttgactgattgtaaatttgaaaaagaaagcaatttttcaccatgagtaagcaagctatctttgatatctgaacaccatatacaataagtttctttattttccatcaaaaagcgaattaaataatattctttcatttttacatctctttatcttcccatacgtaatcggaataaaatttattaacaacatcatcaatactcgcatttgcaggcatttcaagaaagcgactatacacttcttgaaatggtaaagaaaattctatatcctcgctaatttcaaatacatcaattatttttgcaagtttccaaatgaccatttctccaaactcattagggtaaatttcctcattattttgcaccaaattacggataaaaattaaaaatttctctttatctcttagtaagttttcagaaatggaaatcaaaataaggctctcttcaaaaagtttgtggtctttagtaacgacagggtttttgataattgcctcttttagaagcacaatagaatatacgtgtttattttttgaatcgtccatcttgtaatagtttcttggcctttctagcgactgcgtttcctttatcagcagcatttttgatatctttccattttttattgagatattctttaggaaactctctacggatgcttgcttttcttagtttggaaataatttcgtccgctgtcatttcatcttcgccatctttagctgtcttttttgatgtggtaggcttagcttttgccttagctttcgctttttcagcctcaacttttgctctctgcgccgcattgagccgagaggtaaccttattccactccttgttgttctcgtttatcataagaccgcctacgataatcgtggcgcctgtcacaaaaacttttccgattatcggaagtgcggcaacgaatattggtgcagcaagggggaaaatacgcaaatcatagtcaaaatgtatctgaccgtttgcgtccactgtaaactctggcgcattaggtgcgagcgtcattttgtcaagaagggcatcaaattctgcgttagagtaaaattgtccgttgattgtgacaccatcatcacttacaaaagattttgggctgggttttggaacaatggacattgacggatagacttggtctatcatatcgctcaaagtccccgtgaatgaaggcggtggtgtcggttctgtcggagcttgcttttgctcggaatttttaacttctgaactttgagcgtccgacgtggcagatgatgaactggatatttccgtctgccctgtttcatctgctttgacttttaggatgctaaactctcctgcgtaagggataagcagaaaaacagtaagtaaaactaagctgattttccaatgaagttttttcatgtgtttttcctttttttagtttttataaaaaatagcaaatcattatttgtaatttttataactacaaaccccatggttgagctattcttgattttataagctcattgtaccacaaagaaaattataagacaatattttatttgtaatattctgattatttaaacaaaataaaaaactctcctgagttaaggagagttttacaagttttagcttatttactattttcaacagctacacgaataaattctgtgtagagttcttctggacggttgggacgtgattgtaattctgggtgatattgacatgccacgaagaattttttatcagaaagttcaacaatttcaaccaaacggttgtctggtgaaactcctgagaatacgaaaccagctttttcaaagtcttcacgatatttgttattaaattcataacggtgacggtgacgacgttgaaccacttcagcatcattgtaggctgctttagcgcgtgaaccatttttcaattttgctgggtaaagtccaagacgtaatgttccacccatgtcttcaacatcaacttggtcgcgcatgatgtcaatgactggatattttgtttcagggtccaattcaaatgaatgagctccttcaagtccaagaacattacgggcaaattctactgctgtcaattgcattccaagacaaattccaagcattggaacgtcattttcacgcgcatatttgattgctgcaatcttaccttctgttccacgttgaccaaagccaccaggcacgataattccagctgcgtctccaacaagttcagcaacattctcatcggtcacatcgttggcattgacccagttaatatcaacttcggcatcagatgcatagcctgcatgtttaagagcttcagtcactgaaatataagcatctggcaactctacatatttaccaaccaaagcgattttcacttttttcttaagattcatgacatggtcaaccattgctgaccattctgccatatctgcttttggtgcatcaagtttcaaatggtcacaaacgatttggtccatattttgtgcttgaaggttcaatggaatttgataaagatgttccacatcaagtgattgaatcactgcttctggtgctacgtcacagaacattgcaattttatcacgcatttctgtcgtgatcggcacttcactacgtaatacaagcatgttggcttgaataccatattcacgaagtgtcttagtcgcattttgtgcgatcttagttttcaattcgccagcggcacgcaagtgaagaattggaacagtgtgaatgtacatgacattgtcagcaccaacttcggctttcatttggcgcaaagcttcaataaatggcaagctttccatatcaccaacagtcccaccaacctcagtgataataatatcagcatcagttgttgttgctgcacgtttgattttttctttcaacatgttagtcacatgcggtaccatttggacagttgctccgagatattctcctttacgttctttacgaagaatctcactgtaaactttaccggaagtaacgtttgaatatttatttaaattgatgtcaatgaaacgttcatagtgaccaaggtcaaggtcagtttcagcaccatcatcagtaacaaagacttcaccatgttgataaggactcattgtccctgggtcgatgttaaggtatgggtcaaatttttggacagtgactttaagtccacggtttttaagcaaacgaccgagcgatgccgctacgatccctttacccattgacgaagtaccaccaccagtgacgaaaatatacttagttgacatctaaatctcctcttatctttttacaaaacagaaataactgggaaaaacaaaaacagctccccagaggggagcctaccgttactgatttttttataataaaaaaccagtgcccgaaaataattatatctgatttttccttttttgtcaaaagtctgtttttaattttttatgaagcccagtaatatcgggcatttctatttttccttttttgtaatcagtagattttaatgacgaaattgccagattttagcttctacattttttatcattacctttttcacttaagtgcttgcaaaaaatcttcctgtaagctcgttttaaatttaagacctgattcttctaatactttttgaagggcatagaggctataagccactttgctagttctagcattttcacccatatgtccaatgcgcaaaactttaccagctaaacggtcaaaagaacctgttatcatcacttgataatcttggcgcatttttcttaaaagttcttggtcattcagaccatttggtacttttataacactgacagtattagaatagccgttttgtaaataaagttctaatggggagttctttatcgcttttcttgtggctttaccaatcatcgcatggcgcttcaagatttcttggtcaaaaagaatattgtctacggcttggtctaatccataaatgtctgaaattggcattgtgtaaggaaaccattttttttcataataatctttaaaagtcaggagattacaataaaaactcgcaatagggctttgtctattttccattgcttggtaagcaagaggagagatagaaacaatcgttaatccaggtggagccgataaaactttctgtgagcctccaagtgcaatatcaatttgccaattatctacttgtaaatcttcgcctcccatggcagcaacggagtctacaacagtaagaattccatattttttgagaaggggacaaatcttggaaaggtcatttaatacaccagacggcgtatcacaatgaacaattgtagcatatttaaaatcatggtctttttctaaaaatttttctaaaatttctatgtcaaaggcttctttttctgaactttgaagcaatagagcttggccaccatatagttcaacaaattcagcgaatccatgaccaaagataccattatcaagaacaagtacacggtcgcctgattcagtcaatgaagcacaggctgcttccaaacctaaaattccttcccccgccagaattctaaggtcatttttagtttttaaaaattgagcaagtttatcgcaagtccttttatagaaatcataaaattctaaatcaatatctggatttgttgttactttcgctcttgctagacgaacattttcagccacagcggttggacccggggtcatgattagcatctctttcatttattcatacctcgcacgttctccaccaataagtttaggacgtgatttgagggacgtaacatgagcgccacctagttcttttgaaatcggacgtacagggatttgcacgtgtttgacatgcataccaatacttgtatccccaatatccaaacctgcttgagcaacgatgtgctctacttcgacaggagatttaaaaagttggtaagctgcaacttgaccacttcctccagcatgaagctgaggaacaacagaaacaatttcccagtcttttttgtcagctaattcttcttcaatgagcaaggctcgattgagatgttcacaagcttgaacggctaaataaattcccttgtcagatagggtcttgtgaataacagaaacgataacctgacctatttcggctgaacttgcatgaccaatcagaccaccattgacttcagatgatgagagtccaagcacaaaaacctgtcctgatttaatctctgtttgtttcaaaacatcatcaataattatttgtgtttcttctttaagcttttctaaatccatttaaaatacctgtcctttcaataagtgggcttaagactttagccaaaacaaagccaacgataacttggacaatattgacccaaagtccagcaatggccgaaccccagccatacattaagccaccaacaataaagtaccctccaaccataactagaagactcagcaaaaagttgagccatttatatcttgtcaagccagctagatagccttggcctccatgaataatcaggctgaaaaacatataattactaaagcccgcggtcaaatcaagaagaaaagctgcaaagcccccaattattgctgcctctcgtttgccaaaaagaaagaccgctgtataaattccgacatccaagagggttaaaatatttcctgccgagccagggattggaaaagtaaacaggcgaccaagaacaaaggtaatagctgtccaaatcgcaagtaaagttaatttttttatatttttgttgtccatgagtttcatctcctaatttccctagaagtttggtttgcttttggaaatttactttttattttgaaaaacaccaaattcattagaattttgaatagcttgatagacgaagtcttttgctttttcgaccgaatctttaaaagaattttcctcagccatctgacttgcaatagaagaggcaaatgtacagccagctccattattgtttttctttaaaagcggacttgctaattgataaaaatctttcccatcataagcaaagtcaatcgcttgtttttgatcaaatcgatttccaccttttatgattacatttttggcaccaaaacgatgtaaaagtttagctgctgctttcatatctgcctcagtttttactgacagccccgttagaatctctgcctcttttagatttggcgtaatgactgttgctagtggaaataattggctgatgaatagttcgcgcatttcactgacagaatagtctgcattttctttaaaaacaataaccggatctaagataataggcactggcgattttactgacagagctgtcagccactttttcgtcatctctagtatttttttattaggtaataagccaatctttatagctgaaaaatcaatatcagtcaaactttcaagttcttcttggaaaatttcctcatctacggggtgaacaaaaaacttgtcttctttgacggttacaatacttgttaaagcacaaaaaccatataagccatttgccgcaaatgtggctaaatctgcttgcattccgcctccagaaagaatatctgaacctgcaattgttagaattttttttgtttgtgctaattcctctgccattttctctccagtaatttttattaaaagtattttttaaatttcatttattggttcatatttgacttctttaagatataagccctcaggcgctgctgttggtcctgcaaaatttctatttttgctggtcaaaatcttatcaatttgactgacaggcattcggtcattgccgattttaatgacggtaccaaccatatttcggacttgtttatacaaaaaaccattaccacgaaatataaatttgaaattttctttatcaagttgaataatttctgcttgataaatggttcgcaccttgtcatcaactgatgaaccagaggcagtaaaacccgtaaaatcgtgttgaccaactaattttgccattgctccttgcatcagttcaaaattaagcggataacgaaaataagctttagaatgtctgtgaaaagggctacgagtcactgaattttccaaataatactcataggttttttcatgtttttggtatcttgcatgccaatcatctgggacaagttctactttttttaccgcaatatctgctggtgtctgagtgtctagcccaaaacgcaagcgctccaaatcacgcgctttgtcatttaggtcaaaatgaatcacttgaccaaaggcatgaactcctgaatccgttctgccagagccttgtaaaataacgggctcaaaagaatttaatttgcttaatactttttcaatttcttcttgaactgtgcgttgatttgtttggctttgaaaacctgcaaaatcggttccatcataggctattgtggctttgtatcttgtcatttttctattatagcacaatttttcatgcgactttattttctttttttatggtggtttatcctttttcaatatggactttgacaattctaaaaaatggcataaaaaaatgccccactacgaaggtggggcgaggtttggcaccatgatccgagggggattcgaaccctcgaccgttcgcttagaaggcgaatgctctatccagctgagctatcggaccaaatgtaagagagacagctcgactggatagtgaggaagaaaatttaaattttctttattcacaacctcgaagatatacttcgagccagctgagctatcggaccaattaatttctgtcagtaaatttattaagttataaatcactgacagaaacaagtttatcatattctcttacttttttcaattattgacctgtgccgtatcctccagcagtggtatcatctgttccattaccataagtagtcgtattattactattattatagccatcattgtaagtatcattttgctgataggtcgaatcagaacttgatgttactgtagagtcacttgatgagctagaggagcctgaacttgagtccgactgaactgagcccccacttgtcgaaacataatttcctgagtttttagaattcaaagaaacaagatttccttgagtatctactccgtaagtttctgttgtctttcctttttcagtcacagtagctgaaggtagatagtaaaatggtgctgtacctgaaccaaataccgattcataagtaatcaagctacttggtaaagtcgttacagttgattcatcaagcgatttcttcatgatattttgcatcgcaaggtagatatctgtcggcataaattgataggaagttccatcaaccatttcgcctattccttcatattggacagaaactactttattaaagcaatctttgtagcctaataaagaagtaatcgttgaggcattaattggaatattggttctaaaatcttttgaagcttcattcaaaaattgctcatagcgagtaatattatctaaagccaagacttttttcatgagagcggcgataacttcgcgctgatgagcagcccgaccgtagtctccatttggcaaatgatgacggtcccgagtataaactaaagcttggtccccattaatgtgttgttttcctggtggaactttcgcagtgtattgcggctctgtatctgagatgtataaggtttgacccgtagtattgttaatatcaatcccacctacattatcaaccatattgactaaaccatcaaaatttacagttgcaaagctatcaatattaatacccgtttgagctccaattgtcttcatggcataactgacagcatttttcaaaccatcagaagatgaccctgagttataacctaggggataagctgcattcattttttgtttagagacgatgtttccgtcaccatccaaaatattagtcattgtatcacgttcaattgaaaccattgttgtcgtgtgcgttttaggattaagtgtcatcagaatctgtgagtcagaattcccattccaagaatcggaagtcccacgaccttcgcctcctgtatcgactcccataagtaggatggtcagaggtttagtctcctgaatgacttgttctgtttgtttattcccagcattcgtgtaagtcattttaaaggcttttgttgtactgtttaagacggttaatgtatatccgcccgcagcaattgccgttactaaaatgatacttcctagcatgagaagtgtttttatccaaagcttcatattagcattatatcaaaattctgatttttcacaacaaaaaaagaaaaattagattttaatttttctttaattatatttagttttactaacaaaaaggtcagtcattagtcaaaaaataatacatagtcgcaaatatcaatgaattgaccattttcatctcttgccccccattttttggtggcttctaatgcaaaatcaaatttttcataaagatgtcgtgctttatgattgcgtgcttggacagttaattctagccgtttgataatcccaacttcttttatccagtcaagagcatcttctaataaaatcgagccaatcccatagccctgaaaatcttgggccacagcgataaagagttctgcgatatggcgaactcgataatgataatctgctgtcaggtgtaaaactccagcaatttcctcaccaacgaaagcaataaaataggcattattgtccttttcggcttgttgatttagaaactctgtcattcctgcttcggacatcagaattcctacttcatcaatggtcaagaaattactttcggcacccactttgttaagaaagtcaattacttttgggctatctaatccgcttgcttctctgacaattagttctgtagtcataaattattgataagctcctcgtatctttttccatgtgctttcaagataatctcgcgttcttggtcattgattaaatctggagaatacttatcaaaaatgacttcaagataattttctggcaaatcagctccgagcatttccccccactcaataactgaaacgccatcaccaaataaataatcatccaaatcaaaactatctggatcatcaccaattcgataaacgtccatgtgatgaaggggaagtcgaccatcaagtgttcttacaattgtataagtcggacttttaaccatttgatgaatatctaaacctagggccaatcctttggtaaaagtcgttttcccagctccaagttcaccggttaaaacaatcacatcttgtgcttctaattttcttcccaatttttgagcaaattgtaacatttcttcttcgttaaatttcatgattttattatatcacatcccagattgggagccgataaagcaaagactataatttttttgctgagcttcagtaggtttgtacacaattaatttattagtgtagtttattgaacccctctcataaatttgagcaaaataaaaaaccgttaaacggatttttatcttcttctgcgacgatactctttttgctgctttttatgatttttcaaaagttcatccgcttgtaaatttatttgttgagtttctgtcagtggattttcatgattttgcgttttatctgaattcactggtgaatctgtcagtgaacttgaaagagcactgccatttttaggagctttggttttactgacagaactttttttcttcccttgaccacgcaaatgacgaacgagagcaataatcccccctataattgtcactgacgccgacaaacttgttagcgtcattaaaagaatattatttcctttagcattattattgaccgtttcattgataatcgttgttgaatttttagtttctttttgacttccagagtttttatctgttgaattatcccgactttcggctactggaggagtttgattctgattttgcccattagtatctgtttgattttgcgcagttgtactagtctgtgtttgactttgacttgtcgaatttgtcccatcactagaacttgtattttgtgaactactacttgccgaattgcttgagctttgacttgtagaattccctgtggaactttgagcagttgtctctgctgaacttgctgatgtccctgttgctgtttctccataagcaattgttccaacattaagcagactgattagtcctatgccataaataattttcttcatactaaaattctatgatatttttcttaaacgaacttaaaatataggaatgtattaaataaacatcgagtctgtttcatatttctttcatattttttttggtacaataaacctatgaataaatcaacgttttctttgaatgatactccttgggttgatttttatcaacttcaaaatccacgtccagaagaaaattatacttttccagccatcattatttgcccaggaggtggctatcaacatatttccaacagagaagctgacccacttacgcttgcttttcttgcacagggttatcaagtttttattcttaactatacagtgatgaacaaaggaactgattataattttctctctcaaaatattactgaagttcaggcggtttttgctttgattaatcaacatcatgaacaatggcaaattaatcccgaacatgtctttttacttggctgttcagctggaggacatttagccgcttggtatggcaattctgaacaaatttatcgaccaaagggtgtaattctttgttaccctgttacttccttcacttttggttggccaagtgatttatcacattttaactttgaaattgaaaatatttcagaatacaatatttcagaaaaagtgacttcggctacaccccctactttcatctggcataccgctgatgatgcaagtgttcctatctataacagtcttaaatattgtgaccgcctgtccaaacaccaagtcccatttgaagctcatttttttgaagcaggaccacatggcatttccttggcgaatcggacaacagccccttctgatgattattgtcttgaatcagttcatcgttggttctcttgggcctcagattggttagaaagacaaataaaaaattaaaatgcccactcaactggggcatttttttgacaaaattttggtcgttttaaatagaaactatcctttttcttttaaccaaacttctttaagaaaatccaaagtataatgagaattgtcagctacaacgacgatatcatttcccaaatcctctggtcgcccaactccaattggtagcgcccctgaatctttaatcgcttgaattccagcttgagaatcctctaaaccaattgattcggtcggttttacaccaacggcatgagctgccacaataaaaatatctggagctggtttagatgccgcaacttctgctggatctgcaatcgcatcaaaatattcagtcaaggccatcccttccaataaaaatggcccattttttgaggcagaagctaaagcaatcttgatatgattagaacgcaaatctttgagtaattgtaagattccgggataaacaacagctggggaaacatcttgaatcatagtcacatagttatcattttttctttgagctagtgccttaaattcttctgccgatacttttttgccagccaaatctaaaattttctgtagagaatcttcacgagaaactcctttaagttgctcattgaactgacgatcgacaccattaatgccaattccctcagctaaagctttccatgctctataatgatactctgcggtatctgtaattacgccatctaaatcaaacaatactgctttaaacatctttttaccttctttctcgtcattttaaaattaattttttagaatgactttccaaaattactgacagaatttttttcatttctgtcagtaatttttttatcaaaaaataattgtaaatccttgtatcaaaactttattaagagcaaaaacatttattttaaatcaaaattagcttgtactcctgcttttaactgaacttcctcatcataaactttaatcagcaagtctgatgaagctgtcagtaataattgaccttttttaatcaaaatttccacttgacaacctttgaaaatttgactgaatttcaatttggtccaactttttggtaaatgcggagcaattgaaaagtatccatcacgtagtgttaaaccggcaaattcattttgaatcacttcaagtgtttctcccataaccccaatgtgaaccccttcggccgtggttccgccttgaatatcatagtaatcacttccaatcgcagtgattaaaaagtcaagcgcttcatcaaaatcacccaatttgacatcaatcccagcaaaaactggacgtgatgtcgttgaaccatgaacagttcgtgcaagataataatcacgattaactttcaaccaatttttgggtagctcataacctaattgtttgaccaatttggtcacatgttcatgacccaaattgtacattaacatcaaggtatcagcttgtttagccacttgatattcgtcaggcgaaattccctcagccttcatcaaacggtcaatccgatgaatatcgccatattttgcttcataagctgcaaaatcaacttctttaagctcaaaatacttagcatattgggcaatcacaccattctcatcaatatctaaataaagattttcccgaactttttgtgactcttcaagcaaatctgctggaatttcaaaacctttcactgacagctctgtcagccaatttaactgccaagtcagcatcaaattcgtataagcattatcgcaaataccaccttcttgccctggataagcctcatgatattcatcaggacccatgacaccagcgatatgatagcggttatcagcacccagctcggctttatttaaccaaaacttcgtggtttcaatgagcaaatccaatccaccgtcagtcaaaatactttcatcatctgtcagctgtaagtaaatccacagattgtaaacaatagctaagctgacatgtctttgacggcgactattatctggttcccattcattatttactgtattcaaatgaacaaattgtgcctgttcatccccaattaagccggattgccaaggaaacattgcccctatttctccatcaaactttgcattttcctgtgcagcagtcaatcgattgattcggtacaaaagcaaatcacgcgctgtttctgattcattcgccgcataataaggcagaacaaaaatttcatcccagaaaatatgtcctcgataaccttcaccagtcaatccacgcgaacctacggacgcatctaaaaactgattagcaccgtgttgtgccgcttggagaatatgaaaaatattcattcgcaccattctttgcaaatccgcatgatcagattcgatgacaatatcgccatcctgccatactttctcccaataaattgcattattttcctgaattttactgacagaagttgctgccagttctgtcagcacaaattcaacagggtttttggtttcataagaactagcaataacaatcgatttttcaaactgaacttcttggttttttagtaaatcaacttcaatggattctttaaaaatttcagaatttccagattctacttttttcaatggctgaccatttaaataagttttagtcgcaactgctaattctatgtccgtcgttctagtttttgccaccaaaagtccatcagcaatttgagtcacttcaaattctttgctgtcaaaagcccgataacgttcaacattttgattcaataccgaaccatcaataaaagtttctattcgcaattttccagaaaaatcagcgatgatttctccaacgaatccaaaatcgtgaaaatgaatgggatcaacaaattttgtggtcactaaagtcaaacttcccttggctaaactgacattatagctctcaatttgcaatccatttttgaaatcaatcgaagaatttttctcaattgctgactcaaagtcaaccaattcattatcaatataaactttaatcaattgtggatttggccaattgaccatatcttcattgatgacatcatgacctgcaacctctgtacttgtgtgattaaagacccctgcgacatagagtcccggataatgattatccgaacaagttgcccacaaaggcgccccacgaagccctaaataaccatttcccaatgacattaaagattcttgcccataagaacgcttccctacttcttgtttgtcatattggatcatccaatctttatcagtcatttctccccctttattaaactaaaggaagcagaatttattcgctctgctcccaaacaattctgttaattattttacagcatccttaaatgcatttttttgttcaactccttgtcccatgacgtcagtatccttgtaaccaaagaaccaaactaataagaaagtggcaacagcacataccgcagtggcaatccagaagagcattaagttacccgcaggtgcatgatgcgtcaatggattagagataaagttaggaaaaccaatcaatgaccctgaaaatccaaacatttgtaagccaccaaatccggcaataccagcaccaattgctgcaccaattgaagacatgatgaagacacgaacatatttcaagttaattccgtacatggcaggttcagttactccacaaaaagccgaaatggcagctggagcagaaagtcctttaaggtcagcttttttagatttaaagaagacagtcaaggcaccaactccttgcgcaagcattgtgaagctaacaatcatattaagtgagcttgctcctgttgctgccaactcttgtgaaataagtggtacaaccaaccagtgcaaaccaaagataaccaaacattgatacaaaccaccgacaataatacttgcaatccctaagtttaatgacaagatatggtcaataacgaatgacaaaccagatgaaattgttgaaataacaggaccaaccaagagtaaaacgattgaagcagtgataaagaaagtaatcatcggttggaaaattggacgcaaggcaagtggtaaaacctttttcaaccaagcattcaaaggtttagcgattgctaccgccacaatgattgggaaaattgtataggcataacttggcaaagcaaccggaattccaaaatagctcgtattaaaagtgactccaaggaaatttgctactggagctgctgcttcaacaacaacatttttaccggccgcatttgttccaacatgagcatttaccaagttagtaatccctggattaatcatgaaaccaccaacagcagcaccaataaattgtaaaatagtatctttaggcgctaattgttttgctgctgaaaatcctactagaacaggtaagaaataaaatggtgtcattgcaagagttgagataatgacgtaagttgaacttgcagggtcaatcacttcaattaaacgatttcctttaacaaagatacttaataatccattaatcatcccaccagccgcaagtaaaccaataattggaatcatcgaacctgtaattgtcccaatgaccacttggaaagcatgaacaattggattttgttttttaccattagccggtgctgttgcagcaagtgcttgcgccgttgcatcctcatcaacaactgaatctccaagctgttcaacaacctcatcataaacatcttctacagcttgtccaataactacttgatattgattcaagtttgagttataaacagctccagcgacaccagttaaggcttcaatcgccgccgtatctgctttatctttgtctttcaaggtaaaacgaagacgagtgatacagtgaataacttttgtgacattctcagcgccacctacatttgcgataatttctgtcgcaagttgtgaataatttgccataagttctccttttacttcattatttatgaagtatttcataatataaaataataattgacgagtttaatagtcacaaaatttatatacaaagccctcgtcttctttgtcctataaatggattaacctaaccttaaatttttattctttatttaacacttgccttaccaagttcacttccagaagtaactggtccataattgacattgaactcagagagtttatcttttgtatttgtaaagataaccattgtcgttttatctaaacctgcagcttcaatctgtgcccaatcaacgcttccaagctcatcaccaccattgacaatatcatcaactttgaccttgattttaaaaggaagacctttaagagccactgtatcaattccaagatgtaaaagtacatctaagccatcagcacgtttaaaaccaattgcatgtccttgaaccggggcaaaaattttattttcttttggctcaaccgcgaacccgtctcccattatcttttttgaaaatacggggtcgttgactgttgaaaggttgataacttccccagaaactggagcataaaggcttttatcatctctcaattctttcttttttcctattccaaacataagaatctcctatcttttgcagttgtacgtacaagttaacaaaatcattgtatcacataaaaacgttttcagcaatcgttaacaattatttttatgataaaatataaagtatgaagaaatatgaagtgattttgcaagatttagaaaaaaagatttttaatgatatctataaaacgaacgatattcttccaagcgagaatgaactttctattagttatgaaagtagtcgttcaaccgtcagacaagctttaaaaattttagaagaaaaagggctcatccaaagaagacatggctatggcagcattgtcctcgctcacgatcggctccttttccctatttccggcttaacttcatataaagaattgcaaacttcaatgggttttcacagtgaaactgaagtaataaaatttgaaagtataaaaattaccccagctctttcagaaactactggattcgccatcggtgaccaagcccttagtattcttagaagaagaaaagtagatggtaaattttccattttggattgggatttatttttagaaaaatacgctgatggtttgacccccgaacatgcccaaaattctacttacgattatttagaaggggctttggggcttgatattgcctatgcccaaaaagaagttaccattgattttgcttgtgaagatgattttacatatcttgatttaaatccgaaggaccatcatgttgtttccgtgaaatctcatgtctatcttgccgataatacacttttccagtatactgaatcacgacatcaggttgaccgttttcgttttacagagtttgctagacgccaaaaaagataaaaaaactctaccacagtaggtagagttttaggatatgaaaaaagacaagaagaatattctccttgtcttttctttatttcacaccaatttccgcttcaacaacttcaacaattgtatccacaacatgctcaacttgttcatgagttggagcttcagccatcacacgtaaaaggggctcagtacctgaagggcgaactaaaatacgtcctttaccattcattgaagtttccatttctgagataactttctgaatagctggcacatccatcgctgatttcttagctgcattgtcttttacacgaacgttaactaatttttgaggataaattgtaacttcacttgctaattcagataaagttttacccgtttcacgcattacttttaataattgaatagctgaaagttgaccatctccagtcgtgttgtaatcaaggaaaatcatatgaccagattgttcaccaccgaagttgtacttatttttcttcatttcttcaacaacataacggtcaccaacagctgtaattactgaattaattcctgcttcttcaagtgccaagtggaatccaagattagacattactgttgttactaaagtatcttgtgctaatttaccttgttcaagaagatacttcccaacgataaacataattttatcgccatcaacaatttcaccattttcatcaacggcaattaaacggtcagcatccccatcaaaggcaagtccgaggtcacttcctgtttcgacaacttttttagccatcgcttcaggatgagttgaaccaactttaacattgatattaagtccatcaggattttcaccaatcactgttaaattagctttcaaatccgcaaaaacggcacgtgctgaggtatatgaagcaccattcgcagtgtcaagcaccacattataaccttcaaagtcaccttcagccgttgtttttaagaaagcttggtatttacgaacgccttcaatataatcatgaagcattcccaaaccttgagctgatggacgtggcaaagtatcttctttggcatcaatcaaagcttcgatttcgagctctttttcatcttctaatttgtagccatctccaccaaagaatttaattccattatctaatgcaggattatgacttgccgaaatcataactccagcagaggctccatctttttttaccaaatacgcaacaccaggtgtcgctatgactcccaaatcataaacttcaatcccaacagacaaaagtcctgaaatcaaactactcgcaagcatttgcccagaaattcgtgtatcacggccaacatatactttgggagtttccaattcgtgttgactgagaacatagcctccaaaacgaccaagtttaaaggacatttctggcgttaattcaacatttgcttctccgcgaacaccgtctgttccaaaatatttacccatttttattgtctccattttttattctttttatatgttatcaaaaattagataccgatttttaccggggtcaaagtaacttcaacctcttgcggatctatacttactcctgctgcatgtaagggaactgttatttttgtttctttcacaatgcctgtaatatctactgtgccttctacactattaattgcttctaaagcacttttttcacccgacaaagtaacatttttatcagaaattttcgttttcacttctgataaagtcttatcaagtgttcctttttgtgttattttaactggaacatcttttgttaacttattcactgtaacttttaaatgtgttgttgaaggttcaatttgtgccggtagaattttacctgcactatctacggcgtgaagagttactgtgcctgaatagttttctgttaaattaacatcattcggcaaagctgcttcaattgcatagattttttgaatactttcatttcctgcggtaaccttaactttttcatcactaacagtaaggctatctatcgtaaatccttctggaagttgagttgaatcagcttttggggtcacttctaattcttttttagctttatcttccaccgtaatattcatggttttaggctcaattgttgccgtcaccccacctggaagttgttcaattctgattggaacatcaaatttaccagttttcaattttgttaaatcaacacttaaaaagaaatttctagtatctgagttttcttcattggtgattgaaagtcgattatatcctgataaatgaactgttgcactgctgttataaccactgacaaagtatttattagaattatactttaattctactggaacattattaattgttgcggtgtaaacttcaccagattggttggttccttgattgcgaatagatgtagcgttagcattaaagaaaagcacaattgcaaagaaaacagaagctaaaatataaaatgttttggaattaaaaaatctatttgccatttttcttttcctccaccttattttttctaattcttcctgttcctctcactgttttttcaactttaggaactaagattgcgactaaaatatcatgaaatttttcttttgaaatatcggaaaaaaactcgccattatgtgctactgagattccgccagtttcttctgagactaccaaaatcaaagcatctgaaacctcagaaagtccaattgcagcccggtgtcttgtcccaaactgttttgaaatgcctgacttctcagtcaagggaaggtaggcacttgtcacggctattttatttccctgaacaatgactgcgccatcatgcaatggcgtattgggaatgaagatattaataagtagttcactggtaatatcagcatctaaccgaattccggtacttacaaattcattcaagttttgtccttgctcaatcgcaatcaatgccccaatctttcgttcagacatgtaagcaaatgacttttcataagctgaaatgtgaccatctaagctccctttttttgttggtgtaaataaagtggttgttcttcccaagctttcaagtgctcgcctaatttccggttgaaaaatgataactccggcaataaccccgtaagtgatgacttgattgagtagccactcaactgttgtaagtccaataagtccagcaataattctaataaaaatgaaaataatcacaccacgaacaagcgtcattaattttgttccttgtacaaagcgaatcgcttggtaaaggaaaaaactgacaattgcaatatctaatacggcaatagcaatccgcagaggtgattcattcaattcaaaaattttttgccaaaattcaaggttaaaaaattgattgaagtcggtcaaaagttccccctccttttcatatcgttactttaattataccaaaattttatattaactgctgtattcccatataatgattaacggtaagcttgatatatttgttatttatacccgaattgctagttaagattccttatgtatacggtctaattttatctagtgtgacatcttccgccaaaaatattgttatttcactagctatgattgcttgtaacttaggatccttcttttcgccttttataatcagttttttagcaaaaatatttggagcttctgacgctttatcacaaataaaatatgcagctttcatttttgtcgtaatagctttgattttcacattctcagctctgacctctaaaaataaaggtcgtgaacaataatgaataaagaacccgaatggctaaaaaatattatcagcttacccgaaataaatatgaatatgaaattttttggagggcaccaacaaagtgttccattaggctggaaaattgaacgtgaggctcattttactttcgagattatgattatacttgatggtgttcaacagactaaatttgatggatgttcatttaattgttatcaagatgatatcatactcatcccacccggaatgccacatgaaaactcttgtatttcgcctactggtatgcattatttttgtgtccattttgatattgatgatccagagattcaattaaatatacttatgctttgctcagtaaaattaaataaaaataatgatgcttttacaaaaataaaatcagttctccaaaagtatattactctcattgaaacaaatactttttctcttagggagaaattaatgacagaaaaacttttgattgaattaatgcttagtttatatgattacaccttactagagcaaaatatagctacattatcagataattcatcgctaattttagcaaaatcaatcgcagatacaatacaacaaaattttcgaacatttactaagcaacctatcaaagaaaaccagcaacccctctcaatgcatgagatagcatattctttaaatataagtgaaagtaccatgttgaaagtctttagaaaagtttactcaatcagtcctaaaaattatctagatcaactccgttacaacgagtcaaaaattcttcttcatcaaccaaatcttccaattagcgaaattgctgaaactattggatatcagaatctgtcccatttttctcgacaatttaaacaatggagtaatttgtcgccaaaggagtatcgcattcatttccaaaagaatggtcgatagataaataattaaaaaacaaactaattagaccctcagaatatagactttttatgtctacaattttagggtcttttattaacataaaacattttttctattataaaaagtatgatagaaaatttaaaacatgaaataaacagttttaaaatgaaaaaattgattgaaaaaagaaaaagtctacaaattaactttgtagacttttctgtaggatttatttttaattttgaacttaactggactatagagttgctaattttagtggttttactagttctgcagacacattcaaattaggacaacgctctccaattatttattcatcttaaattctaaatacaaatcattataaattccagtccaatatggactaaggtttttgtaagcttcatcatctttgatagttgcttcatctgggtaaaacgatttattatcacgaatttctttgggtaagagagcttttgctttcaagttcggagttgcataaccaatccactctgcattttgagctgcatttttgggttcctgcatgaaattaataaaagcgtaagctgctttgacattttttgctgttttcggaatggctaaattatcataccaaatatttgtacgttcagggatgacatatttcaaatttttattttcagaggtcatctctgctgcttctccgctataaacaacggctaaaggtgtctcattattaatcatgtaattcatgatttcatcgcccaaaattgcttttacatttggcgtaagcttaaggaggtcttgataggctatgtctaactctttttggttggttgtatttaatgaatagccatgtttactaagaaccattgccatgacgtcacgcacactgtctgtcagtaaaatcgagtttttgtaagttggtgaccagatatcattccacgtttttggaggagtttttactgtttttgagttataaactatgcctaatgttccccaaaagtatggaacagaatattgatttccttggtcgaaagctggattaagtagtttagggtcatcgtcttttaaacctttaattttgctgtggtctagcttaaggagcagattttctttggccattttttcaatcatgtaatcagaaggaacaatcaggtcgtaagctgttcctccttgtttgacttttgaatacatggcttcattggaatcaaaagtcatatagttaactttataacctgtttctttctgaaatctactaatcaagtctggatcgatatattcaccccagttgaaaattgtcaagctattattctgagttttgactccgtcagcagctttcattctattggtaatcagtcctagtgaagcagtaatgaccagaattccaacaaaaaagtataataattttttcaagtttctcctttctatactttgaactacaaagtatcaataagaactatttaggtcagatttgaagattttccgacagtttctgaatctttcataatataataataccctacaaccaacagtattgaaaagagaaatacaagggtagagagagcattaatttctaaagaaattccggcacgggctctggaataaatttctactgacagtgttgtaaaatcatttcctgtaacaaagaaagtgacggcaaaatcatctaaagaataggtaaaagccataaagaaaccagcaataattcctggtgtcagataaggtaaaatgatttcacgcatgatttggcttgaatttgctcctaagtcattggcagcatcaattagtgagctgtccatttcttgataaaggggcatgaccattagcacaacgataggtatggagaaggcaatatggctgagtaagacggagataaagccaagtttcattccaacaattgtaaacaaaatcaagaaggaaacaccaatgactacatcaggagaaaccatcaagacattatttaaacccagtaaagtttcacgtcgtcttctttttaatttaacaagattaatggccccaatcgtcccgatgactgtagcaatgagtgaacttaaaaaagctagaaagaaggtctgaacaacaatcaaaattaaacggctgtcagcaaataatgttttgaaattatctaatgtaaaacctgtgaatttactcatgtcacttccagagttgaatgagtaaaaaataaggtaaaaaataggtgcatataaaaggatgaggacaaaggtgaggtaaactttaccaagtgaatttttcttttgcaaattaatctctcttttctttggtcattctcatgacaatcaacatggctacaactaagacaacggcaatagttgaacccattccccagttttgggtagttaagaaatgttcttcaacagcagtcccaagcgttatgactttattcccaccgattaaacgggtcaacatgaagagtgacaagcttgggataaagacagcttgcacccctgctctgacaccgtttagtgaaagaggccagatgacttgggtaaaagtttggaaagctgaagcacctaaatctctacttgcatttaccaaattatcatctaagtcatttaaagcattaaaaattggtaaaaccataaagggaattgagatatatgatgcaaccaaaataaaacttaggtcagtaaataaaatctgtgtccgtccaatccccaaaaactttaagaagttattgaccgaaccatatttaccaaaaattccgataaaagcataagctttgagtaaaaggttgacccaggtcggtaaaatgataagcatgagccaaaattgtttcatttttagtttggtcaaaacataggccacagggtaggaaatgacaagggttgccacagtaataatcagtgcgtagagaatagaattccacgtcatcaatagataagttccactagagaaatagaggatgtaattgttaagagtaaaatgaccgtttaaatcaaaaaatgattgcaacaaaagcatgaccaaaggaacaataacaaagaagacaacccagagaaaatagggaacggaataaattcttttggtcacttatgatccccactttcactattttctgtttcattttcttgcttttgcaaaatttcattaacggtttcagctagttctgtcagctccattgtattttcgagggcttctttgactgcttcttgaatggccgcttcctcttcagcattttcttcttcaacagctttagctaaaccgacggtttcttcttcttcaacatattcttcaatccgagcatcaaattcttcctcactttcattgagacgcatgatatgaatggcttctgggtcaaaatcaagtccaaccgtttcaccaacaatagctttgtgagtcgaatggattagccattcattgttaaattcatcataagctacaatttcgtagtgaacgccacgaaagagctgagtgtccactttgacattgaattttccttcgttaggaagagtaaaccagatatcttctggacgaatgaccacctcaatcggttcatttttacgcatcccaccatcgacggcttcaaatttttgaccgttgaattctacaaggtaatcttcaatcatttttccgttcagaatgtttgattcaccaatgaaatcagcgacaaaatgattgattggttcatcatatatatctgttggtgtgcctgattgaacgatttcaccttcattcatgatgaaaacccaatcagacatggccagtgcttcttcttggtcatgggtaacaaagataaatgtaattccaagactttgttgaagttctcttaattcatattgcatgtcctttctaagtttcatatcaagggctgatagagattcatcaagtaagagaacttttggacggtcgataatagcgcgtgcaatagcaaccctttgtttttgaccacctgataatttcgtaattgaacgcttttcaaagccatctaaacgaacaagttttagactttctgagacacgtttagcaatttcctttttatctactcctttgattttaagagcaaaagcgacgttatcaaaaacgttcatatttggaaaaagggcatatgattgaaagatagtgtgtacattacgcttattagctggtaggtcgttaattcttttatcatcaagaataacatcaccatcagttgcgtcaagaagtccggcaataatatttaaaattgttgattttcctgaacctgaggcacctaaaagtgtgtagaattttccttcttcaagttcaaatgaaatatctttaaggacagttgtatcagtatccgcataggttttactgacatttttaaattcgataattgtttttgacattttaataattcctttgaatataaagatgtgttaagccataaaattacttgaaaataatataaaaaaaccaagccaacgcttggtttcattatcaatttaagtcttctgattccaaaaggacaaacagaaaaatcttgtgcagagtctatacagcagaagaactcttaatactcttattgatgcgccaaagcgtgtttttcttgggtggggccttttatatctccccataactcatgacgagttaatcaataaggcaacgaaagtcgccaatttcggcttttgacccggctgtccgtatggccttagctcaaattatttattaaaacataaattgattactgacaaagtatccgtaatcttgagcggtcaaatcttctgtatatgcacagaacatcattaattatagcttaaattcgatgatttatcaagttgaaatttgaaaaagacaggaaatcctgtcttatttttcaccaataattctaacctcaggctctaatgtcacacctgaattttctttaactttttcaatgaccagagcaatcagtttttcataatccgtcgcatttccatcagcaacattaaccataaaaccggcatgttttttactgacttcgacaccgccaatacgctgaccttgaagtttagcttcttgaattaattgtcctgcaaagtgaccaactggacgtttaaaaactgatccacagcttggatattctaaaggttgcttacttttacgcaagaaattaagacgatccatttcattttgaatttgtgttgggtctcctgcttggagttcaaattttgctgacagaacaattaagtttttatcacgaatcacggaatgacgataaccaaattgcatttcacttgcacttaaaaccgaaacatttcccgcagcgtccatcactttacaacttaccaaaacttgggaaatttcgccaccataggctccagcattcatgaataccgctccaccaattgagccaggaatcccacaagcaaattcaaaacctgtcagtgaattggcttgggccacttgagtgacttcttttaatttcgctcctgcttgcgcttcaatggtataaccagccacttttactgaatcaagtttttcaagtaaaataacgactccacgaattccaccatcacgaacaatcaaatttgaagcatttccaagaactgtaaccggtgtatcagttgctttcgcttttgctgacagttctgtcagtgcttctattgtagccggaaaagccagaatatcagctggtcctcctacttttgtgtaagtataatttgataggggttcattaaatttaatcagtaaatctgggatattttcaagatcagtttcttttatcataaccttattttatcattttctattaaggatgacaattttgtcttaaatttcggctttaactttctttttattcacaagatttttagctttatcaaagatgtcaataggaaaggctttactcaaaacattacccaaaccaaacgctaagttgaagtcaatcatgctatggacaagtcctccaagagcaatcaataaaaggaagttcaataaagcaccttgctcaatattcgcaaatcctagagaataaaaagcataaacaactaaagtttccaaaccagcatgaaaaataccgagaataaaattaaagatttggattttaactttttgatgaacaaattctggatgttttttcaagacataggcaccaacagtcattacaggaaggtgcatcagcgcgcgcaaccaaattgtcggcaccggaatactaatcatgaatccgagagttgttcccagagcaacaaaagcagtcataagtggactgaaaaacatggcagccattataccggaacatgtgcagcaagcgtgaatgaggctgggccaataatgagtttaaccggcatcatcattggaattaaaattccaagtgcagtaagcatcgcagcaataatcagatttctgacttttgccttttttgtttgagtcatttgagtttccttttctttataaactcttgctttaaaaaagcggacagtagggcaatcgtggtttctcatttaaatcacatttttgtcattagaagaaatttaataattcattacttttaactttaaaaaaatgataaatcaaaaaccttattctgacaaataaaacgaaagttagtgaactactttacattcttttttgctttaatgattatatcattttatctataaaataatcaacaaaaagaacctgtattaaaatacagattcttctacttgtaatcctttgttatcaattttcaatggataaaggtgaccagtgaggtttttttccataattttttctgtcagtaaagttaacttattatcgggtacaagcagcatcactgtgggacctgcaccgctcagataagttccgtaagccccaaactcatgaccgatttctcgcaataactgaagctctggaatcaaggaagcacgatagctttcatggaaacggtcagcttccatcatttgccctgctacttctaaattatttgtcaaaagactggctgtcagtacattcgcaatggaactggcagcaactgcttctttataagtcaactcattgggtaagacctgacgactttcgaccgtttttaactcataatctggaacaaaagccaaaagtgcgcatgaaggaaaatcagcgacaatatgacttgttttaccagccacagtacttgcaataaccagatttcctaaaagagctggagcgacattatctggatgtccttcaatttcacaagctaacttaagtttttcatcagaagtcaaattaagttttgccaactgattggccaactcaattccagcaataatgactgaacttgatgaacccaaacctcttgccaaagggacttctgaggtcatttttagatgatattttgctggcagagcgacattcttgtcttccaaaactgctgacagcgtggtcagtaataaatttctttcgtcagttggaatattttcgcctaaatcatggtcaatcttccaatcgctactttcctcaagtacttcaactgtcaaatataaactgacggcaataccaattgaatcaaaaccggcacccaaatttgctgatgttgctggcacaataattttcatttgattagtcccccaatactttgaaacgattaagtaatttaaaatctttttcttgatttaatttatcttgaatggccgaaagttgaacacgattaattttatgactaataatcacaacaactgcccgcttgccatttcctttttgttgcaaaacttgttcaaaagaaacattttcacttgtaaatagctcaaccaagcgcaaaagctgtcctgttgaatcaggtgtctcaactgaaaaataatatttattttcaatatcatggggattagctagacttgtagaacgtgcatattcattaaatgattttccaattgtcccatctttgacacgtttaacaattcggacaatatctgctaaaacactcgtagctgtgggtttttgacccgctcctgcaccataaaacatcgaatctccaatgccctctgattcaatgaatacagcattcatgaccccatttacactggcaagtggatgtgatttaggcagaaaagttggactaacttcggcaaaaattcctgaatcaacttcgttaatttcaccagtcaactttaaaacataaccaaattgttgtgcaatctcgacatcagttttttgaatacttctcaaaccagatttagcaatttcatccggcgcaagcgtcattccaaatgcaaattcacttaaaatagctaatttataactggcgtcaattccgtctacatcatttgttgggtcggattcagcataaccaagttcttgagctttagccaaggattcatcataagtccagccttcttcactcattttcgtcatcataaaattacttgttccattaagaattcccaatagatgtgtaattttatcagatgaaaatgaattagccaaagttcttaaaataggaattcccccagcgactgccgcttcataataaagggctacatgatgtttttgagctaaactccgaagttccaccccatgaacagccagcaagtctttgttagccgtgacgacgtttttacctgcttctatcgcttgagtaatgtaggtcttagcaggttcaattcgtcccatcagctcaacgacaattgaaatttctgaatcggctaaaatatcgtccaaatttaagacaaaatcataattaaagccttgacttctggccttttcaattgccttattatctctcatcaaaacttttgaaatgacgatttcttcatccaatatttttgctaatttctctttattctctgaaagtaaagttggaagccctgtgccaactgtcccaaaccccaaaattgctatatttactgccatcagttctcctttaaaatctaaaataaaatgttaagataattcaaaaaataacttttgaataatttcttaatattataccatttttatagaaaaaaatttactgacagaatggtcagtaaatctaaatgcttctattttactgacagattaatcagtaaattacaaaatagaaatttatgcttaaagtaaatcaagtttctttaattcatcatcaatttgtcccaaaacttcatctaaatgttcgggattattgacaaaatcaatagaatctccatcaattctcaattttagtgaaatatcctaatttttataccaatcaggatattcatcatgaacttgggcatagtagtcttttagaccctcttgattctcaatttgttcaaacgaacgtccccgttgagcgattcttgaaagcattgtttcaaaagaaacatcaatataaaccaataaatctggacgtttttttggcattccatcaagttcctcgagcatgtttgctaacaaatcttgataaatttccaattcagttttcgtcacattcccatttttataattcaaagttaagaaaagttcatcttcaaaaattgaacggtcgagtacattgttatcctgacgataagccatcttaattgattcaaaacgtttattcaaaaaatagatttgcaataaaaaatcatatttttgaagatcttgataataaagatcaaggacaggattattatccaccgcttcataaaaaacatctgtcttcaaatgttcccctaaagcctttgctaggcttgattttcctgcaccaatagtacctgctaatacgatcaaaattgtcttttactcctcgtcattctcccaaataaagaatgaatttattaaatctattttattatagccgaatttttaagatttacaactatttaatgaatttcaaaaatgaaaactacttctattaactacttttcttttttcaaaaattcacgaacttgtgatgaaaaatagagcgaaccagtgattaataggagctcatcttcatttaaagctttttgtgcacgaacaatggctaattcccaacttggtgctaattcaaccccttcatcctctaaataccgaaaatctttcaagtctaaagctttaggataatcaaaagttgtcaaaattaagcgagaattttttaccgtttgaagcatttttatcatctgcctaatatcttttgtggtaatagctgaaaaaataattgaaatttttttatcagggaattctttccccaagttctcaagcaaacgattcatagcatgaacattatgagccccatcaagtaaaattaaaggattttcgcctaatttttccattcgagcaggccaaaaagcttcacgaattcccgcacgaataatctcttcattcaagttaattccaactttattcgcatagacgagcgccaattcaatggccattccagcattttctacttgatgcaagccaatcaaagatttttccaaatccagaattgcctcttgacttgcaaagaaatcaaaatgttcatgctcttttaactcggtgcggtaatcataaggatactgataaatacgcgcagtattttttctggcaacttcccaaataactcgcaaggcttttaattcaatgtttccaaccacaacaggtattccagctttaataatacctgctttttgagctgcgatttcttcaatcgttgaacccaagatatcaatatggtctaagccaattgttgtgattccagaaacaacgggtctaatgacatttgtagaatcaagcagtccacccaagccaacttcgattaccgccaaatcaaccttttcatcagcaaaatatttaaaagccatcgcggtaataatttcaaattcagtaattccagtcaactcagcatcattatcaagcttctcaactaaaggttgaatcatctttacataataaattaacttttcatcaggaattggttgagcatttatagacattcgttcaccaaaagtcgtaataaaaggactcgtaaaagaagcaacttttaagccagcttgcataaaaatagaacgcgtaaaggcaacagttgatcctttcccatttgttccagcaatgtgaatcattgataaagattcctctggattgcctaataattctaaaagtgctgaaactcgatttagccctgggcgaatattaaattttaatcgtgaatgtatccattctaatgcttgttcaatagacatttttgaccttttctattatatgttcttataacgataatactttttaaactcttctggtgcttcttctagttcaaggagaaaaaaaggtagctcagcaagctcagcttcttgttcttccaactccaagagatagcgaaaatcaatgtgccgatgttttttttcattttttatttcattaaatggaatatcaatcaaattaacatctactagcttacccattttttttgcaaaaagacctgtttcttcatgaaactcgcgaatcgcagtgtccaacgggctttctttcaattcaacatgcccagcaggaagtaagagctccttttgataaggatgctcaataaaaaacaatttatcttctttgaaaactagggtactggctgaaagttgcaaatctgggttaattttaccacgtaactcataatttgaactttccagtgattgaataatttttatcaatttttcctgattttcagcagttaccacttcttttatttgagaaatcaaatcctcattcatgattaaaattccttataaatttcaattgcatcaagcaaacgtttcgtttctttcacatcatgaactctaaggatacgtccaccgtcagcaaccatttgtccctctaagatcaaacttgaaaaaagtcgctcttctccttgagcattgaagagtcttcccataaatgacttgcgagaaatcgcaatcatgaccggcagaccaagtctgctcaaaagttccgttgttttaacacgttgaagactatcagagcctgaatctccattgaaaaaaccaactccggggtcaatagaaattttttcaggattcagtccaagctgagtcagttcgatttttttatctttaaaaaataaaggaagttcttcatagacattgtcagcatacttaaaacctgcccgaccattattcatggcaaccactgctggctggtacttttcaatcacttttagcttatccgctgtgtcaaaaccatcaatatcattaataatatcgacaccagcctctaacaccctttccataacataagcttcatccgtatccacggctaagacagcttttggaaaatactttctaatttgagaaatgggttcttttaatctgctccattcttcctctggactaatgtccgcataaccaggacgagatgattttccacctaactcaagtacagatgctccattttctaaatcggactctactcttttaagaatatgggaaatgtttaaattatctggattaccatcataaaaagaatcgggagtaacattaacaattgagtaaacgattgattttctagtcaaatcaaaattgaaattttttcctgaccaaataatttgatgccgtttataaatcaattcaagctcattttttacttcaatattttccaaatgattaagtagttttgccaactcatcaatagttaaaacagctagaaaactattttcgctcagttttgcaagacttccaatcctataaagctttttttgtaagcctgtcaattcatcattacttaattcttcaaattttatcacaatattttttaaagaaaaagatccttgattaagttctaagattttcataaaagactttctaaaaattccattcttttttcgctgttttctttaaattcacctaagaaataagaagttttggtcaacgaatttacttttttcactccgcgcatttccacgcacatgtgacgtccctcaacaagaacagccactcctttgggttttaaaatattcgtcaaaatatcggcaatatcatgagtaatattttcttgcaccgaaagtttacgagaaacataattaactaaacgaggaattttcgataatccaatgatgcgtccaccatcaggaatataagcaacatgagcctttccaaagaatggtagcatgtgatgctcacacattgaataaaatggaatatctttaatcagcacaattgaatcattcttagaagaatcaatttcaaaaagtttgtattcattaaagtttgtcaaacgttgtgatgaaagaatttgttcatacattttagctactctggcaggagtttcaagcaatccctctcgatttggatcctcacccactgcaaaaagaatttctttgaccgcctcttcaatacgactttttggagacttttcttcttcaatcacatgcagttcttgctcgctttctgaaagtttagcaattgcctcgcgaattggctcataatacttaaaatcattgcttaaaagctcaaatataggctttaaaacaaataaacgattaaaagcttctttatgtggaacaatcaaattttcttcttgaatttctgaatctccatagaaaataatatcaatatcaattgttcttggtccccagtgaatttttcgctcacgatttaaagaaagttcaacttcatgaataaaatctaataattctaagggttcaagtagtgtggccacctttaaagctaaatttgtaaaatcatcttgtttgacgccaccaactggagaactttcataaaaatttgatactttttcaatcataattttcgggtgttttcccaataaacgaatggcttcatgtaaataatactgacggtccccaatattacttcccatgcttaaataagttgtttgcataagtcctccatttagacacaatcttttatgattatgttctcctactttgtctgtaaaatgtttatcttagcagataaatctaccctctcatctcgatttcagcagaatcaaagataccttcgatcggaacagctaattttctaagatggacctcaactgctgaaatcccttctgaacttgcttttacagcctgaataatttcaaaggcaacatgttcaatcaaatcggctttcgaagcctctacaactgctttggttgcttcgtaaaaatctacataagacaaagtttcatctaattcatctttccctgagaaatcaaaattcgtttccacaattatatcaatttcaagattctgacccaaaattttttcttcagaaagcacaccaatatgcgctctaaatttcatattattaagttttattttgtacataattcctctttttaagtgtagaaaaggctatgaatctcttcatagcactattttcagagatatttcaaaattgctgtccaagcttcttcaattcctgtcttatcggttgaagaaaagataataaaatcatctgtactatcaaatttcattgcttttttgataattgattcatgtttattccacttaccacgtggaactttatccgctttggttgcaactaaaatcactggaatatgatagtattttaaaaactcatacatcatcaaatcatcttctgaaggttcatgacgaatatcaactagactgacaaccgcttttaaattttcacgtgttgtcaaatactcttcaatcatcttgccccatttttcacgttctttttttgacacacgggcataaccatatccaggtacgtcaacgaaatgaagttgatcatcaatattataaaaattgagcaactgcgtcttccctggctgaccagaagttctagcaaagttcttgcgattcaataaagtattaataaaacttgatttaccaacatttgaacgacctgctaaggcaatttctggccaatcgttttcaggatattgtttttttgatgctgctgaaattgttattgtcagattatttgtattaatggtcattttttatcggcctctcgaatcatttctggctcagcttttccgtcaataactgcttcagtaatgataacttttgtaatttcttcatgacttggaacttcaaacataatatccatcatcacttcttcaataattgaacgaagcccacgcgcacctgttttacgctcaattgcttttttcgcaatagccataagagctccatctttaaattcaagttcaacattatcaaataacaaaagttgtttatattgtttaatcaaagcatttttaggctctgtcaaaatttgaattaagtcttcttcagttaagcgttctaaggcagctacaatcggaagacgtccaataaattcaggaatcaacccaaacttttgaatatcctcagcgataatttcttgcatataagaatcttcatcgctcaattttttattattggcaccaaaaccaatgattttttcacccaaacgttgtttgacaatttcttcaattccatcaaaagccccaccaacaataaacaaaatatttttggtgtctatttgaatcatttcttgattagggtgtttacgtccaccttgtggtggaacactggcaactgttccttcaataatttttagaagggcttgttgaactccttcacccgaaacatcacgagtgattgaaacattttcagattttttagcaatcttatcgatttcatcaatgtaaataattccatgttcggcacgttcgatattaaagtcactggcttgcaaaagttttaagagaatattttcaacatcttctcccacataacctgcttcagtcaaacttgtcgcatcagcaatggcaaaaggaacattgagtgattttgctaaagtctgtgcaaggaaagtctttcctgaacctgttggaccaatgagtaagatatttgatttttgaagctcaatatcttcagcaattttacttgctgtaaaattaattcttttataatgattataaaccgcaactgcaagcgcacgtttggccttttcttgaccaataacgtattcattcaaatggtcaaacatttcttttggcgtcttaacttcaagcatctctgaatcttgttcttcttttaattcttcttccaagatacgagttgaaagttcgatacattcgttacagatataaacatctgaaccggcaatcatcttttttacatcatcttgactctttccgcagaaagagcaatgaatatttagattttgtgtatttgacatagttattttttcctgattgtgctaacctataaaactgatagtcgttagcttacttatataacatactttttctaaatacttttaaaacaaagttccagaaaaagcatgaatagtatttacgagattagtaaaagcattaagtaaaaataatactcctaagccccaacgtttttttctaaagcattgaatcgcaatgacaatgctaatccaacaaaggagagctgtgaaaagcccaaaaattgattttgtcatggttgtttcactttttcatattttttaatcgtaaaagtataagcatttcgctcatctttatcgtgaaaaatttccgaaaccactttgaatttcccaaagtcaaaatgagttgggaaataagtatctccttgaaatttttcatgaacaactgttcgataaagcaattcaagttctgattcaaaaagggctaatatttcagcgcctcccgtgataaacaagtctttatcctgcttataataccaatccagaacttctttagggctgtgcatgatgagaactttttcattttcagattgataagtttcgtcacgagttaaaataatacttattctccccggcaaaacacgtttgttcattccttcaaaggtttttcgtcccatcaaaatcacttgattcatggttgtttctttaaaatgtttttgttcagcaggtaaagaccaaggcattttgtcagcttctccgataagtccttgctcatcttctgcccatattccaattatcatagcaacccctctcattgatttttactttttctattatagcaaaattttgctattttcgctttgacaagttcagttctccgtacaccttttaatcaattattttgttttttataaaaaaatttaagtttttcctttacaaatgcaaaaagaagtggtatgatatcaattatattaatttgtttcaatctttcctgttatgattaaagcaaattagtcccccaactagacttcttgctgagattgactccgaggggtctagtttttttgttttttactttaattaatttactgacggtttgatatctgcaagtaaaatgtctctcgtaattctgttttattgactgacattctcgcatacccaattgacgaaagtacaaatgggttctgacataaccgtcagtaaaatttttgttattaagaaagtgtatcacatgaatcatattgctctttttgaacctcgtatccatttcaatacaggaaatattgctcgtacctgtgcagctacaaatactgttttacatttgattgaaccttttggttttgaaatttcagataaacacctcaaacgtgctggtctggactattgggataaagtaaatattgtctatcataaaaatttacaagactttatggactcaattgctgacggaggccaactttatttggtcagtaaatttgcagaacacgtctattctgatgttgactattctgatgatgaaaaagaccactacttcttgtttggccgtgaagatactggactacctgaagaatttatgcacgaacaccgtgacgaatgtatccgtatcccaatgaatgacgaacacgtccgctcattaaacctttctaactgcgcatgcatgatcgtctacgaagcactcaaacaacaagaattccgtggattagaacttgtccatacttatgaaaaagacaagttaaaataattttaactatatatttattaacaaaaagttttgcaaatttgcagagcttttttctattgtatgttaaaagccgaagtgctataatggtgccaaacgaagacccttaattttgagctttattttttatgaacagagatagatgaggagtaggatatgaaagcaaaattaggaaatacaattatagatttttggaaaatcagcaccagtaaacccgaaaatgaaccttgggttcttgaatcctttgaaaaagggcagatttcctggtctggccaatttgctatgaagactgcaagcaagcagcaactaatagctagtggaatgacccaaaaatattcagctgaccaacataatataggcaatgagataaagcacttggactggttaggcctttatatctcgccaaataagatgagtaatgcctatccggatacaatttatctcgtagtcaatcaagtgcgcattccagcctttggacgacttggagagtaccttgtccttgcgcctgacgattcgctcgaggtctactcagaaaagaaatttgaacgcgatttaaaagaaatttgaaataacataaaaaaaccaccatttggtggtttttttattttgcttcatcagcagctaattcatctttttttccatggttaaataccaaattcaagataatcgctgaaacagtactcatcacaatcccattagaaacaaaaggttgaatgaaacttggaagagccgtgaacaagttagtagagttaaatccgacacccatcgcaatcgcaacagcggcaatcaaaagattttgattaccctcaaattcaacttttgctaacattctaatcccttgtgtcgcgaccatcccaaacataatcaacattgctccaccaagaacgggagtaggaataagttgtgcaacagcagcaaatttagggataagtcctaaaataattaaaaatcctgcagtaaaataaattggtttacgagttttaattcctgataattgcactaaaccaacgttttgtgaaaatcctgtgtaagggaaggtattgaaaatccctccaagaaagacagcaaatccttctgcacgataaccattacgtaaacgtttttcatcaagattttcaccagtgatgtcggcaagagccaaataaacaccagttgattcaaccaatgaaacgatagcaataattatcatcattaaggaatccgctagatagaatttcggtgctgagaaatagaaaggttgaggaaggtgtgcccatggtgcttgagaaacaacagaaaagtcaaccaagcccatacttgctgctatgattgtcccaacaatgagtccaatcaatatcgcaatagaacgaataaatccagtagtaaaaatattaatgagtaaaattattaaaatagtagaaacagctaaaattaaactttgaatagttggcttctcaacgttatttcccatatttccgattgccacaggaataagacttaaaccgattgttgtaattactgaaccagtgacaattggtggaaagagtttacgaattttagagaaaattcctgaaatcaaaataacgaaaactccggcaaccatcaatgaaccaaacatagctcctgaaccatgtctttgtccaataataatcaaaggagcaacagattgaaaggctacccctaggactactggtaaaccaatcccaaaatgcttacgcatttgtagttgcaagaaagtggccaaaccacacatgaaaatatctgctgaaattaaataagttaattgcgtagccgagtaatttaaagctccagcaatcataattgggacaagaattgaccctgaatacatggccaacagatgttggagtcccaagacagcagatttagagttactttgctcctggctttgttcatttttatgaggcattttgattttccttaaatttttctttttttattctttttaattgcttattgcttagttttaatcgaaagcgatatcgtccgctggggcgaagattactttaccatcttcaaacttctcaatccgggcaatactggtaagtttcattccttgatcaagaagtttttggcgtccatcttggaaagatttttcaatcaccattcctagaccaacaacttctgctttggcttgttccatcaaatgaaccaaaccaagtgctgcttgtccattggccaaaaagtcatcaataatcaagactttatcgccttcttcaatcaatttacttgaaatttgaacggtagaagttaattttttagtgaaggaataaacttctgtaatcaataaatcatcattcatagtcacatttttagcttttttagcaaaaatcattggaacattgagtgattcagcagcatatagagcaggtgcaattccacttgcttcaatcgttacaacctttgtaactccggcatctgcataaacttgtgcaaaacgcttcccgatttctttcatcagttgataatcaacttggtgtgtcaaaaagcggtcaactttaagtatgtcttgacctaatacttgaccgtctgaatgaatgcggtcttctaataacttcattattctctccttaaaaaaattttttctcatctgtgcccacaggtgagaaaaacgtctcgttataaaaataacaagacgtttcaaatacgcaaaaaagaaattaaatttttgaaaaatcgaatttccttattgtctcgcatttacggtacgaggtagaaacgcccagccatattctaggtataaataagattgtttatagcagctcaacgattcttattgaaaatactatttatacattgttaattcaaggataaacaaaaaacgcccttaaaaagtagcgtttttagcaccactaagccaattctcagcggtttttttatttaaaaagtacactcctattatatcattttttcttgctcttatctccgtattctttcttacaccattcgttatatttggcattatcgacaatcacaaaattgccttcgttaatatgataacctcctttttcttcggtttccttttgtcgttcttcttcagtcgactggttacggatattatattccatttctcctcgcttcataataaacattaggtcaaattcattattgatagcacgaagtgtgtttttgagcttcttagatacgtgtccttctccatgaggtattttataagaatacaaaggaagaatcgctaaatcagagtttttaaattctacctcattttctgtcaatttttcttctaactttttactaagacccatttctaaactggtgtactctttattttcttcctccgcggctttcataagtgggataattttagaatcaagatcgtccaaaagttcatcgatttttttattatttgagctttcccatgtcttactatcttcatcatgagcttttttcaattgaggcaatacttctaaatcaaggacggcttgttttttatctcgttctatctcctcgagtgaaatgtcaatttcctcaacttcatatcttgcttcacgttttttggctgcacttgaaaaaggaaacttgctatcaattttcttctgaagcgtttctcttcttttgaccagctttgccttttcatcgttaaatttcttttctgtctctagaattaattgataaattttttgtgtgttttctaacatttttagttctcctcgtttttaaataattgttctcagttcgttaacatttagctgttttttaacagttgttttaacaatattgaccgttttagggcggtttttcccttatattttttagaattaaagaatctcctcaatcgttatttttgttgactttggagtgttttcaacgttttcagcacatttttcaacaaaaacactataaatagcttaacagagccgtttatttgtatttttattttcatttaacaccccccctatcaaaaaaatagctttatttttggttaaacgaccccaaccggtctggggtaaatttggaaatagacccaattatttttgacccggggggtatatttgacagaaaagataagatttattctgtttcttcgttttctagttcggaatctttaaacattaagagtaagtgtccatcgtcgtactgttcaatgaacgcttgtacggctcttatgaggagctgactgactactcgctccgttagccctctactcttagcaatagaaacaatcccctccggtttaaagtagtagcattcaaagatattgcgttgctctctgtcgtcaatcttattaagagctgacataatcagattggattgataaggctgtgacttatgtctcatgattatagctaagatgtccctgagctttaaccattgctcatgacttaatcccaagtagttcgcctttggtttcttgatatacattgcttcctccgtgatataatagacatatcgaaaggagtactatgatagccctaggtttctaagtatcttatctaaatctttcgcaatgtctttctggatatattcctcacgttcaactatattgcaatgcttagcttctagatgtaattgagcagcatgatttaatgtctgtttgatactcacccaatcagactttgacaagcggttatgcctgactggaatccctcctccaaacaagactttgaatccctgacgctttgtgtgattagattgattaattgtcttatctattttatctagcttcttttgattctctaatctcaatcgctgaatgttagaatgtggtttaaaatttaacatcttattctccttacggctgtcctaactgacagtctttttatttactcttctaattcaaagccaattaactctgcaatattatccaaggcgttgatattcatatcagccaaatctttagccgtgatttctgtaccatttgtgaagcgtggcacttcgttaatatcatctttaaacatggaatgattgagtgcgtgtaaatcttggagcagggctttgagtgtgctattttcatctacaagttgaggtgaagtactcaattcagatacacctaaagtttcagacaataggtcaattccacaacttattaaagtcattaaagcttctacatcagcatccgaattaataaagtcttttttaattaattcaataatctgttttacagtggcttttggttcattattttcttcttgttcatgtaatttaattatgctcatttttttctcctatttttggggtgcatttaatttaatgggtgcatttagtaatgcacccccaacaaatacagtcataccagaccttagaacagttttgaaagcgatattttcatggggtgcatttaatttgaaaactttactatgtgtccctgataaccaagccccttttataattaacactaactactattttactaagatataaatgcacccttacacccctactatctataaacccttatataatctaagtttttaaggggtgcatttgcggggtgcatttaacttttgggtgcatttagtaatgcaccctattttctgccataaccccttttacctcttcgagtagttttttgccattctttcttattattcattgagttcttgaacttagaaactatcttagcagttcctttccccgtctcaatccccattgcttcccaatagaaataagtagccgtcacaaattctcttggtttgatttcccctctaaactcatgtttaggggtttctccagattgaagaataaagccaatataggctctccgctcgtgcattcttgtattatttccttgtgctttataaaaatctgtaggaatcggaatttcaagatactgctcaagtaattcttcttgttcatcaaaatattcataatctgaccgttccaaattgagttgcttttcttcctcctctgagagtttaaaactgaacccttccttgtagtagtgaaccatctcaccccaaacttgacgaacggtggcatcatctaaatcagaaacaggatgatatttttgtaactcttttgaacaatgaacgggaagaaatcgccttgcccctgttctgtctttttgatattcttcatggttagttgttcgagcaataacaaagtttttggcataattttctacctttgtgccatagggcgccctgaaagaaagcacggtttgagtgataaacttctttaaatccgcaaagggtattttattactgattgccatttcatcatcattcacaatcaaagcacgtaacatcatgactaactgatctttatcatcaaaatttttcattgaatctgtgtaccagccttgccccatcttagtaagaaaggtcgtctttcccgaaccttggcctcctaccaaatccaaaacaaagtcaaacttatcatgaggacgataaaccttactgacagccccaacaaaaaacagtttggtcattcgttcggttaaatcactttctttcgcccccaaataatcaggaaatagacttcttgcacgtttgaccttatcccaattcttgtaacagtcttccatgaaatcttgaacaggattgtatttattttcgtaagcaatcttattaatcacattgactaaaagccgactatcaaataaaacatcatatttttcttcaaaatgttcaagaatagccgtaatataaacctcttttaacccgtcattctcaatctctactcctctcaacttgaaaggggttctgatttctatttcttgtgtaaaagaattaaacacaaattgattttttaaaatgttgtcattttctatggcgattcgtatgttttttaaagaatttactttgggtttaccatactgattgagggcgaaattttcagcttcaaatttaactttaacgattttatcgctctgaggtggtttttgttctgacttcttactctctgcttttgctttttcttcctcgtagctgttaatcatattttgaaaatcatcatctacattagtcactcaacacctctctttctttttcatcaaaatattcatccgcaagacctataaaatcagccagtaaggcttttttctgagttccctcacaagtcgcttcaatttctgaaacggcccacatcatgagatatttatagttatagccgtgttttttgcctaaaataatgaatttcatcatgttcttactatttaaaaagccctgatgcatcacaatttcatctttaaatttctcaaatgtattttgtcgataaacggtagcgactttttcagattgatcacgctgcagcttattaagaaacttcataaatttattggatggatgcgctggatgtttataatgcacttttttatacccttgttcttgatatttagaggttagaaagttaaaaatctcccaatgttggctcacactgatatcaagaaccgaatcaaaatgaccactaaagctcatattattagggacaagataaacatattgatagaaatcttctttctccaaaatgagtgtctctcctgcacctttcatcagttttttagctactattttatttaggcgaattgttaatagttccatatctcccctaatcaatcatttcatctaaccagtcaagtgaggcacttcgaacgcccatgaccgcttttagagtgctataagccatattttcttttttcgtaatgcctttggtgcgctcctcttcattagtaggggcaaaatagccaatgttatcaatcgagccaatggcgcaacccttgccttgcagaaattcaattcttgattgcaacgtccgtaaatctacatttagagattgagccaatattttaccgttaattgctttatcaatccctttatggtctgccagtattttaataatgttttgatctattttctgtaagtcagttatcttcattgaaatacccccaaattttagtaatggtttctaaaaattgctcatagcttgctctctgtctagcttcgccaatcaaggcaaacattaaaatagtaatagcttcattgcttgtatcgctgataagatattctagattgtccttgttgttttcattttcaaggacatcaatagtaattttcatagtttagtttcctttatctgtaattttatgatagccagttgcttgcctaaaatcggcactgattgcgtgcataagttgcttttcactccgctgggtaagattatgcctgtacttgcttcaaactgctgtattaagtcatatttgaccgctcgtgcgttgtgaataatcttataggagtgtttaccaactgggcgaaagccttggccaacttttctgactgcagtataaccgtgatatttttctatcattgtccacctctactctgccaattggtccatgagctgctcaagttgtttctttgagacccaaaccgttttatctccttcttcaaggataacttcacgaagtccagcaacaaccagcttcttataataagcttcattaattgagagttcacgttttaaatcagcttttttcttatagggaaactcacgactttgttcaactcttgcttcaactaacttatcaacatggcttaatactgattgagtcagctcatgctctgcttcaattgataaaatactcatgccatgcctccattcttacgtttagaaataacttccataactgcgcacgttagtttatcttcactaattcctagttcatgagaaagctctgaaacatcttcggaactaataacgtcaaaggctgtgagtgttttgtgcttagtttttctacgttgtctttcatggcgaataccacgattaaacgccacatcatacaggtactcgtaaacaaaaacacgcatccagtcttgccaattttctttatttgcattgtgatagtccatcaagataattttttcctcaatgatgtcagctaattgcataacgccttctggaacgcatcccttataatctgtttgtttaatttcctgtttaatacggtagcgttcagcttgattattagtgattttaagttttaaagggtgcttagaatctaggtaaaaaagtttgcttgtgattatccctaaggctctatctttcttatcgaatgaaagtgttatccctgccctacttttataggcatttaaatcaaatgttttaaatttcatgctttaccccttaaccatttctacttggatatcattttctaaagttgtgaatgtcactacgctttgaccgtcaaacaagcggtagacatactcattaagttggataaagtgtcttgctttggcctttaataagtccatgagttcaaaagcgattgaatcatctaggatataagtttctttgtttactggttttttcatcttgtgtaacctctctttttagtgtaaaatagagagtagaaaagctttatttagctgctctactcatattgtttaaaatcccgccggtctccaaacttttgggatttttttgtgttctcaattttgcgtactgggcggtgcgctttttttattttttacattttaaaattatcagcatactcttgaaatgaattcgagaactttaatatagatactttgcttaacttgacaaggtcctgtttcaaggctgcgcaaagttttttccccaattccaatcagtttacatgtttcgatctgagttagtttcatccctgctcgtctttctctgagagatttagcttgttcatttgtccatatcttcatattggataggtatcctttctatttttaggattgtttttcaatcctttgagtatattatatactgtttttcaatccttgtcaataaaaaagaaatgaaaagcagtcctttaactatcttttctttgtttttctgatataatttatataaagagaggaaacaaatatgtcacttacagcagatagaatcaaaaaacagagaaaaaaaaataacttgacaatgcaggacttggctgaaaaaatgggggtctctaaaactactattgtagaatgggaaaatggtaaaagagaaccaaagcaagatgtcattgataaattatccgaatttttagacgtagataaggcgtatctcctaggtttacaaaaagaggagaaaataatttcattggcaaattttataatggagcttggtaatgaacgctttacaaagttttttaatgaactaagaacaaatttttcagaacaagattatgataatttgactaatatagtctctgcctattctttacttgataacgaagatagaattttttttacaaaaagcatggccttaaaatcaggattaattgacagaacatttaaagcagaaaatggaaaaattgtttttattgataatgataaaccctcgtcttaatttaaataatttcatgttttgacttttgcgtactgggcggtgctagaaggacaaatcaacatgaacaaactaaatataaaagaatacaaaacaaaaggcggagaggtgcgatatattctccgtggggcttatatcggtactgatgtactgacaggtaagcaagtgcggacttccattactgggcgtacaaaaaaagacataaaagttaaactttcacgtcttcaaaatgagttcataaaaaatggttgtactaaaaaaattaaagtcttaaaaacttttgatgaagttgcagcagcatggtttgatttttataaaataaatagaaaatcagcaactgtcaagcaaacagaaaaaaatttaagattatatcttatcccagcatttgggaagtataagatagataaactcacaactgccattttacagcatcaaattaatatatgggcaactatcgctagtaaacctttaaacgggcgtcaggcacgaaaaaaaggcgaaatgagcgattataagagattatatactataatcaatagaattatgaagtatgctatttcaaatgatcttatttcatcgaatccatgtttaactgttctaatgcctaatgtcaaagtagaatctacaaaaaaagaaatcaagttttttactaaaactcaacttcaaagtttatttgattatttaaatcaacaggtttcttctcaatggaaaatgcgactgttaaaagctcttttaccttttctagcctcaactggtctcagaattggcgaggcagttgcattgagctggtctgatattgatttcaaacatggaactattacggtatcaaaaacggtaaatgacagcaatcaaattcaattgtctcccaaaactgaaacaagtaatcgaacaatagatatagataaatcaacactaaatcttttatctaaatggcagattgaaataaaaaaggagtttctcaaatatggaaaccccaatcaacctttgatttttccaaatctcaatggctctgtgcttaatagtcgactacttagaaatactttacttgattgttttgagaatgtgggcctaccaaatatcggctttcacggctttagacatactcacgctacactctgtttaagtgctggaatgagttataaagcaatccaaactaggctaggtcattcaacattacaaatgactatggatatctacgctcatcttgaacctgaaacagctaaaaatgaactcaccttatttgagaaataccttaattattcaaaccaagcgtaacaaaaaacgtaacattatttcccaagaaactcttaaacccttttataatcaggctcacacagactttatatcataagtcttaggtctgattttttatttctattatttactgaccaaacgcttattcctttttaggaacgagggttgtcagggcttttcgataaactttaatatctaatggaagcgggtcacttttatccccatcaattcttgaataaggattgtctttctttttctttgaatgtgtgagaatttctaaatgatccgtgtcaaaatgagtcatttccataaagtcttcaaatttacctctacgaagtttattcaaatgaaagaggatattgaacaaattaatctctttcagtgaataaacgcggataagtccatcgtccactttggcttttggtgctaaagcttgcattcctcctatcgtatccgtcattgtaatcaataatagttttgttcttaaagatttcgtttttccattatacttaactttgatgcgatacgttttattatagcgaatcaccttgtaggcgtccttaagataagctaaaggaccaaattttttcttctcagaaccgctcacattttgagcaatatctgccaaaattcccatggtcagactagaagtcatataatcattattgactttagcaatatcaaatttttgaatttctccatgatttaaattatcaagtgcttcttctaaatcttgtggaatatgaagtgattttgacaaattattgaccgttccatttggtacaattcctaaaatcggtttggctccaccttcaaacacaccgccacaaattttattgattgtgccatcacctccaagagcaatcactaaatcggtttgctcctgacttacttttttggccaaatgaatggcgtcctcaggactttctggattaataaaatcaacttgggagtctgagttttctggtctcgcaaaaaaatccttaatcttttttaaaactttgtcttcatcattatttcccgaattttcattataaaatacctttacttttttcatagactcacctccttattttattgatacggaatctatatcttacactataattctaacatagtctgaagaatctctgatgagacttgtttctttttactgacaagctccctagaaaaatttctcaaaactgtcagtaaattaaaaaagcccatcaattgataggcttttattttctttttttagtcaatactgaaataaggtaaacgtttaaaatgcttacgacgattccatttgtatttaaggttaactgacccttcaagggtagctacatatttatcaacagcagtaacaatccaactttctttatagcgtggcggattgattgtcgcaccgaacatatgttttatgatgatatctttctcaaggtctgacagagtagtcagcttgcgcgcattacggtaagcaatatgcggatgcacataggcatggcttttagaaaattttgtattgcgccaatcataatagaaaaggtcatgcaaaagtccagctctagctgttgctttggcattgaggccacgttttttcgcaatgagataagagacataacttacccgcaagcagtgttgcaagcgtgttgaagtatagtgatgtgtaatcccatcaagcttttttagctcatccatttctaacagatgaccgacataactcatatattctgcgtcgttaaaccacggcttttcatctaaattcatgacttgattataacacgttaattctctttgtcaatacaatatcctctctttttagattaaatttttctttttaaatgcttagaaatttatttttaatgcttgtaaaattttgaaaattcccttctttatcttatttcagcttttatttatttattattttccaaaagtatttttcgacttttttcaaaaaaaataaaggtcaagagtttacaaaaattcaaaattcctgtataattgataggtattagaaaaatcttggagggtgtagtgtgcccacctgggacatacatcaaccgcttttctatgaaaagtaataaaaggagactaaaatggcaaacattaaatctgcaatcaaacgtgctgaattgaataaaatcgcgaacgaacgcaatgcacaacaaaaatctgcaatgcgtactcttatcaaaaaatttgaagctgcaccttcagaagaactttacagagctgcttcttcaacaattgataaagctgcatctaaaggccttatccacgctaacaaagcttcacgcgataaagcacgtcttgctgctaaacttggctaagaaaaaatttctgtctctttgacagatttttttatatccaaaattactgacgaagataaaaagactgacagaaatttctgtcagtctttttatctatttattaaaaatcgcaaaatcttgctcagtcaatccaattaagggatcaaaattgccagataaaattagcgcttctgttagaattccattccccaaactttcagtttcttcataaaataatgaaatttcctcaacttttggtgctgttttttttctgacagaaaagttttctaagtttaagtctgctactgatccaaaatttttctctttgttagatatttccttcttgtcagtaacttttttagttaaggaatctactgacagattttcagctgcaggcttatcatccttaaaacgctcaacaagaaaagtttttcgattagctccttcacgcgccacagcctgagcaaaggcacgctcttcacccaataaaattaagctttgctttgccctcgtgattgctgtatagagtaaatttcgctctaacatccgtgaataagaagagaccatcgggacgatgaccgttgaaaattccgaaccttgggatttatggatagacatggcataagcaagcgtaattttataccattcagatctgggataggtcaattcttgaccatcaaaatccatcacaatctcatcttgtttactgtcagtatattttgctgcaatcaattcaacaatttgtcctaaatctccattgaatacattggcctcagcgtcattgactaaatgtaatactttatctccttcacgaaattttatatcacccaaaacaaattcaagccggtcattaagcggattaaagagattttgcaagagaatattcattgcattaatcccagcggcccctttatacatgggcgctaaaatttgtaattcaaaaggattatttcctcttttttgccaagcactagcaatttgctccaccgtttgtggtacaaaattagcactcacttcaaaataagaacggtcagtttttttcaccgtaaaatctgcaggtaattgtccatctttgatatgatgagccaaatcggtaatcgttgaatcatctccctgacgaaaaatcttatccaattttactgacggaatttctggaatttttaataaatctgcaaaaatttgtccagggcccacagaaggaagttggtcagcatcgccaacgagaaggactttcattgaaccaggaatggcttgaaaaagtttgttggctagccaagtatcaaccattgaaaattcatcgacaatcaaaagtgaacctgacaactcattaccaagcgcatcttctgcctcatcttgccctaagcctaagtgccgatgaattgttgctgctggaagtccagtcaactcattcatccgtcttgaagcgcgaccagtcggtgccgccaataaaataggaaaaacgtcatcattataatggtcagggtctaaatctaactgataaagacgggcataagtttcaatgaaaccattaataatcgttgttttccccgttcctggtcccccagtcaaaatgaaaaattgctgattcatcgctccaatgatggcctgtttctgaagttcatcataagtaatctctaaatctttttctacctcttccaaaactgtcagtaacttttcgtcagcaaaatcttttcccaaacgattagttaaggctgtcagtgattttcggataccgtcttcagcaaaaaacaaggaattttcaaatattttcgttccttcttgctgtacttttccatcaacaattaaaccatttatttccgcagcaacttcagctggattgacctcaatatttctggcttcttcaagtaaatcaatcgtcaattccagcaagtttttagcttcaatataagtgtcacccgttgcttgcgaatgcgtattgacctcatgcatcaaagccgctcgaaaacgatttggactatccgcttcaatccctagttcactcgcaattttatcggcagttttaaagcccacccctttaacttcttccacaagttgataaggattttcctcaattttttcaatcgtttcctctttgtacaactcataaatttgaaaagtgagtttacttggcaagccatactccgcaagcttggtcagcactttttccataccatgattttcacgcaaacgtttgataaatgaattttttctggctagagttaataaaccatccaatttctcaggcgcttctaaaatagaatctaccgtattttcaggaaaagtttcaacaattttctctgccgtttttttaccaatccctggaaatttatctgatgaaaaatacttgaccaaaccagcaccagacgttggtacagccttttcatattgactgacttgcaattgttccccatactttggatgctgggttaattgcccataaaaagtataagaatccccttcgaccacatcgccaattgtcccattgaccacaatttcaaaatcatcatattcagcatttgtttcatcaatctcaattaataaaactttataaaaattgcttggattagagaaaaaaatagcttcaattgagcctgtaacataagttttatccgtcatagctgtttatcccaaattttcaaatcaaaatgactaccatttgattccaaaactgtaactgtattattcgctagaccgccaacagaacgtaattcagcgattgggaatccagccaaatgtcgcattccagccgtcccagaagctccgtgaccaactaaaagtacattgtccattttagaattcaataagtcctcagccaaagaatcaaagcgtgccaaaactgaagtaactgattcagccccaaaagcacttccatcaaattgatctaattcaaagcgagaatcatgcatttccttagggtacttagcgattgcatcacgaatgaaccaaccctctaattcaccaaaattccattctgataatctcttgtcagtacttacagactgattggtcagtaaatctgccgttgtcaaagctcttttttgagggcttgataaaaccttgtcaaattcaatcggttctaaaaacttatgaacacgtttaattgcctcataagattctggcaataaaggtgagtctcccttttgtccctgcaaacgccatgccaaattccactccgttttaccatgtcgtacaaaataaattctcacctttacacctcacctaatgaatatactgaataatttcctaacaatcgaacatttactcccaaacctgccaattcttcaagagcataaggaatctttaaactgttcgttgcattattttctaaatcaataataaaaaagtactgtcccaaacgtgtccttaaaggacgtgactcaattttagtcatgtcaatatcacgccaagcaaaaacagaaattgctttgtgcaatgctcctggcaaattgtcaggtagcgtcaaagccaaagtcaccttatcctttgtttgatttaaatcaaaggattgcttttcttttcctagtaaccagaatcgagtcgaattccccgccaaatcttgaatattttcagcaataaattccaaatcatacattttagctgcaaaagaatttgccaccgctgctgcgggcaagttcggattatttttcacaaactcagccgctgccgaagtggactcagtaatttccacctgcgcctgaggataaaattttctcaaataaactctcgtttgagccaaagcttgaggatgagagtaaatatgctcaattttttgttctttagaaactgccaataaattttgagaaattggaagaacaaactcggccacaaccttggcatttgaatcatgaaaaattttatcaatgctcatattgaccgttccttcagttgaattttcaataggaactagtgcaaaatcacattcgccttcattataagcttcaatgacatccaaaatagttgcataagagtacaactcctcagatttaaaagctgcttcggctacgactgagcaaaaagaacctcgtggacctaaatatgcaaatttcatcctactctatttcccacttttctctaatcagctctgcaatctgctctggacttttatcggtcacatcaattgttaaatccgcaaccaatgaatagtctttcattcttttttcaaataaaagttgagcagcttctttgtcttgagctaaaggtcgaacattctgccaatccatggaaattctcttccataaagtatcaaaatcagcagtcaaaaatacaactcgtgatgctctatcaagaacatttaaattctttggattttctatgattcctccaccagttgcgataataatatctttttgaacagcaagctcaaaaacctcattttcaattttacgaaaatcagcttctccaaataattcaaaaaaagtggcaattggcatttcaatctcttcttcaatcaacttatctaaatcagtaaattcttctgctaaaagttttgccaccgttgattttccggcacccataaatccaattaaaatgatactcattttttacttcctatcatttaatttcaaagattttctgacaatttttctaaatcatcaaagaaacttggatagctcgtttgaatggcctcagctcgttcaagttcaatttcaccattttcaactaaaagtgcagcaattgcaaccatcatcccaattctgtgatcacctaaagtattaattgcattttctggagcatgcaattttgttccaccttgaataatcattccatcatctgttggttcaatatttgcccccatactattgagtgcatcagccacaacagcaatccggtcggtttctttaactttaagttcagccgcatcgcgaataattgttttaccttcgccttgtgtagccaaaagcgcaataattggtaattcatcaattaatcttggaattaaatcacccgatatttcagttcccttaagttgactcgcttttacttttagagtcgcggcttttgccacctcatcttgctctaaaatttccaactggccacccattgcctgaatgacttctaaaatacccgttcttgtttcattaattccaacattttccaagataagttctgaattttcaacaactaagccagctacaagccaaaaggctgctgaactaatgtcaccaggaactgtcacctcttgccccataagtttttgcccgccaggaacaagactggttttatcagaaactttaatttctccgccaaattgaactaacatttcttctgtatgtgagcgtgttttttccttctcaacaacttttgtcagtccttctgcttgtaaagcagcaaaaattaccgccgattttacttgggccgaagcgactggaaggacataatcgattgcttttaaatgggcacttcctttgattgtcatcggtaatttaaccttatcagtttgtccaactatttcagcccccatcatttgaagcggagttgcgacacggtccatcggtcttttggataaactatcatccccaaacaacgtagtttcaaaaggaagccctgctaaaatacccgataaaagacgagttgaagttccagaatttcccatatccagtgctttttctggctctttaagtttcgaaatcccctgaccatggacagtaataacttgaccatcgtcctcaatctcaactcctaaagctcgaaaggcttcaatggtcgataaaacatcttcgccacgcaaaatatcatgaatgattgtttttcctttggcaattgagccaaacataatgcttcgatgtgaaattgatttatctcctggaacctttaaatgcccttttaacccttgtgaatttatttttaatttcattttattttcctaaacattttttagtatttattatagcataaaagggcgctcaaggccctcttatttttatcatttcttcctaagattttaagactaagaatgtcagttctttaacctttatcaaacaactgtaaaatcagttgctttttcaataatttcacacgcctcttgcaaatcttctgctcgtttaaaagagatttgcagttgaccatgaatatcttcacgattttcttcattaattttgatatttgtaatcgaaaaatcctgtaagagtgctaaaactcgtaaaacaactcctttttcatcgggaaccgagatgaataaatcataaaagtttggcagtgcccctttatgaatttccatggcttgtcgaatctttttaccttcttcaaaaaagtgttcaatagcttgggaatctctattagcaattttttgagctattccatctaattgttttttgaaattttctattctgtcaatcgtaatttctggatttgataataaaacactagtccacattaagctgtcagcctcagcgattctcgttaaatcacgaaaacctccagcagctaaatgtttgactaaaggatgctctttagcataatcgtctgattgccagaccagagttgaagccaaaatatgtggaaaatgagacacttgccccgttactttatcatgttccttggcatctaaaataataaatttagcatgaagtcccttaagtaattctcttaattcttgactttcttctgtcaaaacataataagcattttcaaataaattaatatctgctgccattactcctgatttatgagagccaaccatcggatgtcctccgataaattttacttttgtcccagaaaaaagttgattagctagcttgacaatctcactcttagttgaaccagcatcagtaatcaaaagtccatcttttaaatcaaacgttgcaatttgctttaaaagctccagagtcgctgaaattggtacagctaaaataataatatctgcttcttgggctcctttaactaattcgaccttagaatcaataattccacgtttttgagcaatattttcaacttcttcacggtccgaaccaagaatttcaaactcaggatgagctttttttatgcctagggctatagaacttccaatcagtccgagacctataattaatatctttttcattctttactctttcttaatcatcacacaagttccctcaccaatttcagaacttattgcgatttgaaattctagtttatccaaaataagttttgctagatagagtccaagacctgttgatttttgctgaatccgaccattataacctgtaaatccatgttcaaaaagacgtggaacatcttcttttaagattccaatccctgtatcctgaattctgatttcacctggtttgatttgaattaaaattccaccttctttagtgtattttacagcattattaagcagttgttctatagctaaacttaaccagcattgatcgctatttaccaaccattccccttcgatttgaatggaaagatttttttggataaagaagctactatatttttttactaattcttttgccagtgaggacatgctcaccttttcaaatctaaaatcggtagccaaattattaattctttgatactcaagaagaatctttagatagttttctaaagaaaaaacctgatttttcaattatttaggatcaatttgtgtttgtgtcattaaatcaatggcggccaaaggaactttcatctgatgcgaccagactctaataatatcttccatctcccgttcggcaagattttgttggtccaatttttttgtagagcctgattatctttcatcactcgctctaccgcttctcgcattgctttccagcggaaatatgaagaaattaaataaattacaaaaataattaaggcaaataaagtactattaaaaaaagccatcattggtaaatgccaaagccaaaaagtcacaatatatatggctgacataagtaaaaaaacaccgatttgtgggattttagacttaaaatatttataccaaagcatagccacttcctctttttgtcattatatgtttatcaaattcaacttctccaagctttttacgcaaacgagtcatttttacattcaaagtattagcatcgataaactcatctgtttgccataattcttgtaaaattttctctttagtaactacctcgccgttagcacggaacaatagggttaaaattttattttcagaactggtcagttcaacttcttgtctttcagaattttgggttaagctcaaagtattttcagacaaaacaaatcctgcaaactctaatttttcaattccagaaaaagaataacttctgtgtaagagtgctttgattttagcgcttaaaatttccagagagaaaggttttgtcacaaaatcatctgcaccttgattcatagctgttacttgattcatgtcatctgaagcagatgatataaagataatgggaatttgggaaagttttcttaattcgttggtccaataaaatccgctataaaaaggtagtccgatatccatcagcactaaatctgcttcaaactccataatttcttgtttaactgctcgaaaattagagacacttcttacttgaaactctttttccaaggcaatcttaattgcttttacaataatttcatcatcttctactataaatattttagtcatatttattcctttcctgttttcaattttgctacgatttgagtatcgctcactctttcataccagagttttcttgttttcgagagaaaagcaattaaaacatccagtaatggcaaaagacttaatcctaaaaagagtaagataagtaaaaagttttgagccaattggtcctcagctatcgttcctgaacgttggagaaagaatcctgaagcgataatcaaagcaaaattcccaaatgataaaaactgacgtaaagcaattctaaatcgatttttacctttaatttgtattcttaataataattgccccggagttgccttaagagctatcggaacaattcctaaaattagtaattctgaataatagccagtcggaagaaatagacttccaataataaagacaagaaccatatcaactaaaaaggcaataaaacgtcttgaaagactgactcttgaactttcaaccttagttgcatccaaatctggtaaaaatcgactaaaaatgaccgcaattccaaacccaattaaacttccaagcgtattaatcattagatcatcaacatcaaacaaacgataaggacgaggatagagtccaaaaagtgctgaacgttgaataagttcaaaagataaagtcaataaaaaacttaatataaaagtttgtttaaacgaacgtttaaagagatatttcaaataaaatccaaaaggtaatgtcaaaagcaaattaaagaagggttgaatgaatgttgaatcttttagagctaaaatccaagttgatggttcatttatcctaaaaggactgtataaaataaactggtgaataaattcaaaaggaactaaattttgttttggacctgtcatttgagcaacttcgttaacaggaggaagagggaaaattgtcatcgcataggcacaaatcaaataaagaataaaagaaaagttaacaaaaaagcgccagaaattaattctaccataacggcgatactgaacaatcaaatatggaattaaagataaaaataggaaaatgaaaaagagtaaaactccaatttgaatagaatgcagataagtcctcatggtttcccttcgttaaaaatgacttcttaggtgttagtcaaaaagtccttgattatatatttattttattatatcaaaagtagccctcttttgtagctatttccttctctttcttttttcccttctaaaaatttttttattaaaaaaaaataaaaaagagacatttaaaatgtctcctttaatattttatctttcaacttcagtacttcttttttattttatgctctaattaatcgttttaaacttgaagtaactaagaaaagaacaatgaaaatcaaagttattgcggcagaggctggcgcatccatataataagaagcaatcaaaccagcatttaacccaataaaactaacaataactgagataaaaagcacagccttgaaagattttcctaatcgcatcgcaatcgaagctggtaacaccatgatcgctgataccaatagagctcccgctgccggaatcatcagtgcaatcgcaatccctgtcacaatattaaaggcaattgaaatccagcgaactggaagtccatcaacaaatgccgtatcttcatcaaatgtcatcacataaagcggacgtaaaaatagaataaatccaagtagaacaaccgccgccaaaacaaagagcataattacttgcgaaagtgaaattgtgataattgaaccaaacaaatattgctctaaacttacagaggttgctcctttggaagaatttaaaattaataaagcaatagcaagacccgccgacatcaaaatcgccgtcgcaatttccatgtaattatgataaatcgttctcaaatattctagaaaaactgcagcaatcactacggtaattaaagtagtaatcgttggattccaacttaatagcacgccaaaggcaacacccgctaaagaaacatgcgataatgtgtccgacattagactttgtctacgcaggacaagaaatacaccaagtaatggcgagaaaattgaaattgctgtcgctgctaagagagcattcctcataaaatcatactggaataattcaaacatttgctttctcctctaattcttcttgcgcttcttggagaactctatcacggtcagtatgcaaatcaaaacaagcgaactttccatttttgtcttttaatagatgaatgttacgatcagcgaaatctttcacttcctcaggatcatgagtgaccattaggactgctttcccatgcttatgggccgcatgatgcatcaattgataaaaatcactacttgatacatcatccataccagttgttggttcatcaaggataaataaatcagggtcactagcaaacattctcgcaatagcaatcctttgcttttgacctcccgaaagttcaccaattcttttatcgcgatagtcccacataccaactgaatcaagagctgccttgacatgttctaaatcatgagcgcccatttttttaaaccatccctgtcttggatagcgtccactcatgacaaattcatgaacagaacttggaaatcctgcgttaaaacttgcaacttgctgtggaaggtaggcgattcgtaacttttctcctctattatttttagaagaaatcgttattttccctttctttggttttaaaatacccaaagttgttttaattaaagttgattttgccgctccattttctccagttaaggtgacaaattcgccagagtccacatggtagctaatattttctaacactggctctctatcatagtagaaggtcagattttcaacattgatatatctcatttttttctctttttatctttaatagtggccctaattatagaactatctagtgcctcttattttttattcaaaaacacgaaactcccgttcataagaacgagagtttcaaggagttttatgaaaagatatttttggaagaagttcattataattccttcttcttaattttcccttaaactcacttgattgttttcttcaaagctgtcaagttttcttgcatcaatgtgagatagttatccccattttttttctgttgatccgacaagccttcaacggtattgataccaattagatttgctccaactgattttgccaaagtttctgcaattttactatttgcatttccttcaaagtaaacatttttaagtccggctttttccatttcagtctttaaagtagcaagtgttgaagctgatggctcaacttctgggtcgagtccagcaatagcaatttctttcaaaccataatcacgtccaaggtaagcaaatgcttcatgttgtgtgataaatgttttttgcttggcattttttagagtgtcaaattcactatctaactttttcaatttgacaacatagtttgctgcattcttttcaaaagttgtcttatcttctgggaattttttccctaattcctcagcaattgtattaacttcaataattgcttgctttggactaatccaagtatgtggatctcctttaattttattgacatctttgcttgcttctattttgactcctttattattcactttcagagcccatttttcaaggtcatcagaattataaataatagcttgagcatttgtcattgttgcaacttgcttggcactcggttcaaattcgtgaacttcttgattcgccggaacaatattttcgattttaaccttatctccaacaattgctttcgtaaattcatacatcggctcaaaagttgtcacaacttctggtttgtctgctgttttttgacaaccagcaagaagtaaaactgccggaatagcaaataacatcaatattttcttcatcgaaactcctccgtaagtactgataagaattgacttatcactttttgttcttcgtcagtaaatttgtctcctaattcttggtaggtacttagagttttctcatgatgagcagcatgctctttagcaactggaactgctttttctgtcaggctccaaaggactacgcgttcgtcatttgttgcccgacttgatttaatcagttcttgctcttgtaattttttgagagctttagttaccgctgctggcgaaatcttgagttgctcggcaattctcgcgtttgtcgaaacctctgcagctagaatcattaagatatgttcttgcgtgcttgttagcttaacattactttcgcattcgccaagtaatatttcatgtttgttttctgcaaactgcataattgccccaagaaactggtcgatttgatttgctaaactcatagtatttcgtcctccataattagtttactggttaattatatagtaaagtaaaaataatgtcaaccagttaacattatttttactttactatttgataaattcttccatccttaagccgaacatcaaaacaataagttttattactaacagtttgaccaccgctagttgaatcagctgacagatctgtcagtaatttgtaagttaaatttccacaatcaaaattaagttgaccactcgttttcaaatcctttttaagagccaatgaaaccattaattcggctgtcagtcgctccttttctattttcaattgctgagctgtaagcacctatttttgcaaataaaactgtagaaataaagaaaaaattagcagtaaaaccaaagtatataaaagtatccctccttttactttgtatcagtaaatcgataaataaatactcgctcacctccattatcaaaatcaattgttatttttatcaaattttcttctgcctgaatttttgctccttttaaatcataaagcatcggttggtatccttgccctttatcatcacttttacgaaaatcatcccctactaatccgaaccgtaacttcttatctttggtcacatacaaaaaattttgattcacattgtctaattttgctccggagagttctgaacgcatttgttcacaaaatatttgccaatctttcctactatcattctggcttattttcatctgttcttcaatcattctagtcagccctgagatgactagcactgaaccagaaattgccaaaagtgctacgagacattcaagtaaagtaaatgccctaattttgagcttcaagtcgcaaaatttcctttccatggtcactaataatggttgcagtcgaatcttgtcttatttttataacagaaccatttaacgatagttccatcagctgactttctattgccatctgagctacatttaaggactcaatttgttgattttcttgtacctcttgctgacgagaattagtaagagcacttaagagaaaagtgaccaaaaagctcaataatgccatactaattaggctctcaagaagtatacatcccttaattgattttctttttatattttccactccccatctccatttgatataaaattgttttcttctcataaggtaaataaactttgattttctgtaaacttgagttcccccctttctcatcaaatataatcaaaaattctgccatttcaacctctttgggaatatctatctctttgttttcataaatcaatttcccattttcacttcctaaattttctgaactactttgtagcgctgcattctcctgacttattttgtataaattttcaaactgtaaaacaaagagtctcccttaaataaatgcactgtttgagtcaattctgctgagaaaaagagggtgataaaagagacaataagtaataccagtagagattctaacaaagtgaaggctctaatcatcgaaattgcgctgttcatttttattctggtcatagtaatcatcataggccgtgacttgcttttgcgtaatcatccccgcacttaaaagttctgataggtttggcttatcattatcatgatccaactcataaagttgtgcctgactttcaactactttaactactgctgcttcaccagttttttgaacttgtgctttttcttttatcaaatttggcacaaaaagcaaaattaaaatactgataattgccaacacaattaacatctcaatcaaggtaaatgctttttgctttttttgccaaagctttcttccgtgaattttaattaatgacaaagctttgatcattattaaagttatattttctattttcataaatttccttcctttttttaaattccagaacccatattagaataaatgggtaacgacatcgctgcatacaataagacaatcatcaaagcaacaaaaataaaaataaggggttgtattaattgcattagacggtctatcttagaaaagaattgttcccaacattcatcagcataaacagaaagctccaaccctaatttatctttaatcgcgccgtactcaatcatcaaagaaagttctggtaaaaaaatcgaaaaatgactgacagcttgctcaaaattctgaccagccttcaaacccaaatcaagtttaattccaacttccgcaaaaatgcgaattttctgctttttcatcaattctattatttgtcgcaattcaactccttgagcaattaaatttccccattctctggagaaataagcggtcaaatacaagcggataaaagaacttactaatggaactttaaccaaaaaagtaaaattagtgagtgctgaaagatgtttgaatattattattgataaacttgtcagtaaaacgattaaagcaccaacagaaaaaaatactagcggtaaatgattaattaataaagtagcaaaattatttcccttatcaatttgaggtaataaataatttttcaagccccacataattccaatgagaaataccaacaatacaactggataagttgccacttcaattaatttctttttgaccttaagctgcttttttaaatgcagttctaccaattgcatggttcctactaaattcccatgcacttctaccaaagcaagttgtgtcacaacatttttagaacaagagagactatctaaaatttcagataatgaatttccagaactgagaccttggtgcattttgaatacaaactctttttctactaattttgataaagctaaaaaattgataacttctcccaaatggaaaccattattcaaaagattccccatcagttgtatcaattttgcttgcttgattaatgctaattttttccctttcggcctcaatagccgtaagatgtccgtttgcatataagttctcaatcttttcattccattttttcggcgaccaagtgtcaaatttacttttcgcaatatctaatactccttttcccgctattaaccgttgataaacaactgcctctaatccatttttcaattcccaatcactcaaacccaattccaacaaacgttgaaccactcccttcacggaagccgcatggatagtagaaaaaactgtatagcctgttaaacttgcacgcaatacagcacgagctgtctgctgatctcgaatttctccaacaattagtaaatctggtcggtgtcttaaagaaagtttaattaattcatcataactattcccaattatatcattaacttgtaactgaataaaatcagattcaattaattctacaggctcctcaatagtgataacctgtgcatttgaaaaatgacggtgggctaagtcaaacattagtgaagttttcccagaccctactggcccagaaaataaataaagtcctcgtttacatcgaaaatcctgaagtttatcgtcataccaaaactcaagttcttgtttttggtcatgcaaaagacggataaccaatgattcatttccttcaaaatctcccactgttgaaaggcgcaaacgttttgccgaacttccctctagttcataccaacaagcacccagctgaacacgccggcgttcaccagtattcatgccagcaagaaatttaaaatgagtaagtaatgctaaaccaatctcttggttaagttcctctatataaagttcgccctaattgttgacgaatatatatcttataaagatttcctgaagcaattaaataaatatcagaagcctccatctcaattgccttttgaatgagttcttgtgcttttttctgtaccatactagaatatacgcaatttgttagtaaatgtaactaaaaatagtacaaaaaaagtcgaagaactttcgactttttttaatataaatgactaatctagcgattcaattgcttaaatcaaaagaaatcatcaaataagcttaattgattatcatcaggcataccttcaagaacgcccatattggtcatgttttcaataatggtttgtgaaactcccccacgtttacgaagttccatcttactcaaaaattcaccctcagcacgcgctgcgacgatttgttttgccacgttttcacccaatccgtccatcgttacaaatggcggaatcaaagtgtcaccgtcaatgacaaactccgtagcctcagagcggtaaaggtcaattttaccaaaagtgaagccacgctctaacatttcattacagagttccaaagttgtataaaggttagtttccacatttgtagcctcaaaacctttatccttaatttctttcatttttgatttgactgcttcaagaccagcccccatgacaccaatatcaaaggccgttgccctgatagagaaccatgcgcagtaatagaaaattggatgatgtactttgaaataagccacccgcagagccatcataatataagctgccgcatgggctttagggaacatatatttaatcttagaacaagactcaatataccattctggaacctcatgttctcgcatggcttccacatatttctcacgttcttcggcaggaattttattccacattcccttacgtacacgctccataattgtaaaagcaagaccattttcaagtcctttatggatgagatagaccataatatcatcccgacaaccgataacacttgaaaggtcggcaattcctgaacgaattaaatcttgggcatttcctgaccatacgtctgttccatgggaaagtccagaaatttgcagtaaatcagcaaagtttttgggtttggcttcggcaatcatattcattgaggtaaaagttcccatttcaggaattccaagagtcccgagttttactcccaattgctcttcggtcaaacctaaagattctgtcccggtgaaaagtttcatcactccggggtcatccatcggaatgtcttgaggaacaataccagaaagactttgcaattttcgaatcatcgttggatcatcatgtccaagaatatcgagtttcaagatattatcatgaatggcatggaaatcaaagtgagtcgtttgccattcggcattgacatcgtcggctggaaattgaactggagaaaaatcataaacatccatgtaatttggaataacaataatccctcctgggtgttgacctgttgttcgcttgacacccgtcgatccggcagctaaacggtcaatttcagcattgccataaaattggtcatagtcacgttcgtagcctttgacgaaaccaaaagccgttttttcggcaaccgtaccaattgttcctgcccgaaaagcgtaatcttccccgaaaatatcacgaacgtccaagtgagccaaaggttggtcatcccctgaaaagttcaaatcaatatcgggaactttgtctcccttgaaacctaagaaagtttcaaaaggaatatcatgcccatctttgatgagtttgtggtcacatttaggacaatttttatccggcatatcataacctgaaccgaaagatccatcatcatagcattcaaaatattgacattctgggcaacggtaatgaggtgccagtggatttacttcggttattccaatcatggtcgcaaccagtgacgaacctactgatccccgagaaccaacaatatatccgcgctcattggaacgttttacaagttcttgcgaaataatatacacgactgagaaaccattccccaaaatcgatcgcagttctttttcaagccttgcatcaataatatctggcaatggatttccataccactcgtgggctttttcataagtcaagcgaacaatccgctcttctgaggtttctcctccgtcaaagaccattttaggtgtatataaatcatcacgaacaggagtgagaacatcgaactcatcagccattttttgggtattgtcaatgacaatttcacgcgctgttttctcatcaagaaaactaaaggcttcaagcatttcatcagttgttctaaagtgagcttcaggtaatggaagaggttttgcatgctccccgtgtccttgtatccagttaatttctgccccaagaccaagtgagcggacaataatttcacgataaatggcatcttccggattcagataatggagatttcctgtggccagaactggcttgccaagcgtttttccgatttttatcaaatctttaagcgtttgttccaattctttttctgatttgaaagagccgccgacaacaagtgagcgataaagtgctggtgggaaaacttcaatgaaatcataaaatttagcaatttcaagcgtttcttcaaaagttttattaatcgctgcatcgaagacttcgccgacttcacaggctgaaccaacaagtaatccctcgcgattggcttccaaaactgaccgaggaagacgaggaagaccagcataatatttcacatttccaaaactaacaatcttgaagagatttttaagtccttcttgtgttttagcatataaagtcacgtgttttggtcgtacttttttataagaatcttcactgaccaacttggcattaagttctaacagacttgtccaccctgtgtttctggtccgtaattcttccaagaatacaaagagcaaacgcccagttgcttccgcatcaaaattggccatatggtgatgttcaagtccgatttgaaacttcttggtcaattgtcctaaaccaaaacgtttcatttcgggatagagattacgggcaaattcaagagtatcaacgacaggttgactaataatcggcagcccatttcgtgaatagttcatattcatgaagcccacgtcaaaaggtgcattatgagcgacaagaattgttccttcgcaaaatttttgaaatttcgtcagtacttcataaagcggtttcgcatttttgacatggtcatcagtaattccggttagttctgttgtaaattcgcttaaacgataacccggattaataaattcatcaaattcatcaatgggatttcctttgtgcatttttgttgctgcaatttgaatcaaatcattatgaactgctgaaagacctgttgtttcgacgtcaaagacgacatatgttgattcatacatatcaacatctgtttcattaaatacaattgggattttgtcttcgacaagattggcctcgactccataaataatcttgaccccattctttttacctgccgagtgagcctcagggaaagattgcaagcccccatggtcagtaattgcaatggctttatgtccccattttgcagcctgagcaactaaacttgaagcggacggaatcgcgtccatttgactcatattagtatgggcatgaaactcaacacgtttttcatcagacttatcttcacgaacattttgtgtcggaatttcaatcaaatcagtcaattgtagcactaaatcatttttgaaattgtcccgttgaacattcccgcgaactcgacaccatagtcccgctttaatttgtttggccaattgaatttcttcttcgccacgtaaccacttttgcacataaaaacttgacgtgtaatcagtcatttcaaattcaagaagataactgatgtttcttgttttacgtgatttgatttcgcggagttcccctttgaagacataaccttcaaaaacaacaggaccgttagtagaaaattcactgacagaacgcatcggagtgactggctcattatttttgatttcacgacccagttgaattttatctgattttacagctttgatttggagagccacacggtcaatggttggtttaggtttaatttcaacaaccgcatttgccgtcattactaagtcatctttatatttgtcgtgttcaatatttccttgcacacgtaaccaaagggcatcagataggctgtcagtaaaattatccgctccgtcagtaagaattttttcattcatggctttaacggtgctgacaatttggtcaaattgtgcaatttcttcgtccttacgaccccatttggaaatcataaaggttgatgtttcatcagccattttcaattctaaaatatgattgactttacctgattcttttcctgtaaattcgcgatgtgcggcctcaaaaacaagaccttcaaagataaccccaaagccttccccagcgatgaaagacatactggtaattggactttgtccactaatttttcgaccaaagaaaatcccatcagaaagtgccgtctctacaaattctggtttggcttctctagtatttttactttcacgttcctctgagcgttgttttttaagctccgaaacttgagcttgctctgccgtttgagcggccaagcgagcggctactttttcggcatgagcagccacctgtaagtcggttaattgttgatcaaccactggaataatttttaattttccgaaaccaaaatctgcgaatttttcttctaaaattggaaagtatttttcaacaaaaaagtccattcgtggattatcttcaaccatcaactgaattttttcttcctgcaattcaagatgatatttcttaaaaatacttgaaaaagcagaatcacaaagttcaggaagtgtcagcgcatattgataataatcattaaggttttgctcgtcaatgactatttcacggctactgacagaaatttctgtacgagcgattgtagaaaaagctgtctctgtcaattctgtcagtaatttatatgtgtcaattggtaaaatctcgtcaaaaattaactgaaagtgccagagcttacttgccgtatgcacttcaacattttcaatatcagcatgctcaaactgtctagaacgacgcaagtttggtggcattttgatctgatccatcaatttctcaaaaagattttccatgtttttcgaccctttatcttattttttctatcttcaaataaatagaatttcagttctcattatagcataaaaaaatgatgatttacatgatttttttcaagaataaaataactgacaaagctgtcagttaattcatttttacttactaatgaccgacagttctgtcagtaaaattatttgttcgttgaatgattattttcatccatttcccaaaaatagagtgcttcttccaaagtctgtgcctcaccacgtttcatataacgaatcatgtggctgaccgtttcaattgttttaaattctgctggaattcgttcaaagtgatttaatgctttttgaattttttcttcttctttaagctttttcaattgcgaagctaaagattccttttttctgacactttcttgctctaaagatagtcttttctcaaattttcttgaatcatatctaaataaaaggcaaaaagccaataaatacaaaagagagatgactagtaacagaaaaaatgatagtttgaaatagaccccgaccgctatgatagcaatgaaaagaaccagtttaataaataaagatttaccctgacgacgacgaattctctgtttattagaatgctccgaaaaaaactcaatatttcgctctacctttcattctctctgactaatcgagcaaggatccgattaaagcctcgtggatctttgtatccatgttcaaaataaaaatctgtaaactcaatatcttcaattctcaattgttgctgaatcgcaagtgagaaaatattaacatattctgccatatcactcgtttttccgatacattgtaaaccaagaatttgatgcgtacgtctttcataaatcatccaaacattacttggcagacgcccttcgagatgttcatttaataagtgcacagcatctgcatcataaccaaaatcaaccgcttgtttcattgtaattccagtcatggccattactaaatttttcatcggaacatgataagttccttgagtactcgtaattttttgccgagcttctagcaaattaatagccgcaatttctccgtctcgaacagcatctgacgcatgtggaagataacgattctcttctaataaattgacataagtcgttgagacgtcacccactgcaaaaacatcaggacagcttgtttgcatatattcatcaactacgactgcccctctatcccctaactcaacttgttgattcaaaagataagaattaggacgaaaaccgattgtaaagatgaccccatcaacagcaatcttttgaccatttgctgtttgaaccaccgtattttctccatcaacgctaatttctgttacttcagtatttaataagagacgagttccttcagcattcatccaactttccaacaaacgactggcaggttcatcaagataatcattcaaaagatttttattgcggtgaatgagggtcgtttgaattcctctatcttgtgtaattcgagcaacttcaacaccagtcattccaccgccaattactgcaatatttttagctgttgccaaaaattcttcagcctttattgcatcttccatactcttcaaaaagtaaagattactttttttatcaaaaggaactgaggtcatcgccggatatgagcccgtcgctaaaattaacttatcataatcggtaacttttgttttctttgagttatttctacggtaaaatacttttttatgatttgtatcaatttcttctatcacagtttccatctgcatgttcaatcccgcttcttttaattcttctaccgaagaatagctagattgaaaaagcacagatttttgacccgcgaggtaagaaataattccttgagaaacaaaagaaacctgattacgcttatcataaagcgtaatctcggcttctgggtattcttcaagcgcccgtaaaccagcacaaattccggcatgggagcttccaacaataacaattttcatcgtaaatctctttttttatttacttaaaatttcaatggtattaacaagttcatctttgttgatttcaacaacttcacctgtcgcacgaattttaacttcaacgattccctcagctgcttttttaccgattgttacacgaactggaagtccaatcaaatcactatcagcaaatttcacccctgcacgttcattacggtcatcaactaaaacttggtaacctttaccacggagtttttcttcaagttcagaagttaattccattgctgcttcatctttaacattgacaggtacaagatgaatgtcaaatggtgccaattctttagggaaattgattgaccagctaaatttgaattcttctcttggtgttttttcaacatagatacgggcaaattgttccaaaatagctgaaagcaaacgactgacaccgattccgtagcagcccatgagcattggaattgaacgaccattggcatcaagaatattagcattcatagcttctgtatagcgagtgcccaatttaaagatgtggccaatttcaatcccacgtgcaaatttcaaagttccacggccatctggtgaaatttcaccttcattaactgtgcgtaaatcaacaaattcttcaacttcaaaatcacgaccgaaattagcattcttgtaatgatagccatcaacattcgcaccaaccactgcatttttaattaactcaactttgcggtcagcaataattcgaacattttcaagaccaataggtccaagtgaaccaaaatgagctccaaatttttcttcaacttctgcttcacttgcagcttcaataaatgacgctccaagatggttagttaatttcacttcattaagttggtcattcccgtttaacaaaataacaattaactcatcatcagcatgataaaccaaagttttaaccgtttgttcttcatcaatttcaaggaagtctgatacttcatcaattgttttagcccctggtgttgctactttttcaagttcaagttcttctgtataagcgacatttggttcaaactggcttgttgccatttcaatgtttgcagcgtaatcgccaccttcagcataaacaatggtatcttcaccagcaaccaaccatttaccaagttcttcttggatttctgaaaggacagattctggaatttcatcaattgaagtaatatttttacttaaaacaagccatttttcgagattgatgcggtcatcagtaatcgcaataaactcttgactatctttaccacccattgcaccagcatcggcaataattggtttaaagttcaaaccagcacgctcaaagattttttcgtaagcttttttataatcaagataagtttcatctaatgaatcttggtcagcatggtaactataaccatctttcatcaagaactcacgaccacgcaataaaccataacgcggacgtttttcatcacggaattttgtcgcaatttggtaaacattgagtggtaactttttataagaagtgatttcgtcacggacaagagaagtcattgtttcctcatgagttggtcctaaaatgaaatcagaactatcacggttttttaatttatataaatcttctccgtatgtttcgtaacgaccagattcacgccaaaggtctgctgtcaaaagacttggagcaagaagttctacagcaccaatttcatcaaactcttcacgcatgatatttttcaacttttcaagtacacgatttgccaatggcaagtaggcataaatccctgctgaaacttggcgaacatatcctgcacgcatcagtaaagcatggctaataacctgggcatcagaaggcatttctcgaagggttggtataagcatttttgattgtttcataattttaaaatttcctttataagtatggttcaacttctttttttctgaatagaagacgaatagataatattagttgacaaaagcccgtagaatgtcattccatgttacagccataaagagtacaagcatgaagacaactccgactaatgtgataattgattctttctcaggcgaaagtgctttgccacgaattgcttcaataatatttaagacgatttttccaccgtcaagcactggaatagggaaaagattgacaattcctaagttaattgagagcatagctaacaactgaataattgttggcaaacctgctcttgccgcttgtccgctgagttgatagatggcaactggcccacccagtttatcaagactcggtcgtgcaatcagacttcctaatgctctgaaaattgctgtggtcgcttgtcctgcttgaacaaaaccacctgtaattttatcaaagaagcctgttttcatagattgcatgattccaacacgataactgccatccatctttttaggggtaactgccaaagtttctgatttgcctgagcggataatttcaagttttaattcttttccattagaacttgacatttctgtgaccaatttatcccaatctgctgttttagttccattgacagcttgaattttatctccagatttcaagcctgcggtgtaggctggtgttcctttttctacttgcccaatagcattagaatttgatggaacgcctccttgaataaaagttaaaacgataaaagcgacaagtcctagaataaagttattcaaaggaccaccgaaattcgtcaacatcttatggaagacccctgctgattgatattgaacatcaagaggaacaatccggacttcagtgccatcttcttcaataattgtggcatcatggtcaactgaataacgtttgatttctccaaacacttctccttcaatgaaaagttctttttcaaaatcatattcagtgattaacattggaacagtttcttctaattccacatgttctgacagattaattcttctgacaatattactgacagaattttcatctcctgaatttactgcttcagatttactgacaaccagacttgcagcttgtcctttttttatttcagttttatcatcaccccagccggccaaacgaacatagccaccaagcggtaaaattcgaatcgtgtagagcgttccatcttttgcttgatgagcaaaaatcttcggccccattcctacggcatattcacgcactagaattccagaacgttttgcccaccaaaggtgaccatattcatgaatagcgacaataataccaaaaataataataaaagtaatcagagtttctatcaatcgacttcctcctttagattagaacagtccaagtagatgcataatcggaaaaacaaaaataagattatcaaaacggtcaagaattccaccatgacctggtaaaattttaccagaatctttcacgccaaaatgacgtttaatgcttgactccacgaggtcaccaatctgtccaacaacagaaaagataatggtgaatgcaataagttttatataaccaatatgtggtaactctttggtaaatagaaaatacataattagcgcaacgacaacagctgaaacaatcccaccaagcgaaccaatcaccgttttatttggtgaaacagaaggtaaaagtttttgtgggaaacggtctttgagtgaccgaccaaaagcgtatgctccaatatctgtcgcccaaacaataaagagggctaaaaagacaatataaacacttgtttggcgtgctgtcagtaaattttgaaaaccaatccctacgtagaaagccgaaaggaatggaaaaccagcatcaacaaaagaatattttccgtttgaaagcaccattcctgtcagcattgcaaacaagaaaagggtaaagagcatcactccaccgtcaacattaagccctagccagtgttttccaactggtaaagcaagtgaaagggcggctaaagttgctaaaattccttcaaatgataataattgaagcttgtacattcgaaatagctcttgcatggcaataataacaagcaatgcgactaaaatttggaagtaagcacctcccaagagcaaaagggctagaaaaatccctcctgcaaccactcctgtgataattcgttgcatcattatttgactcctccatatctgcggtcacgcttttggaacgcagcaatcgctttgtccaattccgcttcatcaaagtcgggccaagcggtttgcgcaaaatataattcactataagctgactgccaagtcaagaaattagatatccgttgttcacctgacgttctgataatcaaatcgggatcccgaagattttccggcaaaacagctgtttgcagatgttttgataaatcttcttcagtcagtgtacttaagtcctgtccactcttagcaagttcttgaatggctaagatgatatcacgacgtccaccataattcatcgcaaaattcaaaatcattccagtattttcagaagtttctcgagccgcacggtcaatagagtctaaggttgcttttggcattcctgctcgttcaccaatcatacggatttgaatattttcttcttttaaaactggaacatatttgctgtaaaagtcaatcggtaagctcataatgaattttacttcatctactggtcttgtccaattttcggtagaaaaagcataaacagtcatcactttaattccacgtcttgcaccatgaacggcaacatcttttagcgaatccattcctgctttatgaccaaaaattcgtggtttccccttctttttagcccatcgtccattaccatccatgataatcccgatatgctctggaagtaattcttcttgttctttattttttaagttattaaacatagtacctcacatgggaattttatgcaaaaattgtatttcataaactcaccaatatactctttggttattaaagttctattgagataagagctttctgaaaaataaaattctctcatccatttcaaaactttattcgatactttctcaaaaagacagtattacttttccattttaccatattttgatatagatttgtatctcaaattttattcgtcagtattcaagttttattctttttgataaattcaaattaccgattgttctgtcagtaaataattttataaaaaaatcctgtcagtaactgaacaggaaaataaattgagtctattgcctcatcaagaaaaaataaattatttttcttcaattgggctttccacttttgtttcttctactgtttcttcaacaacagttgcttctggtgttacactacttttaactgtttttacagctgcacggtcaaaagttaaaataactccttcacaatcaagttcaattgttccttttgctgaatcaatacttgaaagaattccgtgtaaaccgccaattgttacgatttctgaacctggttgcatcgcatccaattgttcttgacgttttgattgttgtttcttttgttgacggttcataaagaacatcatcccacccataacaacaacgataaaaataagagataagcctgacatttctgtctcctttgtaagttttattcaaatttaagtccatttccgaacattcttcttattttatcatagtttgaaaactctgtcaaatcaagctttagagatgtttagtggcttcccgaattgaaagttttgccatttctttttcatgccgcccaataaattattgcacccatcttggattagtttttgctaaatctcgcaaagcccaaccaatagccttattaatgaaaaattcgtcagcaaatggagaatgagcaagattttgttcaatattataagaaagtagctctaaatctgttttttcttttaaacttaattgacaatctatcgcgattctacgaacccaaaaattctcatcttgggcccattcttttactagcttactcactctttcataagctagcccctcatcttcaaccaactttgctcgacttgccattaagataaagccaactaattcatcaagcgaatccactgtgtcccaccaagatttactaatcgttaatttttttatcttcgctaaatctgcaaaagtaagccattttttcatttgatgaagataatcgatcgccaaatattgaaattcacgttcaggcaagttccaaagttcaaaagcaaaatcccattcaatttctttactttgttttttttcctttataaattccttacctaaaagacgtctttcgggtgttttcaaaccaataaattcaaactgatggcgtaaataagccgcttgtttttccgcattttctaaatttttatttttgcggaattcttctattatattaaccatatctcattctttcatttttacttatgataagccgaacctcgatttatcatttgtgcccgataaatctgttccactaaaaccaaacgcatcagctgatgagggagagtcatccgaccaaatgaaatttgtaaatcacttcttttatagacctcatcggaaagtcccaaagaccctccaattacgaaaacgagattgcctgttccataaacttctgcttttttcacaaaatcagccaattcccctgatgacatcaacttcccttgaattgctaaaattgctaacttatctcctgtttgaatgcgagataaaattttatccccttctcgcttctttaaagcttccgcttctttctcagaagcattatccggaattttttcatcagctagctcaataatttcaagtggaagcatcgttcccattcgtttaacatattcggcaattccatcttttagatacttctctttcaattttccaacaactactaatttaattttcatctttatttttctcccaatcaaagctctatattattaaaataaggataattagacgaaacaaaagtcacaaaaatgtgatacttgttttaaagagttgcgtcagctggcaggctttaaatataaagatttggaatcaattatgtctaaaaatggaattgttaggcttgaaaacgggacttcaaatatttcatttgagagattagctgaacttttaaaatttatgggttatactttgagtgactttatgtatttatctggagaaagtcgagttgatgggggttatggtgaaaagtttcatattattcgctatcagcaaggctatcgtgatgatttttttattccagttggagtaaatcctgttcgtttgaagctatttgaaagtggaaaaattttgctaccttatgatgtgattgatgcaatgcttggactcatgaacattccggaacaggatttttcttatattatcaaaggaagtaaggatgattattttgttcattatatcaactggttggatatgatacagttaagagaagaatttgcggaagcagaaatgattcaaaatgaagcacacaaatatgcgaataatcaagaaataaaagttaagatacttgaagaaaaatttgaaactttgaactataacaatgattggcttgagctgcattcgcaggaaagattgaccagacaatacactgattatcgtgtcttagaattaactgccaaagcttgttatcaaatattaaatgaggaagaagtaacagaaattggtgattttttatttggaatcgagctttggcttgaatatagtttaggaattttggctttaaatgcttggcaactgccttattccttagtttatgcaataatatcagatattaatttacacgagacagaatataaaggtaaattaatttatcgacgtcggattgtacagactgccgggcgatgtgctatgacactcataagtagaggggaaacccaaaaagcaagtgacttattatcgatggttcataactatgcagaagcacttgatacacatgtccaaggactttatcgctttgcttgggcttatttagattataagaatggaaaaatggaaggtcaaaaagaaatgcttagagtgattgccttatttgactttttagaagttcctattagtcgtgattttgctcaaaaatattataatcgtcacgttcttaatttagaagaatcatagaagttaaaatattttctaaatcatacaaaacttgcttgctttgcctcactttttgcgttacaataatagaaaagagagtgagtagtggtgaaagctcatagggtttgtgacagtgattatcggtgataacgttataatcaatttgaggctctgattttctaggagcaaatttaggtggtaccgtgcaataatgcaccctagagcgagaggctttggggtgctttcttatgtaaacggtatcttattagataattatcacatataatgattttttacaaagactcccactcccagtgaatcgaaaggaaaaaaatgaaacttcaaaaaccaaaaggaacagcagatttattacctgctgaaactgcaaaatggcagtatatcgaagaaattgctcgtggcgtttttaatgattataatttcaaagagattcgtaccccgatgtttgaaagctatgaactctttagtcgtgccactggtgaaaccagtgatattgttactaaagaaatgtatgatttcgaggataaaggtggacgtcatattgcccttcgtccagagggaacagcatcagccgttcgtgcttacatcgaaaataaactctatgctccagaagttgtgaaaccagtaaaactttggtatgatgctccaatgtttcgttatgaacgtccacaatcaggacgtttacgtcaattccaccaatttggtgtagaatgcttaggcttgaaaaattcagcggtcgatgtagaaattattgcgatggctgatacgcttttccgtcaattaggcatttctggggtgaagctttcgctcaacacattaggggatatggaaagccgtaaggcatatcgacaagctttgattgattatttgactccgtttgaaaatcaactttcagaagatagccgtcgtcgtttaaatgaaaatcctttacgagtgttggatagtaaagaagcagaagatatcgcaattgtgaaaaatgcccctgctatcttggactatctcaatgaaacttcaaaagcttattttgaagaagtaaaagccttactcgaagctttgaacatcgaatataccattgactcaaatatggttcgtggtttagattactataatgatacaatttttgaattcattgttaattttgatggtaaagaactaactgtttgtggtggtggacgttatgatggtctagtagagtattttgatggtccagccactccagccttcggttttggtttaggtatcgaaagactcctaatgattgccgaaaaacaagaaattaactttattcctgaggaaactttggatgtttacattgctgtaatgggtgaaaaagctaatcttgaagcaacaaaattggctgagagtttacgcgaacaggcctttaaagtcgaacgtgatttttcaaatcgtaaacttggagcacaatttaaaattgccgaaaaattgggagcagaattgattattacacttggagaagatgaagttcgcacaggacaaatcaaagtgaaacataatcaaacacgtaaacaagtagaaacaacacttaaagcggttcacgaatcatttgccccaatttttgaagaaatttacgctgacgagataaactaagtcaagaaaaggctcaggtgaagagatgaaagattgtccattttgtgaggtgaaagataaggtctttgaaaatgaattggcacaggcattttatgatgcttatcctgtcagtgaaggtcatattttgattacccccaaacgacatgtcgcctcgtattttgagctgactaaatatgaaagagaagcaatcgaagaacttttagaactttctaaaagtcacttagatgaaaattttcatgcaaatgcttataatattggcatcaatgttggtcatgcagccggacaaactgtttttcattgtcatgttcacctgattccacgatatcagggagatgtaaaaaatccgacaggtggcgttcgtggcgtgattcctgaaaaacaaaattatcgataataagaagaaagagggcttaaattttacctgtttgcactagagaacagtgaaatttacatttatatgaaacgtacaaattacgcgggaaatattacagaagaatatttaaatcaaacaatcacagttaaaggttgggtggctaaacgccgtaaccttggaggattgattttcattgatttacgtgaccgagaaggaattgtccaaattgtggtcaatcctgaaacagcagcaaccgaagtggctgaagccgcggataaagcacgtaatgaatttgtccttgaagtaacgggtaaagtggttgagcgtgcaagtaagaatgacaaaatcaaaaccggtggtattgaaatcgaagcgactgctatcgaaattttgtccacttctaaaacaacaccttttgaaatcaaagatgatgttgaagtacttgatgatacacgtttaaaatatcgctatcttgatttgcgtcgtccagagatgcttaaaaatattacaatgcgtcatgcgacgactcgttccattcgtgaatatttagatggagcaggctttatcgatgttgaaacgccatttttgaacaaatcaacacccgaaggagcgcgtgattatcttgtcccttctcgagttaataaaggcgaattttacgctttaccgcaatcaccacaattgatgaaacaacttttgatgactgctggccttgatcgttactatcaaattgtgaaatgtttccgtgatgaagatttacgtggtgaccgtcagccagaatttacacaagtcgatttagaaacttcatttttgggtgaagaagaaattcaagagttgactgaagaattgattgctaaagtcatgaaagatgtcaaaggaattgatgtgactttaccattcccaagaatgaactatgatgatgccatgaatttttatggttctgacaaacctgacacacgttttgaattgttactgacagacttgtcagcacttgctaaaacagttgatttcaaagttttccaagaagctgaagttgttaaagcaattgttgtcaaaggcgctgctgacaaatattctcgtaaatcaattgataaactgacagaacaagccaaacaaaatggagctaaaggtcttgcttgggtcaaatttgaaaaaggtgaattcgctggtggtatttcaaaattcttagctgaatctactgacagctttgttaatgaattaaaattgactgacaatgacttggtactttttgttgctgacagccttgatgtagcgaattctgctcttggtgcccttcgtttaacaattggtaaacaacaaggtttgattgatttccgtaagttcaatttcctttgggtcattgattggccaatgtttgaatggtcagatgaagaagaacgttacatgtctgctcaccatccatttactttaccaacgaaagaaacacaagctttcttatctgctgacggacatcggaaagattctgatttgaaaaaagttcgtgcgcatgcttatgatattgtccttaatggttatgagcttggcggaggttctttgagaattaatagtcgtgaccttcaagaagaaatgctgagtgctcttggctttaaactagaagatgccaatgaacaatttggcttcttacttgaagcacttgactatggtttcccaccacatggtggattggcccttggccttgaccgttttgtaatgttacttgccggtaaagataatatccgtgaagtaattgcgttccctaaaaacaataaagcctctgatccaatgactcaggctccatctatagtagctgacaaacagctggaagaattgagtattaaacttgcaaacaaagatcaataaaattctcggtggccttttagataaaattggactttaccaagtattaaaatctattggcgctgaaaaaatggcaaataaattttcggcagcagttgtatatgcggttttctcatcattcgcgttgaactttttctatcagccagggcatgtctatgcttctggtgcgactggtgcggcccaagttgtttcagagttggtgacaagaattagtggtcatgatattttacccatttcagcttcgctgattttggtaaatgctccacttttcattctagcgtggcgaggaattggaaaacagtttactgtctatacagtaattactgttgtcatgagttctgttttcattcactttattcctgtgactcctttaactcacgagccagtcattaatgctgtcttcgggggagcaattatgggatttggtgttggaaatgcaatgaaatcaggaatttcttctggtgggacggatattgttagtctctatatgcgtaaaaagaccggaagaagtgttggaacattatcatttattgttaatggagtgattattttcacagctggagttctctttggttgggaatatatgctttatagtttaatcgctattttcgtcaattctcgagtacaagacgcaatctttacaagacaaaaacgtttgcaagtaatgattgttactaaaaatccagaattactgacagaaaaattagttaatcgctttaaacacggagttacaattttacatgatgcggaaggtggttatacgcacaccagtcaaaccgttcttatgactgtgattaccatgtatgaatatcaagaattcaaagatattatccaaaaatacgatgaacatgcttttgtatcaatatcggaaaatgttcgagtacttggaaaatttgcagaagtagaagattaagaacttgatattctattgaaaaaagtaaaataataaaagggagaaagccaaaaggaggactttctccccttattatatgtgaaaaaataaagggggaaataaaatgaaaaaattagcaaaagtacattttctgtacttacttgccattgcaattggtacaggaatctatgcttttggctttgttgcctttaacatggcaaaccacttggctcagggaggagtcgcggggctttccttaatctcctatgcgctatggcatattgacccctcttatgttcaacttttaataaatattccccttttaattttaggatatcgttttttaggaagaagaacatttatttacaccatttgggggattgtgagtctggctgtttggatttggattattcaaagaattagtttcacaatcaatattggaaatgatacccttattgctgctttattagccggagtattttcaggttcaggaattggattagtttttcgatttggaggaacaacgggaggaacagatatccttgctaaactctttcaaataaaaaaaggaatcccagttggtcgaatgctttttatctttgactcttgtatcttggctctttctttaagttatgttgaccttaaacatatgatgtatactttgattgccagctttatatcaatgcaaatgattaatttgattcaaaatggtggttatactgttcgtggaatgcttattatcacgaaccatcatgtagaagttgctaaaacaattatcgaagaaattggtcgaagtgcaacttatttgcatggtgagggtgcctattcaggaactgaaaaagaagtcctttacgttgtactcaatccgagtgagatacaagaagtaaagcaaattctatctattattgacccgaatgcctttgcctcagttattaatgtccacgaagttgtgggagatttcgcaccaaaacgtggtagatttaaagatttgaaaaaataaatagctcaatgagctattttttttgagtattcttaagttaaaaagggagaagttttcaaaagttgactaaattctaaatttaaactacaatagatttaaacgtccttgcctttggcaaggatatttcatcgaaatttttgagggatattatgaaaaaattatctaagatgcattttttgcaacttcttgctgttacaattgggacagcaatctatgcctttggttttgttgagttcaacatggggaaccacttggctgaaggtggagtcgctgggctttcattgattggttatgctttattgaatattgacccgtcatatactcagcttatcttaaatattccacttttaattcttggctatcgctttcttggacgacgaacttttgtctatacgatttggggtatcgtgagtctctcaatttggatgtggattttccaacggattccagtaacaatcaatgtcggtcatgattatttaattgctgctttattagccggtgtttttgccggaacagggattggtttagtttttcgatttggaggaacgactggtggagccgacatcattgccaagcttttacaaataaaagctggggttgctgttggacgaactttcttcatatttgatgcttgtgtgatgctgttatcattaagttatattgatttacgtcacatgatgtacactttgattgcaagttttgtagcagctcaagtaattaatgtggttcaatcgggtggttatactgttcgaggaatgttaattatcacgaacaatcatgccgaaattgccgaagcaattattgaagagattggtcgtagcgcgacttacttacatggtgaaggagcctattctggaaattcaaaagaaattctctatgtggttttaaatcccggagaaattcaagaagtcaaacaaattttgtctattcttgacccgaatgctttcacatccattataaatgttcatgaagtcattggtgacttcacttatccacgcagtcgctataaagtggctaaaaaaggaaaaaaatagctcaaaagagctattttttatttttatcagtgaaagaaattatcttgaaagacgtgccccttcgatttcacctgtagattttactccttcaacagaaaaactatctgcattgattccagttttgatattttccaactgtttaattgtcttgtctaattgaattaagttttgaacattgtattcaaaagtatagttactaatttctcttttggctttcttcaggtgaataatagctttttcgatttcttcagtggcttttgttgtacgcatatagaaaaccctttctatttttggaattgtatgactatttatctattcctattataacacaggctgcgagtcaaaacaacgtttcgacttttgggtctttcaaagattacgacctgataaaaagttaaatttatttttaaagaccagatgttaacaattatgatttgatgtgttgaagatgaattttttcactgaaaaagtagaaaagaccaactgtttcacggcgaaattggcgtccgcatattaccattttgcggattagggactgtgagaatgataagaaaaaaatctggaaatatccagatttctttttatttatttaattccacttacaaaattatcaagaatcgtgataatttctgcttgcgattcagcttgattgactgcaacttttacttttgctgcacgagaagctcctttaagatagtaagctgcatgctgacggaattctcgactagcaagattgtccccttttaattcgacgagacgggccaaatgtaattttgcaatttccatcttttcagcaaccgtaggttcagcaagaagttcccctgtacgcaagtagtgttctgtacgatgaagaatccacggatttccaagagcagcacgtcccatcatgaccgcagtcacgcctgtttcatcaatcatacgtttcgcatcttctggagtcttgacatcaccatttccgatgactggaatattgacattgtcagtcaattttttgagccagtgccagttttcttgggcatttcctgtgtaggcttgagctttagtgcgtgcgtgcatggaaactgctgctccaccacccgcttcaattgctttagcattttcaacggcaaaaaggtggtcatcgtcccaaccgattcggatttttactgtcaatggtcttgaaatggctttactgactgcgctaaccacatcgtaaactttatcagggtcaagcaaaagtcgagaacctgcttcattttttgttactttaggtactgggcaacccatgttgatatcaataatatcagcaactgtatttgattcaacaaatttagcagcttcaactaaagtatccacttcaccaccaaaaatttgcatagatagcggatgtggaacgccttcaaaatccatcatttccaaagttttcttgttgcgatgttcgattcctttatcagaaatcatctcggttacaacaagtccagctccgaattctttggcagtggtcagaaaagctttatttgtaattccggccattggtgccagtacaattttattttttatttcgatatcgccaattttccacgattcgttgtaaattttgtccatagtcataaagaatattatagcaattttttgagatttcacaaggtcttaaggattagaaaatttactgacgagaactctgtcagtaaatttattgaacctatactactagattaaaacttacattgatttgtcaaagttattgaatgcgagcagattgaaaagtaaactgacaagggcaatgaaaattatgccccaaaagtaaacttttttatagtttttccattgagtgattaagaggtagatggcgcttaggaaaagtatagttggagaatacatggcgaaaattcctgttaattctgcccagaaggccaaaaaagaattattccaaacattttcatcattagcaaatggtccaaacaagtaaacggcgccaacgaaattgaaaacgccaataatccgtagataaatgacaaaaaaacgggttaggttttcatgagaaataaacgtgacaagccaacacaaaagcgccaaaataatgctgacaattaaaaatacagaagtttcgatcatttgaccacctgcccaaatttttgtaatttaaaaatcaattattcaaggagtgaatgaaacaactttatcgttataaaatacaattccatagacttttttggaatcgcccaactgaaaaataaggttcaaatgatgaactctgtcaatatattggagataagttgcagattgctccgccccacgaataatataatgcttgccaaagaccgcactcacctcagaaacgctttttccattaaaattttcgctatttaaggttagatattgaacgaggtatccattcgttatggaaatagcagcaactttcttttgatagctgatagcattgaaagattggctatcgctatccgacattcctttgtaccaccaggtcttaaaggcgccatgtgtgggaatgagatcgagtccgataataccgtattctgtgttggggacgagttctttatgttcttgttttatcgtttcttctggcgcgttaattttaagatttgccaaagtcacatgactcaaatcagtcgatttttgcaaaggggcgttttcataagtaaactagagtgcgacaagtaaaaacgggaggaggacgatagacccaatgatgatttttttcttcatgattatctccttaagctccgctattgagaaccaatagattaaatagcaagttatcaagtagaatagagattattccaaaaaagtatatttttgtcatagaataacctcactttttatttctatttcttgataccaaaatgataacaatacatgcgacaaatggaattccaaagtataaagttgtccaaagccaagaaagattgggaaatttatcgtttaagggattaaaaatcaaagtgttgaatactccaaggatagctgcccacaagaaagaccagaaaactatttttttcatttgttttccttcaattacttttttgaattcttatctttgattttgactcgatagcttacataaatcccaagtattaaagctgtaattagagtaaatagtagccatagtttgggaaataattctttaaaataaaatgtgataaacagagctacaaccataagcactctagagataatggtttcttttttcaattttatctccttaaattgtttttatgcagaaatcacaagattacttgtaggtcttatcgaaaaacattgtaacaatattcactatcaacaaggcaaatcctaatatgtaaaatgatgagtttctaggaaagctgaaaattaagataaaaccaatcaagactactatcaaccttattattctatcgaccgtttttttactaaacataaagccccctactattattattcttacttaagaatttaccgaagtttcctcgctttttaaacttatattgacctaatttaaatatttttgataactcttggcatttgtaacatcaattgttttatttccaattttaagacgtgtgttatctagccattttagcttgatattttcccaagttgagctactttccgtgtcagagatgctgtaaacagtttttgtattaaaaaacggaagcaatgcttttttgtttgttactttcacagtatatggaccacttccaaaaccacctccatctgcaaattgcgcttttgcgacatattgcatattgggagaagtagccgtagataatgtatctgttgagctcacagcatttgaaaataatgcagcaatcccccaaagaacaaaaaatgttacgatgacccctgaaaaagttccgcctaagaaccataagattttatgtttatttttcatgctcaaccccttccatagactagcaaaataaaagcaactccaagaatagcaaacgttataacaacaacgacaacaagtccccatgcataccagaaaattgccttatgttcttttctcaaaatctaattctcctattgtatagattgaatccataagctatcatcgcactatctcttggttggtcaaaaaatgaaaatggaccgtatttcaaacctccgtgtgcaaaagaatatcctgcctctccggctcttaaaacagcttcaggaattcctaacacacgtcccatatagccgtaatttacattggttacaccagcaccaatggtttttcgtccatatacgtagtaggttccagagtaacttaagcctcctcctttttttgttgtcaagttccattcaccatttccttttactaaagcggtaaaagctcctattttataagaattggcaaaagcaccaaatgttacatcaactttgtttttaatgaaaggaatcgggatataagatttaaattgattggattttgcatttaaacttaatgctagtttataattatttctaagaatagcagcaacacgtggtgttgtatagtttgcaggttgtttggaggcagctagtactgtaatagaaccaaataatgaattctttgctgaactttcttgctccatgtttgtatctgatacactcgttttttctgcctctgaaacagaattatcaatcagttgttgtaaataaatctgcgataggctaaggatagtcatcaactgacactgcccctttttcttgggtttccttttggatgatttgatttgcctcattactggaaatgctcttcgctgatttatcagaaatatttgctgccatttgtatgttaacatcaggttgggaacttttatcaatttcttgtgtttcaatttgaattttactaatgagcttcgcatctgctactgagatatttgggtttgagccataaacaatctgctccgcctttgcaggcaaatgcccaacactaaagatatcaggacaagtaagccagtcgttacaataagcgagccttttatctgcgaattaggtttcattttatcaggtttacttggtaaaagtgtgaatattagatagacaatggctagcacacctgaaataatcattgcccaaatttgcgtaaattcgccgagaatgatgctcacagggaaaacaagccataaaaatggactcaaacctatatcacgaattcgacgcatagcgagcgctgacattggaacaatcgaggcaagtccccagacgaagagcaaaataagcgcaatccaagtaactgctgaaaaatggtccacatcagccgtcaaagccactgaaagtcctgatgacaataaaaatgttgttgtcaggacaagatatatgatgagattaatcaagaagacccaccaataggccgaccgactcgaacgatttttgaaatcaaaggactggcgcgaaaagttttggtaagcagcgagcataagaaacctccatatttagttattttagttttattatactcttctatcgtaagcgttaccatagtgtttttgttttaatacaaagtagttaattttaaagaatcatgccctattttatggctacaaatgccgaaaaattaactgttttagttaaaaattaacttctttatttttgtcagtaacttttatcaacaaaaaaatactgacaaatcgtcagtatttatttgtttactaaataatgtaattcaacaaattgcccgtaagttctagtatcaatcagttgaagtttctcttcataatttcctgacggaaaaagtgggattccatctcctagtaaaactggggcaatggtaacttgtaattcatcaacccaatgattttcaagaaaaagtttgatgacctccccgccgccaacaacccagaagtttttgtcattatccgcaaaagttactgacagctctgtcagtttttctttgtcaataaaaatgatgctgtcagtagcggagatttcttgatgagttaaaatataagaagtattgtcagcataaggccactgaccagcttgctctttttctaaccaatcataagtctttttccccataatgattgtatcaataccactataaaaagcaccatagccgttatctccttaccctcaacatcaaaaagccattgaagactttcttctttggtggcaatatagccgtctaatgtagaagcaataaaaagttttacagtcatttttctcaatcctattttactgacagaagttttgtcagtaaaataaattattatattagttaattagtgcttttaattcttcttcggaatattcatatttgttttcacagaattgacaaataatttcagctccatgatcttcagcaatcatttcttcaattggttctcttcctaaagatttgatgccctcaagaaaacgttccttactgcagtcgcatttgaatgccaaaggaaattcgccaagatttttgtattccatatcaccataaatattatccaacatggtttttaatggttcgtcacttgtcagcattgttgcaatggaaggcatacttttgatattgtgttcgatttcagtgatttcttcatcggtggcatcaggaagggcttgtagcataaatccaccagcgattttaacagtatcagagtcttcattaagcaagacattgaccccaacagaagaaggagtttgttcagaacttaagaagtaccaagctaagtcttcgccgatttcaccagtaattaaatctacttgaccactataaggctgtttgaggcccatatctttgacaacaactaaaaagccattgccaacgaaaggagcaactaaaacctcgccagtagaggcttttttatagtcgagttcccgatttttcacatagcctttgacatgacctttgctgtcagcaacagcaataattgggcccattgcgccatcacctaaaacctttacggtgattttagtatctcctttttcattagcccccaggacttgggcagcaattagggtacgtcctaaagcaacagtagaagtaggccaagtttgatgccgttcttgtgcttctcgcacagttagggttgaatctaaagcaaaagctctgaaatgcccattttttgagattgatttgataattttatccatatcattattataacatgccctatctatcgaccgcaatagaatctaattaattttaataagaagtttttaatagcaaacttaaatatttttatattaaacatttatttagtaaaatgaataaaagcttgctcctcattagctttaagaggttagaagaggttactatgttttcaattatcatcaattctacgattatctattgggcaacggctttagacttactgatactattagctattttatatgtgcgatttgataagaaaagtcatttatcgattactctgggtcaaattattggttcaacggcccttgtagtagttagtttgttctttgctgtcattttaaagctcgttccagaagagtggattttgggcttgcttggattaattcccttgggactggggattaagtacttgttttggggagatgatgacgacgatgaagaattagatgagttactacaaaagagaaaaaataaaagtttactaggaactgttattattatttcttttgcaagttgcggtgctgataatattgctttatttactccattttttatgacactttcgccaagtaatttgatattgtcaatcttcatttttattctaaatattttaatactaggactactcggaaaaacaatttctaaaatcccacatctccatgaaattttagaaaaatatagtcgttggattttggcttttgtttatatcgtacttggaatcatggttttgatagaaagtggaacgctctctaaaattatcagccttttgtaagaaatctattgattaaacaaaaagttcattatttccgaacgataaattcattttaatcaaaaacatcaggatttccaatgcaaatcttggtgttttttgataaaataaaaaatagtgcgataggagctttcagaaaaatattcaacttttattctgataaaataagtcaaaaagtcgaagaaaatttttagaaatgccagccaagcgaacttggagcgtgcaaaatattttaaaatgaaattgagttcgccctcctaacttctacgaaaatagataaaaatgggaacctgcctcaggcagaaccaccatctttcctaattttctaggaagttaagcagtcgggctcacatcttaaggagaatattatgccatcagtagtagttgtcggaacgcaatggggagacgaaggaaaaggtaaaattacagatttcctaagctcaaacgcagaagttattgcccgttatcaagggggagacaatgcaggtcataccatcgtcatcgacggcaaaaagttcaaacttcacctcattccatcagggattttctttcctgaaaaaatttccgttatcgggaatggtgtcgttgttaacccaaaatctctgattgaagaaatcgcttatctagctgaaaatggagtttctgcaaacagtttacgtatttctgaccgtgcacacgttatcttgccgtatcataaaaaattagacttccttcaagaagaagctaaaggtgataaaaagattgggacaaccattaaagggattggtccagcctatatggataaagcggctcgtgtcggaattcgtattgcagacttacttgacaaagaaatcttcgaggaacgtttacgtacaaacctcgaagttaaaaaccgtgaatttgtaaaaatgtatgattcagaacctcttgaatttgaagaaatttttgaagaatactatgagtatggtcaacaacttaaaaaatacgttacagatacttcggttatcttgaacgatgcccttgatgcagggaaacgtgtcctttttgaaggggcacaaggggtcatgcttgatattgaccaaggaacttatccatttgtcacttcatcaaatccagtagcaggtggggtaacaatcggttctggtgttggtccatcaaaaatttcaaaagttgttggtgtatgtaaagcctatacttcacgtgtaggtgacggtccattcccaacagaactttttgatgaagtgggacatcaaattcgtgaagttggacatgaatatggaacaacaactggacgcccacgtcgtgttggttggtttgattcagtcgtaatgcgtcacgcaaaacgtgtttcaggtttaacaaatcttagtttgaactcaattgacgttctttcaggtcttgaaacagtaaaaatctgtgtggcttacgaacgtagcaatggtgaacaaattacccactatccagcctcacttaaggaattggcagattgtaagccaatttatgaagaattaccgggttggtcagaagacattacttcatgctgtactttggaagaattaccagaagctgctcgcaactatgttcgtcgtgttggcgaattagttggtgtacgtatctcaactttctctgtaggacctggtcgtgaacaaactaacgttttagaatcagtttggggcgtataaagtcaaaataaaaaagtcagagcatgctctgactttttttgtttacaagaagggtccaaagacttgtggactagaatttttattattgacgttgacatcaattacattgtaaaaggcattagaagtgtcagcaacatcccagacggccaaaacgatgtggtaacctgaacgatcatttggaatattgattgtatgtgagagattgttcgttgcaggagaaccatcgtggttgattgtcactataagttccaattctgaacgttttaagggtgcattttgatcccaacctgtcttggtcatatagtagtgccacttcgttgttttatgaggggcagtatatttccaagtgaaaatgttagaaccggtactaatagatgtttttttccagcgtgaactagtttggttgtctagaacaaagtcgcctatttgccccaaacctccatttgcagaagcaattcgaccatcagcggggccagactctgggaagccttttggtgcttctaaagattgtggattactaataacatttccatagatattaaaagcatcagtccaccctaaattttgataatctaattgtccttggtagcctctggctggtggagattgaacatatccgtgagcagaaacagaatctgttttaatgaaaagtgagacgctgagtagaccagcagtaactaataaaccagtaagtagttttttcataaattttatccttttctattttagagttttttccatggaccaaaatctcctgattgatcaggctgttgaccagtattccaccattttgcttcataatctactccattaaaagtaacacgatccccttgaacataaattttatctttttgccaaatattattttcctctgacgtatcatgagttataaatgtggcctttgcagtatcagaacgattacctgaagggtcaactgctacaacttcgacattgtattcagtttttggggatagtccagtcacgttttgtaagccagaagtgcttttaaaagattgggtaccaatcttaatttcatagtaatcaatgcgaaccttatctgtagattttccttgaatcgtggcagttgaatcagtcacattattaatggaaattgttggtaaggttggcttttcagtatcttcaatcggttgattgttaaagagcatgggggcgtaagtatttacaaaagtattattatatttttcaccatttgaattgcttccagcgtcccaatttaccgaccaagtcatcaaaccttttatttcattaccagaagcttttaaacgattcaaagcatttttaacggcattagggtctttcacataacctgttgcggcagcgtcattattagatgggaggccaatgacgaatttactagctggaattttaataaacccatccgttcctgttacgagacgtttagttaaaccatacagaaagtcttcctttttttcgtcatttgattgagaaatccacatatttaaatcactatcccaaaaaccatcccctccttgattatagtattgaggattgatgaaatcatagtatgaatctaaattgttgatatatggagcatattttcctgaacttgttaagtaaggaaattcgggagccatcgtaatcataaagtttttaccatcttttcgataatggtctttaactgtttttaaagcagaggggataacagtttgattatctgctgcttcaattgcaacctgttctaaatcaatatctaatccatcaaagccgtaagtatctacaagacgaatgatttcattaacaaaatcagtttcttgacttttctttaattcaatatgagcgtcagctcctcctaaagcgattaagacgctcttaccttcagcatttaattttgaaacttcggctctgaattcagcttcagttttgttgtaaggcttaaatgtgggaagtgtttgtccttcaggtgtcttcataaaggaaacattaattacattatatccttcttgtgtatttgaaagatcgaagtcagcagaaatacctcctttataaccatcttttcctgtggatttccaattgtgccaataacctacaagtactttatcttttggattgaccatttcactcgctgcatctgctaagactcgctgccctcctaacgcaacaattcctatagacgctgttatcaaaaaaactttaatgttttttcgttttctcactgaaatcataaatatctcctaaattgtagtgattttaaagattccggaatcttgttctgtaagcgctgacttcattctaacaatttttttccttaacttaaaataaaaaggttcgtaaaaagatttatttacgagaaataaaaaacactaatattttgaaaatattagtgttttttttatttcaaatctttaagcaatgagtctaaccattcttttttgaaggtttctctttttatagcaaaatctaaaacaagataatgaccgctctttttattttcctcagactcaccaaaaagatttttttggcgtctaatgagatagtccaattttttctgatgaacgatgctttcttcctcgattaatttaaggaggttttcttcatttttatcatcaaggaaataaagacggagcataaactcgtccttttggattgggtaacgatcaacgggatgtttcaaccactcattgaaaagttggattccctttggagtaatttgataagtttttttctctaacttttcacctacgatatggacgtcaaaagttacagcctgatcatttaataatactctcaatgaaggataaatttgccctgtattggcttgccaaaattcccccacttcactttcaaacttttttttaaggtcgtaaccgcttaagggttctgtctttaaaagtcccaatataatataagataatttatctctatggctcatattttttctcctttatttccatgatacacaaaaaatggtaaattgtaaatttttgacgtagaatttaaacttcatttttaaaaaacgttccaatccattataaataacaaaatttaaaggaacctaaagtagtaaacatattttaatataagactagacccgaatcttgacttaacgtcagagtattaatagagtaaggaggatgagtaccaagagactctgtcttttggtgctttttaagttatgattatactaaatcagtctaaattcatagaggttttagatgatggactttctttttatgatggaaagcatcaaaaaataaaacgttataccaaacagatatggataaaaattttagagtggtatcaaatagcgcgagaaattgatgatattccgaaatgtattttgccgaatgaggaaatggtagcacttcgagaagttctattgactttacatattttaaaagaaatcgaaatggtcccaagacacctcgagagaatttataatttttatagcacttataatgcaagtaatttagagagaatcagtaatataagagttatgatttggggatgtggaacagttggtacagcaattgttgataatttagttaaaatgggagttaaaaattttttacttattgattcagatatcgttgaggaaaaaaatattattgcccagtcaatttttcagaaaaaagatattggtttaaaaaaaattgaagtgataaaaaactatgtagaatcattcaatattggaaaaaataatgttgaaatcagcgataaatttattaatcacggagaagagttcatgattaattatcaagaattttatcctaattttataattgattgcgctgatacgaaagatgaagaattagacattcagtttataaaatttgctgagcaacttggaagtgtatatatgtcaactggctatactgatgaccgagattttatttttgtaatatcaaaaaactttgataaatttagaatgtttatgagaaataattgggcaatttctaaaagaaaatatcagatttcaagcaatagaggaacgattattgactctcaacttctgggaagtttaggggcacgtagcattatcaaccatgtctgtgccctcaatcagaatgacagagtaattgaaataaatttattggatataacaatgagagacgtcccatttcgataaacattttggataaatcgactgcaagtacactaagtaattaattataggaggaattgtgaaaaaatattttacacaaaataaactattaacaatttttttgatgtttctttttggaagtttagcaagtggtacgttgacttttatgatttcgtggacagtattaaaggagacacatcaggcctctcaatttgcgctattgtctacaatatcttctctcgtaatgcttattgctatgccagtaatcggaataatcgttgatagatacgaccataaacatttgcttgtgattgcccaagtgttcagtttgtttgtttgttttactgagctttatttttcaaccatttcatggtttaataatttacattcttttttctattggtcttaatttaggagatctattattttcaattacaatgtatgcttctgtaaagtcgctatcagatgataaaactgaaatgtcaaaaataaatggcattgaacaagggataggggctttatttgccatcgtttccccagcggtcgctgggtttactcttactttcatttcagtcagaattttttcttgggttgagatagtctgtgaatctattgttgttttgttagtatttcgattaaactttgagaggtttgatacgaagaatgaagaagagagcgttagtgttgaaaaaatttcatataaaagagttttacagcttttaaataaaaaatatattgtaatgattattgtttccatcatgattgttcttaaatttttattgggttccattaatgttggaattccgtttattttaaacaacaattatcaaggaaatacagtgatactaggcattgtccagtttagctttcctcttggaattattttgagtagtttattagtacaaaaattacctaagtttcagctttttaaattgctgaaaatttcatacttttcctgtgcttttgttattttctcatttggaattattttgagctttttgatagggtcaatagtttttacggtagttgttttatctgtattgatgttatttatgggattaggtttaggcttttctagagtaccaatgatgacctttgctcaaaataatattcctgaaaatatacaaggaagagcgttctcaattatagatacctctgctcagattctttcatcactcggtttaaggttttatggagtattgtttgataatttttcaggaggttggatttatctattttcttcatttttgatgtttggggtattaatagttggattttggtttgttgacagagcagataaagaaaactatatttactgagtttttactttagagaatttgactctttgagcaatataataataaagcagcctgagagatatgaaatcttatctgcgactaatttgaaatatttttcttctaagggtaccataaagtgcgattagagaggtacattttaattagggaaggataattctgaattcttttcaattttataagagaaaaagtttaacgattaaaaaacccatcagttaggtctgataggttttttaatgggtaaaggtcatcacaacaaggatgaggtaaataatcaaagtaataaagaaggtcagtcgccaccaaagctttaaaaagcggcggtaggcgaattgtttataatagaacaaatcaagtaacaacaaaataagtgctaaaccagaaatgattagcagatagtaaggaataatactgatacttgttacattttttgaaaagatttgcattcctagaattagaaaaagtgtgaatacatctggaatttttaatttacgattggttaaatgacgtagtctgaaaaacttgaaaataaagaccaacgcaataaagacgataagcggatatagcgccataagtacttttataaacatagactaattgtagcggttttagactagtttgtaaagtatttatttgtgtgagagagtgcacgtatcagtgctaatccaaagattgtaacaaggatagctttaatgatttcaacaaatacaaagggagtgaatccaagctttaatgccaaagaccaatccacttgagtgaaaaatttgagccagagagtgccgatgaccaacattaggagatgaccaacaatatttatgataaaagctgggattgttttgtatttgatttgatgaagtccccaagaaatgagggttcccatgattaaaaaagcaagtagaaatccaccagttggtccaaaaagaacagcaattcctgaagttcctccagtgaatacgggaattccaataaatccgagaagtagataaagtaaaatggcaaagaaagtttcacgtgctttgagtactgtggcaacgagtccgacagctagtgtttgtaaggtgactgggacgataccaattgggatagccaatggagaaagaaccgcgataatcgctgcaccaagagcaattagggttaatgaatataattttgtgttttgcattccgagtcctttgttttatgtataaaataaaatatactaaaaaagaagaatttttgcaaactattgctccaaatatacaaaaaaatactgacagaatttctgtcagtatttttattctctgatttcaacaaagtgagcatggacaaaatctgctagttcttggggagcaatttttatactacgtccaacttcacccgcggaacagacaataaagtcatgttccaaagcaatggaatcaatataaattggaaactttttattttgccaaatgcttacgggattatttgccccgtgaatataacccgtggttttttgtaggtctttttgaggaatcatacttacttttttgttgcccgaaacttttgctaattttttttctgacagatgctctgtcaaaggaagaataccaatgacaggtcctgttttatctccaatcaatgcgagtgttttatagatatcactacgattaatatcgtcaggaaggctatcactttccaaagcattgatggcaagtccagtatgctcaattttcgccttatcaagaatttgttctacaagtgttttctttaatttttgctttttagacatagctatattatagaagattttattctgactgacaagatataataattttactaacaggtttattagtaattactatggataaaaagtttagggaattttttgacaaaaattattaagataacaaaggcagcaatggccgtcaaaataccgctgattccattaacagcaagagaataagcaacagcgccccaacctttccaagcatattggctccagaaaataattccggcaatgaaatggaaaaagtatttaagaagaacagcaacaaaagttcccaaaagtacaggtgctagttttagaggggctgttttttggcggaaaaggccagctattccgagtgaaacaggagccacaagatattcaatgaaagcttgggataggcttaagatataagcatgtccagtaatcattgaaagaattccccagattaatcctccaacgagaccagcggttaaacctcgtcgtaagctgagaagaaggatagggatacaggcgatttcaacgataatccaaccataaacagtatttggaatgaggctgatgatgaaggcgagtgccgccatgaaggcaatttccgttaataaacggacattgaacttagaattagacataaaaaaactcctttttgatgcgcacaaaaggagggttagaaattagacgattgtcttaacacattcctacgctggcattacccagatcaggtcagatggtatttctcgctactgacagacttgtcaatagacccattgtgcaaatatttatttttacaagtttaagtttagcataatttatgttgaaaagcattgatgggagatcagaattctattttataaattaaacttaaaaattttttaaggcaacataaaaaatcaataattcaaaaaatttgaaagtctgttagaataaatctatacacaaattcggacaaaataaaagcggtcgagtaagtaattgtgaaagtcagtacagagagcttgtagcggtgagagcaagcctgaatgaagcaatgaaaatggcttgataagcgtagcaaaagtgaggttttaccaagcttttgacggcatggttctcgttattgaacttaaaagtttgcttttgtaaagtttatctgaaaattttcagtgagctacaaagtgcttaaatcaagaatggtaccacgatatagctcgtttctttttatgaaatgggctctttttgtttagtcagattgtttttgtttgacgaatttgtttagagtcagaaaattggcaggtgcacggttaattttctgatatgatgcaaaagtttatcaaagggaaataattgattttgaaaaataaatcaattagaaaaaagggagaagaaatgaatccaagaaacagaaatattttacttgtcgttattgttgttgtaattgttgctatcgctgcattcttcggttttaatcacaaatctggcggaagtaaaacggcaaataaaactgtgaatattggaataatgacaggaactaaagaagatgattccatttggtctactgtttcaaaaacagccaaagacaaatacggaattactttaaaatttactcattttacagattatacacaaccaaatacagctttgaaaaatggcgatattgatttgaatgccttccaacattatgctttcttaaatgcttggaataaagctaataatggtgatttgaaggcgattggaaatactacaatttcacctattcgtctttattctaaaaaaatcacttcattgagccaaattaaatcaggagatacaattgctgtaccgaatgatgattcaaatgaaagccgcgcgctttatgttttgaaaaatgctggtctgattggcctttctgtatcaggtgatacacttgcgacggttaaagatattaattctaatccaaaaaatttggtcataaaagaattagatgcggcacaaacaccacgtgcgcttgattcaattacagcagcagtaattaatgacgattttgcaacaacagcaaaattaacggttgaagagtctatttatactgaacctgtaaacaaagatagtgagcaatggattaatatcatcgttgcaaataaaaaagatgaaaataacaaaatttataaagaagtagtcaaagcttaccaaactgaagcaacgaagaaagcaattgaaaaagcttatcctgataagagaaaaattgctgcttggggattgaaactcgactagcaaattcgttgacggagtaacggttaggtcagaacttcgggagtttctattttagaaattcttgccttaaggctaataaattttactgacagaagacttaaactgttttcaaaacagtttggtcagtagaaattggagaaaattatgaatcctagaaatcgtaatattattattggaataattgtggttgttattattgctattgctgctttcattggctttggacatcaaactaaagcaaataaaacagtcaataaaacagtgaaaattggaataatgacaggaactaaagaagatgacagtatttggcaaacagtatctaaaacagccaaagataagtatggaattactttgaagttcactcatttcacagattatacacaaccaaatacagccttgaaaaatggtgatattgatttgaatgcttttcaacattatgctttcttaaaagcatggaataaagcaaataatggtgatttggtggccattggtgatactgtaatttcgccaatcagtgtctattctaagagtcttaagactttgtctgatatcaaagagggcggaactattgcagtaccaaatgatgcgtcaaatgaaagtcgtgcgctttatgtcttgaagtctgccggcttgattaaattggatgtttctggtcaaacgctcgcgacagtcaaagatatcacttcaaatccgaaaaatttggttattaaagaacttgatgcttcacaaactgcgcgtgctttagattcagttgacgccgcagttatcaataataattatgccgttactgcaggtttaaagaaagctgatgcaattttcactgagcctgtcaacaaagatagtcaacaatggattaatataattgttgctaacaaaaaagatgcaaatagtagcgtttataaagatgttgtcaaagcttatgaatcagaagcaaccaaaaaagccatcgcaaaagcatatccggataagagcaccattcctgcttggggcttgaaattaaaataatttcttttgcacttaattgtttatcagcatcacaggaagttagagttactgacgaaatttcctattttctgatgaatggatgagttttcctgagaagtaaatgaaagttctctgacagctttgtcagtagaaattggagaaaattttgaatcctaaaaatcgaaatattatcattgctgttgctgttcttattcttgttgcgctggttgccttctttagtttgaaccatcaaggcggagtgaaagcatctgctggcgaaaaaacagtcaaagttggaattatgagtggcgacaaacaagatcaggaagtttggaaatcagtagctaaaaccgctaaagaaaaatacgatttgaagctgaaatttgtttatttttctgattataatcagccaaatgaagctcttctgtcaggagatattgatatcaacgcttttcagtcttataattatgtaaaaacatggaataaggcgcacaagagtgatattgttgccgtagggaatacttatatcacacctatgcatatttattcaaaagaaattagcaaattgtcagatttaaaagagggttcaacggttgctattcctaatgatgcttcaaatgaaagtcgggcattgtttgtactccaaagtgcaggtttgcttaaattgacaactagtgattcaagtaaactggtgggcttaccagatatcacagaaaatcctcatcaattgaaattcaaagaagtggatgcaagtcaaacaccacgtgctcttgattcagttgctctttcggtggttaattataattatgcgacagccgctagtttgccaaaatctgaatcagtcttcatggagccacttaataaaacttctgctcaatacatcaactttattgctgcgacaagtaaagaaaaaaataataaagtttataaagaagttgccaaagcctatgcttcaaaagcaacagaaaaagcaatcaaagaacagtatcctgatggtggagaattgcccgcttgggacttgaaactttgaataaatactcttcagcagctgaggacaaaaaattattaagctcctagaaattgtgaaagaagaaaaatatggggaaattagcgattgtaacgggaagcggacaaggttttggggaaggtattgtctatcggttagcaaaagatggatttgcggttgccgtagcagatattaatcctcaaacagcaaaaaatgttgcaaaaactttgatagataaaggatttgaagctaaagcttacgtgcttgatgttgcgaaccgttcggcagtttttcagcttattgaacaagcggtgagtgattttggtgaacttgctgtatttgttaataatgctggggttgcttttattgatagcattatagattctgattcagaaagggttgaacgactatttgatgtcaatatcaaaggtacttattggggaatacaagcagcagctacccaatttaaaaaacaaggtcatggcggacgaattatcaatgcgtcttcgcttgcaagtgttgaaggttctgccttgcaaagtgcttattctgcttcaaaatttgcaatacgtggattgacacagtcggcagcgaaagaacttgcaaaagaccatatcacagtgaatgcttataatcctggaattgtacgtaccgctatgcgagatgagattgataaaaaacggctcaaatcaaaggaattagcattgaacagcaacgacagaattgtttgaatgaaatctacctcggacgtgaaggaagaccagaagatgttgcagaagttgtggcctggttcgcttcagatgcagcagaatatattacaggacaatctatcttagtggatggcgggatgagattccattagcaagaaggaaaaaatatgaatgtaaaaaatcgaagaatattaattacgattattattcttgtattcattattatagtaggcgggatttttgccttttctcacagtggtaataaatcaaaagtttcttcaaaaattgtaaaaattggattgatgcctggtggtaaacaagaagatgtcatttggaaacaagttcaaaaaaatgctaaagaccaatttgggattacattgaaatttgtcaattttactgatggagatgagcctaataaggctttggtcaaccatgaagtagacctcaacgcctttcaacattatgcttatttgaaatcatggaataaagctaataatggaaatattgtgtcaattggtgatacaattattacgccgattcatttatactcaacgaaatacaaaaaggtcgatgaaattcctgataaaagtacgattgccattccaaatgatgtcacaaatgaaagccgcgcactttatgttttaaaaaatgcgggactcattaaactagacacctctagaggagtattagcaacggtcaaagatatcagagagaatcccaaaggattaattatcaaagaaattgatgccagtcaaacaccacgtgcgcttgattctgttgctgcagcagtcattaattataattttgctatttcggcaaaaatttctgataaagaatcaatttatcaagaaccattaaatgaagattcggctcaatggattaattttattgcagcaaatcagtctgataaaaataataaagtttataaagaagtcgtcaaggcttatgaacaaaaaaatatcgctgatatcatcaaaaaagaatatccagatggaagagaactccccgcttggaatttaaaattgtaaataagaaaactcgtctttgacgagattttctgtcagtattaacaaagctgaattttactgacgaaagttaaggaaaagctttgtcagcactgacagagaatgaaaaagataaaggaagtaagtatgacagcaattattgaattaaataatctttctgtgcaatttcatcagaaaggacgattagtcacagcagttaaaaacgccactttacacattgaaaaaggggatatttatggtgtgattggttattctggagctgggaaatcaactttggttagaaccatcaatctgcttcaaaaaccaaccgaaggtcaaattgtgattaatggtgagaagatttttgatagtgcaaatcccgtgaagtttacaggtgcaaaattacgtgaatttcgtcaaaaaattgggatgatttttcaacactttaatcttctgagtgagaaaactgtttttaataatgtggcttttgctttgcaacatagtcaaatcgaggataaaaacgggaaaaaacgttatctcacaaagaaagaaaagaacgataaagtcactgaattattaaaattggttgatttagcagacctttctgataaatatccggcacagctttctggaggccaaaaacaaagagtagcgattgcgcgtgctttgactaatgaccccgaaattttgatttcagatgaaggaacctcagccctcgacccgaaaacaaccaatcaaatcttggatttgctcaaatcccttcatgaaaaattgggaattacagtggttttgattactcatgagatgcaagtggttaaggaaattgctaataaagtagccgttatgcaaaatggtgaaatcattgaacaaaattctttaattgatatttttgcgcaacctaaagaagctttgaccaaacaatttattgaaacaacaagttcggtcaatcgatttattgccagtctttctaagacagaacttctggctcaattagcagatgatgaagaattaattcacttagattattcaggttcagaacttgaagacccagtggtttctgatattacgaaaaaatttgatgtaacgactaatattttctatgggaatgttgaattacttcaaggtcaaccttttggctcattagtcttgaccttaaaaggttcaagtgaacatcgagctgccgcaaaggcatattttgttgaaagacatttgaaatttgaagttttaggtaaaattgaaaggacggtagactaatggcagaatggtttgcacatacatttcctaatgtagtttatttaggatggacgggcgagacaggttggtggacagcaattgttcaaacgctttatatgacatttatttcggcacttattggtggcttattgggattgattttcggaattggggttgttgtgactgctgaagatggaattacacccaatcgaccattattctggattttagataagattgtctctatcggacgcgcttttccctttattatcttattggcagccattgcgcccttgactaaaatattagtgggaacgcaaattggtgtaacagcagccttggttcccttggcctttggagttgctcctttctacgctaggcaagttcaagcatcacttgagtctgttgaccacgggaaagtagaggcagctcagacggtgggggcagatttccttgacatcgtctttactgtttatcttcgtgaagaactggcaagtttgatacgggtttcaacggttaccttaatttccttgattggtttgaccgcaatggccggtgcgattggggctggtggacttggaaatactgctatctcttatggttacaaccgatttgccaatgatgtcacttggtttgctacgattttgattttgatttttgttttattggttcaacttgtcggggatttcttggcaagacgcgtttcacatcgataattaaataaatagacttaagtctatttgattaaaggagaaacaatgaaaaataattctgtaaaaattgttgttgcgactggaattggtgccgctctatttgtaattattggctggttgattaacattcctacgccaattccaaatactagtatccaattacaatatgctgtacttgccctattttcggccttgtttggccctcttgctggctttctaattggatttattggtcatgccctcaaagattcatttctttatggggctccttggtggacttgggttttaggctcaggtttgatgggactatttctaggctttggagtaaaaagagaaagtttgactcaagggatttttggaaataaagaaattattcattttaatattgtccaatttttggcaaatgtagtcgtgtggggtctaattgctcccattggggatattctggtttatagtgaaccggctaataaagtctttacacagggagtagttgcaggtttagttaatgccttaacgattgctgtagccggtactttattgctcaaactttatgctgcgacacgaacaaaatcaggaacgcttgataaggaataaatatttttaacatcagatgtgctagaataaaagcagcaaatacttgctgcttttgcgcttgtatccttagagtgagaccattgtctaagaatgtttgtaattaataagaagggtgaaaatggaaccattaatctcgttcaaagattttacatttaaatatgatttgcaaaaaaatccaacattaaaaaagataaatttagaaatttttcctggcgaaaaagtactgattgttggaccatctggttcaggaaaatcaaccattggctcatgtctgaatggaatattgcctcatttgtacaaaggggaagcaagcggggaattatcaattgctggcttaccttttgggacttcaattactgaactatcagaaagagtatccactgtgctccaagatactgatggacaatttattggcctaagcgtagctgaggatattgcttttgctttagaaaatgacggtctgattcatgatgaaatggtcagcaaagttgcctagtggtcagagaaaaccgaaagcaagagccttttgaatcatcgtcctcaagacctgtcagatggacaaaaacaaagagtttctttggcgggagttttaattgatgaatcaccaattttactgtttgatgagcctttagccaatttggaaccacaaacttgtggagaaacaatagctttaattaaaaatattcatgaagaaaagaatgtgacgacaattatcattgaacatagaattgaggaagttctatcactcggaatcgataaaattgtggttgtcaatgagggtgaaattgttgcgattggtagccctgatgagttattgaaaacagaagttttcagagaaaattctttacgtgaacccctttatttatcagcattaaaggctgtaaaagtggctgactcactgacaaatttttctgatttgaaaacgttagatgccccaaatctaaaaaaaatactgacagattttacaagctcttataaagtgactgacaaagctgtcagtaaaaataatatcctgtcagtaaaaaatttgacggtaaattttggtaaacatgaagttctaaaaggaataaatttagagattcaagaaggagaaaaaatttcgattgttgggaaaaatggcgttgggaaatcgacctttgcgaatgcgctctgccattttgtcgaagccagtggtgaaattttgtatcgtgggcaatcaattgttaatgattctatttcggaacgtgcagcaaaaattggttatattatgcaaaatccaaaccttatgatttcgcaaaatattgtcagtgatgaggtggcctctggtttgagacttcgtgggtttgatgaaggagtcattagtgaaaaagttgaagaaattttacaggtttgcggactttatccatttagaaattggccaatttcttctttgagttatgggcagaaaaaaagagtaacgattgccagtattttaattttggagccagaaattttggttcttgatgagccaactgctgctcaagatttaaaagcttatcgtgaaatcatggattttcttgaccaacttaatcatcgtcttcatttgacaatgattatgattacgcacgatatgtatttgattacagaatatacagatcggactctagtttttgctgacgggaaaattgttgctgacgaaagtccatttgaaattttagaaaatgaaaattttgttaagatgggaaatctgagacaacccagtctttatcaacttgcgagaaaagctgatattagtccaatttcactgacaaaagcttttattaattttcaaaatcaggagagattaaagcatgaataatcaacttaaagtcttaggctatcaagccggaagtggttttatttatcaactcaatgcgactgccaagctcttgttttttcttttgatttccatcagtagtatggtcacttatgatacaagatatctggcttttgtggctctcttttctatgctcctcttttacttttcgaagattcctttttcgtcagtcaaacgagtcgctcagtttgccgccctttttgctttcttaaatctcctatttgtgtttgtttttgacctcggctatggtgtaagactctatgattctaaaacgattatttgggggcctttaactttagaagaacttttttatctctttaacctcgtcttgaaatatttttcgaccattccacttgccttattgtttattttaacgactaatccgagtcaatttgctagtagtctgaacaaaattggtcttccttatcgttcctcatattcggtatcattggctttgcgctatattcctgacatgcaagaaaagtttttagctattcgtaatgctgggcaagctagaggaatggatttatcaaaaaagtaggtcttttttctcgaataaaactaaatgttcaattgttattgcctttgattttttctagcttggagcaaattgataccatttcaacagcaatggaattacgacgatttgggaaaaagaaaaaaagaagttggtattcatatcaacccttaaaagtaaaagactactttgttatcttactcgcacttttaggagtggctcttgtaatccttttgttttttgttaatcaagggcgattttttaatccctttcattaaaaaagcctgcacaagttatcctttgtaagtctaatagcgaatctggagtccatattagctatttttatcgtattttactaaaagtcttctttccgctcaaaaattcaaaactcccttctcaaactttgaaaagggagtttacctttgttctgaggcaagttttttgctttttgttatcttgcaaaaatgagtggaaaatggcataataggacttgtaaaaaacttttgacaagccgattgtttgcaaaagcttataaaatttgaattaaatctataacaaagaacttccaaaagaattagaagggaaaaacatggaaaataaaatacgtgaattgcgtcgtttgtctcatctttcacaagaggatgttgctcatatcgcacatgtctcgcggcagacgattaatgcaatcgaaaatgacaaatacgaccctgagttgactcttgctttcaaacttgccgaaaccttagggacaaccgttgatgagctttttaactatcaaccaaccgttgtgaaaaggaaagaaaacgatgtattttggtgcgaaaaatatcaatgtgtcttatggaaaagagcaggtattgaaaaacgtaacgctgtcgattgaaaaaggaaaaacgacagctattattggagtcaatggttctggaaaatcaacgatattaaaagccctagggcgcttgattaaagcagaaggtcaggttatttttgataatcagcccttaagcaatcattcaaatcgggagattgctcgcattttagccctattgcctcaatcaattactgctcccgcagatattacagtctatgagcttgttagtctaggacgtttcccacatcaaaaactgatgcaacaacgtttatcaaaagaagatattacttttattgaggaattaatgagggaaacaaatgtttgggatattcgtgaaagtaaagtatcagaactttctggtgggcaaaaacaaagagtatttatcacaatgattttagcccaagatagtgagattattttactagatgaacccacaacatatttggatttagctcatcagttggatattttgtgtctgcttaaagatttagcgacaaagcgaaataaaaccattgtttacgttattcatgacttgaaccatgccgctcgttttgccgacaacctagttctcgtcaaaaatgggaaagtggtcgagcaagggactgttgatgacttatttactcaaaaaacattgaaagaatgctttggattggacgttactttaggatgtgatacctttaccaaaaaattaatgattactggggtgaaagatgcctaaaaaacattttctgacaatcttttttgccctagttttttctttactttttttgtcagttctttatctgatgctaggaaacaaaaatgttccactgacagagttatccacaaataaaatagttttacaattacgcttaccacgattgataagtctttttctaaccggatttctcctgtcggtcagtggatttctagttcaaattatgaccagaaatccaattgccgaaatgtctactctaggaatttctggtggttcaagtctggctttatctcttttgttgactttgggttggtcgacaaatgatggaatttcagtcatggtttcatcactaggagcatttattgctctagccgtcgtcatgcttttgactgccaggacacattttcagcccttaaaagttgttttagttggaacatcagtcggactttttgcaacgagtttagcgagctcaatgacttttgctagtcatgatacgcaggcttattttcgctggattgtcggttctttttctggtataaccaatactaaagttcttttaatggcagtcgtgagtctgttttttctcctactcttgctcctattctctaaacaaatttatttattaaactttggagacgagctggcccaatcttttggagtttccgtaaattttgtccgtctactcattatgtttttagttgctcttgcttcgggtgtgaccgttgcctcagttggagtggttagctttgttggtctgatagctccacatattgccaagaaaattgttagaacgaatttttggcaaaatgtgattttgtccgtgctgacagggatggttttgcttgttttggcagatttggcggctaggaatttatttaaaccatacgaatttccagcaggaagtttaaccatgcttctgggggctcctttctttttgtgggtcattacaaaggaggcgaaataaatgaaaagaaaattcactttactttttgtccttcttttggttttgattgtggctgatttgacacaattttcgactaattctcaaatcctatctattttgattcctaatttccgtttaccaagattaataactattttgtcagcagggattgccctttcattatccggttatatcattcaaaatatcacagagaaccctcttgctgatagtggaacaattgggataacttctggtgcatcagcaggaagcgtcgcctttttattaattgctgatcattttaaattgacgggcatttggaatttttcttatcccctattcgccttaattggtgcccttctttcttttgctttaatttatatttttgctctgagaaagcaagtgagctctgtccgagtactcttgacagggattgcaattacagcttttttccaagccctgattacgattggtcaactttctgtcaatgcatttgattttcagaaagtggcagtttggctgtcaggagatatttggcaaacgggaaccacttatctgataatttgtattttattattagtcatcggattgataattctcccttttttcctcaaaaaacttgaaattttatccttgggagaagaaatggcgacggttttgggacttgatgttcccaaaactaaaatctatctatacttgctggctttactttttgcagctgttggtgttttattggttggtggattagcctttgttggtttgattgctccgcacattgcacgtgaaattgttggatttaaatcacggaaaagcctaatcgcaacagctctttcagggatgattatattatcttttgctgatattatctcccaaatgattatagctccatcaagtttacctttaggctttgttgtcgcctttattggggctccatattatatttatcttattcaaaaagtttaagaaattaatttacttttgtaaatttcttataaaaaaataatggtttatttctataaaatgacctaaaaatagaggagattcttttgaaaaaagtactcacaaccctaattgctgcaggagctttacttactttagctgcctgttctccaaattcatcatcaaaaaaatcaacatcgagtgaagacaaagtgacctttcacgctttgaatggtgatgttaaagttcctaaagatccaaaacgtattgccgttcaaaattacccagatgaagtggcttcattaggtgcaaatgttgttggaacagactcatgggctttcccaaataccttcttatcgaaagaacaaaaaaagaatatggttgatttgggagcaccaaaattcaatatggaaaaattgattgctcaaaatcctgatttgattattacagttgataaagaccaagtggctgactatcaaaaagtggcaccaactgttctcgttaattataaagatctttcaggaatgaataaatcacttgattactttgctaaacttcttaatcgtgaagatgaaaaagcaagtttccttaaaaactttaaaaaagaagctgataaacaaaaagaaaaattggctaaggttgatgttaaaccagctaaaaataccatttcacttcttgaacttcaaggagataaggtttatgcctttggagataattttgctcgtggaggacaagccttaacaactggtttaggctttaaagaatcaagcaaaatgtccgaactctcaaaaggggtgggttatgccgaagtaaatacagaaagcttgggcgaatttgatgcagactatatctttattgattttgcagagaaagataaagaacaatatgctgctctaaaaaataatccggtttggcaaaatcttaaagcggttaaagaaggacatgtcatcacaatggactacgacaaagtttacttctttggcggaccaacagcggctaaaaaagagctgtcactctacactgacgctatcattaaagctacaaaataaaaagaaaaagtgtataatcaacttatacactttttttgtgaaaaattaaggactttatgacatgaatattaaacaattacggtacgtcgtcgccattgctaatagtggaacttttcgtgaagcctcagagcaactctttgttagtcaaccctcaatgtcaattgcagtaaaagatttagaacaagaacttggctttcaaatttttgaaagaacaaatacaggcgcaactttgactattgaaggcgaacgattttatgaacaagcacaaactgttttacgtaatttcgaaagctttgaatcgaaatattctaaacctaaagaatcagacaaaacattttcagttgctagccaacattatgattttttagcaccggtcgccgttgaatttgagaagaaaaatcccgaaataaagaattttagaatttttgaatctaccacttataatattttacaagaagttgcacaagggcatagcgaacttggggtagtttatctgaataaacaaaaccgctcagggattttaagaatgctcaataaacttgaattagattatgaagagattttcttatcgcaaacgcatatttatattcgcaaaggacatccactcgctcagcgcgagacgatttcagatgatgacttaaaaccgctagatcgtgttcgatttacccaagaaaatgaacagtttctttactattcagaagatttggttgaaacttttgaaaatacattgatttataatgttactgaccgagctagtttaaacggtattttagaacgaacagacgcttatgcgacaggtcttggctttatcgataaagcaagtgttcacaacgtgactgttgttcctatgcaaggggataatggaaatagtttgattttagtcaaacaccgtggacatttactttcaaatgcggcaacttcttataaacgcagccttgaagtttattttgaaaactatgaattctaaaataaaaatactctctgatttatttatcagagagtatttttattaggattacttaccacaaaaaattagttttgataaagaactaaatgctactcttcatattgatgaagtaattttaaaaaaaattatccgaatctttttagagaacgcaagtaaaaccgaagatccaaaaagtgtattaaaaatagctttattaagacaaggagattctattgatatctctgtttccaatgaaggggtaaattttatttacgaggagaagaaggctatctccaagctcaatctttccgatgatactctagaaacaagaacaactattggactttctcttatcaacgagtatgctgaagcttgtggagcgtggttttttctatctgataatttccccagtggaaatgtatttcatcttgtatttaatcaaaaccaagaaaagagataagatttgattaaactcgaaaaatttacccgttattgtttaattggtttaacttcccttgctttgttaatgatgattttcatattctctactgaatcaggtaacgttaacccgtttgttgttataataaccatggtccttctatattttatattacgatttatcaatggcttactgagaaaatcttccaaacgacaattaagaaacattgttataggttctgttttagccgtgactatccttgccatactgaatgtcgttttctttagagttcatctatttggtgatgtccaaatatgtattgatatggctagaaaaattagtcaaaataattttgaatggagtaactggattttacaatataaaaatcttgttcccctaactattttatacagttggatgatgaaaattgggcagtttttacacactggtttttatcctattttttttgcatataatattagcttacttataggaagtcttgtattaacgttgctaaccctctggcacaaaaaaccacaaagtgctgcacttgcaggcttgttagcgatagttcttcctgtattttatagttttattatacaagttggttatactgatggagctagtatactcgctttatcactcttaatctttctttttgaatacaatcatctaaattggtggaaattgatattactcacctttgtttttgcttatggctatctaatgcgacccaatatcatcattgctctggtagctctatttataattggacttttcacatataaaaaacaaaataatatttttaaattagtcagtaagctttttattttttgtttcttaggaattatacttgctactagtacgagtaaaatttttgatgcaacttatcattataatgctaataatcctaagcaattccctgtggtgcactggatttatatgagattgaatcaagaaaaaattggtcaatataacaaagctgatcgcagttatactctgaatcacgaaggtttttcttcggctcaaaatgctgatatcgcaggaattaaaaatagattattaaattatagaccactgactttggggttacacttcatcaacaaatatggtattttgtggcatgaaggaacttttcaaactttgacagattatcaaaagaattatatttttgctccaaaattatttttaaaatattctaaacttatctttttagtttctcaagtattttcgaaagctttaataagtctgtttttattttttttagttttagaattattacgtaagaaaccaattcctagaaattctattttattatcattattgataatatttggaataagcctttttcataccatcatttgggaggtgaaaacacgctatcaattcatgactttctttttactattttttgtaggagtctatgcaatggttgaatattttgaaaaagataatttttagaaatttatatgtttctaaattagtcaatttttatttatgctaaaattacctaccttataaagaattcataaagtgcctgttctaaaaaacataaaagcagacatttatctgttgtttgcgctcaatattgataggtgacttactaagtggttgttttgtgaggactaatcctttcctagtgattatttcctatttaatagtttatgtatttttcaaatctaaatttagattgttttatgatgataggttattcctatcattttttttgagcctgttaagattcctaagtatgttgatttggaagatttagtttaaaaaacaagagctttctgtgttattcatctatcaaggttatagatattgggaagtagattatgaaattattataattgtcatctctgattttgaaacgtggtattttatgaacaatttcttgtaaatttacttaattaagcaatggatagagaagactaattttcatttgatttggatatttttattttcctacagttaaattttttccttaatattcgatatgtgtgctattcatatttgattaatgagaatatggaacctgataattttgaataaaaaaacctcctgatgtaatcttatacatacaggaggaaaaggagtaagcgtatttaatactatcatttttcttatataatagagttgagaataaagaactctacttataaggagtcaaggggatttgaacccctgcgccgctttacaaggttcgacggatttcgagtccgctgcattatcactctgccatggctccgctcccttatctaatttcattataccatagttaattaccttccagaaataatatgaaataagaataactaaaataaaaaaacgcatatttatacaaaaatgttgacaaatgaataaatatgctgtacaattgcatttatattaatttgaaagaagaaaaatgatgggaaacaaaaaaattgtcttggcatattcaggtggattggatacgagtgtcgctgtaaaatggctgactgataaaggttttgatatcattgccgcttgcatggatgttggtgaagggaaggacttgaattttattcatgataaagcactccaagttggtgcggtagagtctgttgttctaaactgtaaggccgaattcgctgaaatcttcgttggtgctgccctcaaaggaaatttgatgtatgaaaataaatatcctttagtatcagcattaagccgccctttaattgctaaaaaattagtagaggtggctaaagaaaaaggggcaaccgcaattgctcatggctgtacaggtaaaggaaatgatcaagttcgttttgaagtagcaatccattcacttgcgccagaacttgaagtgattgctccagtccgtgagtggcattgggctcgtgaggaagaaatcgagtatgctaatcaaaatggtgttccgattcctgctgatttggataatccttattctattgatatgaatttatggggacgtgccattgaagcaggagttcttgaaaatccttggaatacctgccctgaagatgctttcttcatgactaattctgttgaggatgctccgaatgaacctgagtttattgaagttgagtttaaagaaggtttgccaattgctttgaatggaaaaatcatggaattgcatgaaattattaaagaagtgaatattattgcaggcaaacacggtgtgggtcggattgatcatattgaaaaccgcttggttgggattaaatcacgtgaattttatgaatgtccagctgctattaccttattaaaagcccacaaggatttggaagatttaacttttgttcgagaattagcacatttcaagcccgttcttgaaaatgaattagcaaatttgatttacaatggcttatggtttaatcctgcgactaaagctttaatagcttaccttgatgaaacacaaaaagtagttaatggcatcgtgagaattaaattatacaaaggtttagcgactccaataggacgtaagtcaaccaattctctttatagtgaaaaattggcaacctacactgcagctgatgagtttgaccaggcagcggcagttggatttattaaactttggggcttgcctactcaggttaatgctcaagtaaatctcaaataaaagatgaaaaaatttggaaagtgagagaatggtagaaaaactttggggaggacgttttgaagcctcattagataaacaaactgaagaatttggtgcatcaattaaatttgaacaaagacttgctccttttgatttaaagggctctttagctcatgtgaaaatgttaggtgaaacagggattatcactgctgaggaagctacaacaattgctaatgggctgataaaagtagaagaaaaacttatgaagggtcaaattgagttcaaaattgaaaatgaagacattcatatgaatatggaaacttatcttcatgatgaaattggtccacttgcaggaaaacttcataccgctcggtctagaaatgatcaagtagcaaccgatatgcacctctatctcaaaagtgttttatctgatcttttaaaagctttaagaacgcttcgtgaaactattgtaaatctttctgtaaaccatgttgacactctttttccgggttatactcatttgcaacatgcccaaccgatttcttttgcccaacatttaatggcctattatcaaatgtttactcgagattttgaacgctttgaatttaatgtaaaacatactgatatgaatcctttaggagcagcagctttggctggaactacttttccaattgacagggagttaaccacaaatttgcttcaatttgagaaagcctatgctaattccatggatgctgtcagtgatcgtgattttattttggaattcttgtcaaactctagtttgttgatgatgcatttatcaagattatgtgaagaacttttgctttggtctagtcatgaattcaattttgttagtttatcagataattattctacggggtcctccatcatgccacaaaaaaagaatccagatatggctgaattgattcgaggaaagagcggaagagtttatggaaatcttatgtctttattgactgtcatgaagggacttcctttaacttacaacaaagacttacaagaagacaaagagggaatgtttgacagtgctgataccatattaacatcattgagtgttatggatggaatgttgtcaaccatgactgtaaaccgtgtaaacatggaaaaggcgacagagcaagatttttcaaatgcaaccgagctggctgattatcttgcggcaaaaggtcttccttttagggaggcacacgaattagtaggtcaattagttttaacatgcataaaaaaaggaatttatcttcaagaggtgagcttaaaagactatcaagctttgtctcaattaatagaagaagacgtttatgaaattttgcaatctagaacggctgtttcaagaaggaattctttaggtggaactggttttgaatcgattaagaagcaaattgaacaagcaaaaaaagagcttcaaaaatgaagctctttttatacaattacttttttagtgtaactgaattattgtgtgtaaagtagttgatcagattgaagatgacaaggattgctgaacctacaaatacataacgatagtcgataaaaccagcaatagctgagcctaatagaggaccagcaaaggcaccgattgattgagcggattgattgtaagagaaaatacggccggtgacagcttgaggagattctttggccagaatagcttgaacagatggtaaaatcgcagcatcagaaattccgacaaagagtcttataacaatcagaaaccaaacattagttgtcagtgcggtaattgaaaagacaataagtgagaagaaaagtccaaagccaagaatttttctttgaccgactttatcaccaagtctccctaaaaacggggcagcaactaaggttactattcctggagcggcggcgacaagcccagccatgaaagtgatattcccttgaccatgcatgagttcctgtacatagagtgaaagaacaggattaatggattgattggtcatttgggtaatcaatgttgcgaaaaacattccccatattattgcagggtgtgtgacaacttcccatacttgtttgtaggagagcatgtttttcttttcaactggtttaaaagtttctttgaccaaaaaaagtgcaaggaaaaaaacaaggaacatgatgatacctgtaacgctaaagacacgacgatatccagttatattaacgaggaccccaccaactataggtccgattaatgttccagctacagaacctgttgtgagtaatgataaaactgaacctgatttttctttgggtgccgagcttgccatcaaagccattgaattggatacaaagccagaaaaagcaccaagcaacattctcaaaataaggagttgccaagcagccgtgacgaaagccattagagaaattgaaatggccattccgagagaggctcttaagagcatcaactttcgacctttttggtcagctaatcttccccataggggagaaacgatggctaaaacaataaaagtagatgagaaaaccagcccagaccaaatgtttaattctgtttttgaatagtgacctagtgttccgatatagagtgatataaaaggggaaataaggcttgagccaattcccgtcataaatgtcccaaaccaaaggacgattaaatttcgttgccatgattctttcatgaataaatgtacttctttcttgatgtattcataataatattataaaactattgttcgtagtttgtcaatgacgaatcatcacttgaaaaagagagtgaatagttttatactgaaataagatgctttgagatgaaaaaaatctcaaacttcaagaaaactttctaatcagaaggtactgaaaggaatcctattatggcaaggattgcattaacccgcgataaaattgttcaagcgacaatcaagttagctagtgaaattggactctctaatgtgagtttccctcgtttagcagaatattttggaattaaagctccgtcactctacaatcattttaaaaatatggaagaagtccgagtagcgactgcagtttacttacaaaaagaactaaatcatgaattgactcatgcaatggtaggcttgacgcctttagccgcccttagagcttatgctgaaagctataaaaaatttgccgaaaaatatgaagcagtttatgaattaattaatgtgatacatcagacaaataatggtgaacttgaatatttagcaaaggaaaatattcgcttggttcgtcgtagtttagaaaattttaatttatcagaagaagagaattttcatattagtcgaatgtttaggtcaactttgcacggctttattactttgacgcaattaggttattttcgtcagtcaggctcaatttctaaagaagagtcgtttacttatatggtagatcatctgcttagtacgcttaatgataaacatagtatttaagagaataaaatattcctatcaaacaaagttagaataacaaacaaaaaggagttatggaatattttgaataaaagaacgttttcatttgaaatagtgactttttagcaactttatgataaaattagtacgataatttctaaaatgggagagagtggcttggctataaaaaaaacatatcgcgttaaacgctcaaaggattttgaccaaattttttcagcgaaacatagctttgccaataaaagatttgtagtatataaattaaatacaaatcagcctcattttcgtgtagggctatcagtaagtaagaaacttgggcatgcggttttgcgtaatcgaattaaacgtcttttgcgacatgcagtagctgaatttaaaccttatttggtagatgaagattttgtaatcatcgctcgttcgggtgttgagacacttagttttgaagaagtaaagaaaaatctgagacacgtgttgaagttgtcaaaaatctatgtggatggagaaaacgattgaaaaagaaatttagtttgatcgcaatggcgggagctgcccttttgttacttacagcctgtggaaccacggcagtaacaggtagctcaagcaatctttgggatcaaatcgtatatggctttgcgcaggttattcgtttcttgtcatttggtggtttgaccggagttggtattattttattcacaattattattcgggcggcattgctcccgttgatgaatatccaaatcaaatctagccaacgtatgcaagaaattcagccagaaattaaaaaaattcaggctaaatatccaagcaaagatatggaatctcgtcgtttgatgaatgaagagattcaaaaactttatgctgaaaacaaagttaacccttatatgggatgtttacctttggttgttcagatgccagtgctttgggcactttatcaagccttgtctcgtgtagactttttgaaacacggaactttcctctggtttgaaattggagcaaaagatccaacttttattttacctatattggcagcaatctttactttcttgagctcatatttaatgatgaagtctgctcctgaaagaaatgcaatgacgacttcaatgacttatattatgccgattttcatcttgattatgggtgtaaactttgcgtccggaattgcactttactgggtaatatctaatgctttccaagtctttcaaacgatgttgttagctaatccatacaagattattgcagcgcgagaagctaaggtacaggtcgaaaaagataaagttaaagctcgtgaaaaagcattgaagaaggcaagaaaaaaataaaaaataccattggcagtttttattttaattggaagttgtgctagaaattgtcaataggctttatcatatgacaggagtagtttgattatggctatttttactggtgaaacggtcgaagatgcaattgatcgtggtttaaatcgattaggcgttaagcgcgagaatgttcatattcatattgaacaaaaagataaaaaaggtttcttgggatttggaaagaaacgggctcgggttaatatcgagccaatccatgaggaaacggtgcgtaaagctgatcatttggctgaacgtggtgtagatgatacaattaatcttggcgttcctaaatcacaatccgcaatggaagcaacgcttgagctaagtcaagttgttaaagcggttcgtgcggctgagagagaacaaaacggcgaaatcactgaagaagagcgtaatgcgattattgaagtggccaaaaaaacagttgttcaaaatcgccaaggaacaacagatttttctgatgttgttgcagctgttaaagaagaagttgaagctaaaaaagaagtttcaaatgaagaagaaaaaattgcttcaaaaatttcaagctacttgaccacgattacccaagaaatgggaattgcaactcgtgtttcagtttctcgtgatgggaatttgacggtctttaacttgacttctaaccatgatgctctacttattggtaagcatgggaaaattttgcaaagtttacagattttagcaaaagcctatgcaaacagcattttaaatacacgaatgaatgtcgctgtaaacgttggagattatcatgaaaaacggaaagcttacattgtaagcttggctcaccgggcagcagagcgtgcgcgtgggggtgaaactgtttatatcaatgatttacaatctaacgagcgtaaaattgttcacacgattattggtcaagaaaatggtgtgtcaagtcattcagaagggcaagaatataatcgctatattgttgtctctaaagagatttagccttgacaaaagacctttcatagtgtagaattgtaaggtatgcttttaatagcagtaaactaagatgaaaggaacaccgaaaaggtggagctactttcaaccaaaagtgaagtagcccagggacttatataatgaaacgtacttaccaaccacacaaaaaatctcgtaagactactcacggattccgtagccgcatggcaactaaaaacggacgtcgtgtccttgcagctcgtcgtcgtaaaggacgtgcttcacttacagtttaatttgtaaatgaaatagaaaccagcatctgctggtttttttttatttaaaaaaataaaattttgttaaacggtttcatttattgtggtataatagctttattgattaattaatggagttttcctttagtaattgaagtataaggtaaaatttcatatctgataaggagatttttatcgtgaaaacatttaagattggtgaacttgaagcttctcaaattattctaggatgtatgagaattaatgaagaaggaaaagaccccgttgctgtaattgaaacttcagttgaagaaggaattaatttctttgaccatgcggatatctatggtggtggagcttgtgaatcgatttttgctgatgccttaaacaaatcatcagtcaaacgagaagacattatattacagtcaaaatgtggtattgttccaggaaaaatgtttgacttttcaaaagaacatatccttgaatcggttgaaggaagtctgagtcgcttaaagacggactacttggatactttgctcttgcatcgtccagatactttggttgaacctgaagaggtagcagaagctttttatgagcttgaaaaagctggaaaagtacgttattttggagtctctaatcaaaatccaggtcaggttgaacttttaaaaacagccgtgaaagaacctttgttattcaatcaattacagtttggtttgaaacatacaggtatgattgatgctggtattcatgtcaatatgagtgatgatgcttcctttgtccatgataatggaattttagaatattctcgtattaataagatgactattcaggcttggtcacctttccaatatggcttctttgaaggagtttttgttgggaatgaaaaattccctgatttgaataaaaaattggaatattatgctgaaaaatataattctactccaacgggaattgctattgcttggattaatcgccatccagcaaatattcaaacgattattggaacaatgactttgagtcgaattaaagaaattgcagctgcagcagatatcgttttggaacgtgaagaatggtatgatttatatatggcggctggaaatgttttgccttaaatctaataagaataaaaaactagcaattaatagctagtttttttatttaactatgttgaagaggttttgatgaaatttttaaagtattttaaagaaataagaataaacaaagactctaatcattcgtttaagttattgaattttgaagatttaacagatgatgaactactaggagtttcgggaggtggattttctgataatctccgacaagaaaggctagaagcagggtggacacaagaagaactagggaaattattgtttactagtaaacaggcagtttgcaactgggaacatggtcggagacagccaaatttgatgctgcttcaagagatgtcaaacttatttgagtgttcaatagatgctctattgaaagagagaaagtaaaaactaaagtacacaaaaagaatactaaaagactattgaccgaatattcagaaaagaataaaatatacttgtaattagttacggatatttgaaaaattaatgggtgattttagtagaagtgcacatcgactgaaaatgctcaaaaaagtccaaattggactagaaagtgtgttcttatggaaggacaaaagatttttgaagtgtttgaaacgttgactgatgctgaattgatggagattagtgggggtggaggattaattaattattctcaaaattatctttcatcagtcttaatcggaagtggagatattatcggcgatatttatgaccgttaacttaatcgcttttgttaattctagtgtattttaagctaaaggattgttaatgtaatttagcaatccttttttggggacttttatgattgaacgtataaaaaaatctttacagactaaattaaaaacgcttctagttttactagtaacggtagtgctttacaatggttgggaacctagtttgggtatttttccgactggtttttatgattttacttttaatcattatggagcggtggatattttaactttttctctaataatgattattgcttacaaaaatggagcttttagaaagttttttgatatttttcgttggaaaaatctattatttattttattttttattattggtgggattgtttttattgtgttagcgcataaattatattttcaaatgacgtctgctttggtggcattcccagaacatggtgtggatgtggcaaactctcttgcacggactccgttttggacacactctttagatttatttgtaattgggccgatttgtgaggaacttatttttcgtgaatatctttatcgacttttcgataaaaaatggttggcttgctttgtaagtgtcgttgtgtttgcatggatacatactggttttacttattccttctttttttatttgccgatgagtttggttgttactttggcttatcatcgacgtaaagcaattggggagagtattattcttcacagttcgataaacttgatcaataattatttgccttatttgctaaatttcttggtgccttgagtagataggactgtaatgtacattatttggtgatttttcaaattagaattcatattttatttaaaagtcttttctaaagacttttgtttactttactagagaaaacggttgaattcaggcaaaaaataacgtataattaacatgtatctaagaaatttttaatgagatatttctgtcagtattagaaaatttaaagttctctaaagatgagaaagttaagtaactgacagaagtgaaattattagtttttagtttgatctggctttttacagataaatttaaaggaggtgtcttatgagttttacagatgaaacagtccgttttgaatttggtgattcggacaagaaagaaattggcgaaacactcgttgatgtttacaatgtacttgaggctaagggttacaatcctatcaatcaaatcgtgggttatgttttgtcgggagaccctgcttatatccctcgtcatgatgatgcgcgtaataaaattcgccgttttgaccgagatgatattgttgaggaattaatcaagaattatttgaaagataatggtgtaaatttatagtgtttgcacgaattttaggtcttgatgttggtacaaaaacggtgggtgtgtctgtcagtgatttacttgggatgaccgctcagcctgttgaaaccattaagattgatagtgaagctggtgagctcggttttgatcgtctagctgtcttgattaaagaatacaaacctgaaaaggtggttcttggtcttccaaaacatatgaacggagatgaaggcattcgtgctgaagcttcgcgtgattatggaacaaagttggccaatgaatttagcttagaagtagcctatcaagatgaacgtctgactacagctcaggctgaaaaagttttaattgacggtggagtacgccgcaaagaccgaaaaaaatcgattgataagttagctgctgttttgattttacaaaattatctggatgcgcacgcattaaaattataatttttgattactgacgagcctgtcagtgataataagtctgcttgttttgttataagtagcaaaaacttcctataattaaggatgaagaaaaggaaatagaatgactcatacacatgatcacgaacatgaccacaatcatgaacctgactatattactttagttgatgaaaacggaaatgaaagtttattccaaattttgattaccattgatggacaagaagaatttggtaaaaactatgttgttttacaaccgactgaatttgaagaagatgaacaaggtcttattgacgttttagcttactcatttactgagaatgctgacggtactgaaggtgatttacaaccaatccctgaagatgctgaagatgaatgggatatgattgaagaagtcttcaatagtttcatggatgaacaagaagattaaaataaaaagctgtcattaattgacggcttttatttttttaaaaagcttgctagagcaacggcaccaagcatggcgacacaaactaagccaataggaggccagaaccaaacaattggaagggaaattcctaaaataatgaaaatatttctacgagaaatactatgggtaagttctttgtattctttatctggattttctttgaggagttcgtaatccatgagatgaaatactgctgtccagagaaaaacaatgacgagatagaagaattcagggagaaattcagtcgcatgttttccgacccaaccggtagtaaatgggaaaaatgacataatgaatagacatagcgtattcaataagaaaattcgaggagtaatatttttaatgtcgcgataaagttgatgatgattgtaccagacggtcataatcataaaaaagctcaaggcataggccaaaagcggaaccgttaattctgtcagggctggccagccgcttttatcaggggttttaaattctaaaaccataattattgaaatgatagcgttgatagcatcggtaaaggctaaaaaacgttctttttccataaaattattttatcataaatattaagaattttttacgaatagattgtaagttaaaaaattactgaccaatctgtcagtaatttttatatttattttttaaatttacgcttcaagccatttttagcgacgtctttaatcactttgttacgtaagcctggttcatagttatcataaattgttccgtcaaaattaataatttgagcattgtgatttttttcgtcaaaaatgaatttactaatcatttgagctgtttcttctggagatttgacaaaaggactgtcaccaacttttgcgccatttaaatctgttgcaacagccccaggcatgatagcaaaaatttgtttttgtgatttgtcttttttaaattgatgaccaaaagcaaaagtcatggcattctgagcggcttttgaagtgacataggccagcggcatccaatattcctgagaaacgggtacggtgatgttaataattttagcattttcggtcagtgaatgtggaaggagttctgtaatcactgcatgtgttcccaaaaagttggtcttgattgtttcttctaagtcagaactagaataatcaaaagctgatttttccatatcaagatgtcctttatctgaatgaatattaccagaaattccagcattattaatgagtaagtcaatgtctgtcagtgctgacaggctagttaattgatttaagtcatctaaatcaactttgacaaattccgcattgattccttcggccttcaatttttcaacggcttcttgtccacgagtctcattacgagctccgactaaaacttcatagccacgatgaccgagattttgcgcgagagcaaaaccaattcctttatttgcgcctgtgatgagtgttttcattgtatttcctcctttaatttctagctgtcgcccttagacatttgttgatggtcaattaaatcagcatttaaaaaccagtggcggtgccaatcttccgctaaagcattaaagggaacaggttcttgaccagcatttttaactttttctagcaagtaatttcttaaaatccaagtgtcttctagtgttctttgtttaagtttaaaaattttttcaagtttgacttcgctaatttttaaatcattagcaatttcagatttgctgagtcctgtgagctcaaagttttgacggagctttttttggtgttgtgcatttggagtggattaagtgacatttttctcccttattctttgttttttggaaaatagttactgagcatttgattagagagaagtttggtgttttcgtcactattaacttttcccatttggtgaagctgtttggaaaaaccagcatcaattcgctctaagccattttcaagtccggctaaagtttcattaatcaaatccgaaagggccatgttattaggtgcgtcagtatttgtatggctttcaagatttgtttcggcaactaatggtggaactaattctacaacctttaaagatttatcaaaatatttggcttgttctcgaagggcatcagagtaaaaatgaacactagctttggttaaattgtaaataggatgcgcaccgtcagccagatttgataagccagatgaaacgttaatgaccatcccattatttgctacaagaacttccaaaaaggcttgtgtgacagcaatagttcctagtaagttaatattaatttcttctgtcagtgctcctagagaattgtcagcttgttcaaacaaattgatggcacgcataattccggcacaattcatgagaaggtcaagcttaggggaattttcattgatgaaattgaccaattgggacagagaattttcgtcagcaacatcactgacaaatcctgaaaaagttggattttcgcttaaaatttgattgagtctatcttcattgcgtgcagtgatgataactttatttcctaattcagcaaatttttttgcaaaacctagaccaatcccgcttgtaccgcctgtgattaaaatggtatgtcctgtaaatgtcatgatttctccttaactattgataaaaggttattattttttatttttataaccaacaaaacgaattataaaccagaaagttatatttgtaaagaattataacttgtgttacaattaatttatgaacacacgtgaaaaaatattaaagaagacagaagaatttatcctaaaaaatggaattgaaaagttgaccatttcaaaaattgccaaagaattgaatattagtcagccagcgatttataaacattttaaaagtaaagatgaacttttgaccattctatcacttcgttggcttaatggtcagacgcttgtcaaaatttttccttttgatacaagttcttatgagcatcaaaaagatattgtccatgattggctttggtcagtagctattgccaagtatgaagcccacagaaatacaccagaaatgtttgctctatatacgacttatattggtgagaacttagaattaggacgccaacatattttagaaatggtagagagtttaaaaacggcggctaaactagaatcttatgaggaggctggcgcttatatccaagctttcgtttattttcaccacccaaaaattgcccctcagtgggacgatcaatttcaaacgcaatttgaaaatctctggactttggtggaaccaaatttaaatgaattttaaaaattactgacagacttttcggatttctgtcagtaaaaaaacctgtcatttgacaggtttttttactatttaattttaaacaccatcgctgttctaggttcaagaatcaaatttaaagttccttttgaccaaccaaaactacttcggggaccaaatcccccgaatttttgatcatcactgtcaaagataagttctggttttttagaaaattggagctgaagtttttgctcataactagggtggaaattaaagacaaaaactaattgtctttttttgtatgccagtaatttatccgaatccttaatccaaagctgttgaacaggatctgtactttctaaaaatttgaaatcatgttctaaattgagcatggcttggtcaaatgccagtaaatatttgaaacgtaaattttcgttatcagcaagtgaccattgtcttctagcatgttgaaaatcatcatgattttcttctcgagggaaatcgagccattcaggatgaccaaattcgtttcccatgaaatttaaataaccttcacctgctagactgaaagtaatcaatcgaattaacttatggagggcaatggtacggtcaataatcagagattgactattgatgtccatgttccaatagatttcttcattagctagccacatcatcagtgttttatctccaactaaagcttgatcatgactttctgaataaccgatatttttttctccaggtcgtctggtcgtcaattcccaccataaacttagcaaatctaaactattatctgttttttctttcaattgtttaatccaaaaatcaggaattcccattgacaaacgataatcaaaaccaattccgccagccgagataggtagtgccatcccaggcatggcagacatgtcttcagcgattgttgttgctgatggattaaagagatgagttagttcattagccagcatcaaatatgtcacggcttcaacatccgtattaagtgaaaaatacttactataatctgtaaaaacagttcctaaaccatggtcatgataaagcattgaagttactccatcaaaacgaaagccatcgaaatgataaatgtctagccaaaattttagatttgatagtaaaaaatgaaggacttcatctttgccataattaaaaagtttcgtcttccaagctggatgatttccctgttcgccttcatgaaaatactgattttctgttccatcaaaatagttgagcccatcctcaatattttttacagcatgtgaatgaaccacgtctaaaagcacttgcaaacccaaaccatgtgccttatcaatcaattccattaaatcttctggctgaccaaagcgactagagatggcaaaaaaattggaaacttgataaccaaaactagcatagagcgggtgttccataattgccatcagctgaatggtattgtaaccatcttttttaattctgggtaaaacatcgcgcgtgaattctttgtaagaattaattttgtattcttcggttgaaatcccaatatgtgcctcataaatcaaaggtgcttcgcttagtttagggcttttatttttccattcgtacttaggctgagtaataaccccgtctaaaccatgattttcattaggaagagcatacataatgtaagaaggaacacgataaacaacttctccagttggcaaaagcaactttatttttactttagaacctacaggtaataatccaggaactgaaatttcccaagtcccgccataagcctgttttagttcatagttgttttcccaattgttaaagtcaccaacaagccaagcttttttagcatttggtgcccattcgcggaaagtccagtgtttactttcttgttggaagccaaaatacttatagccgttcgcaaaatcaactaaagaaccatcaacgcccaaaagccgtttcttagttctagcaaattcaaagaggcgtaaagacaagtcatctttgaaaggttccaaataggggtcataatccaagatatttagaggcataagctattctccttttactgacaatcatttctagcactattttagcacttttgcaaaggttttcataatggaattaaaaataaaaaatttactgaccaaaagctgtcagtaaataattattattcatcattaaatccaaaccaagggtcttcctcgcctgtcagatgttcttgactaggagaaagtgtcattggaatttgcgcagaagctgtagaggcttgagaatttactgaccaatctgtcagtaaatttttgtccacagaagttttatcagcggcaaaaaaatgagtttctaaatactgaatatattcataaaactctgtcagaagttcatgataggcctttaattcactcgacttatccatgtttttaaatttctcctgaaattctccccagcgttcagcgatatgtttacttttcataaaatcatcataattcatgtcagccctcacttctatctattaattataacctattttatgaagtctattagtaaaattgtatttcattctgtggagagaaagttattttaattgatattttacctaccgaaaggtagaatgataattatcaaaataaaagaggtaacataacaatggaattttccactacacttaaaaaacgtatttcaattcgagatttatagaaaaaatcttctaaaatattatcaattaaattttcattgagcttatctccaatattagcaaggattgaaagttcaaataagccccaaaattggattcctttgagataatcttctatttcatcaatttcttcaggaagtaagtgttgataaagtcctttagctgaataagctactaatttttgttcattagtccccatttgattttcttgataaatttctttaagacgtttaatttctctttggtaataggcgtgttcaatctcatcgaaaatagagatataactttcttgttcaccattatttatcatgatactgtagtcaagaggggaaacattcattttttgaagggcagagtctagtcggtcaaaagaaagcatacttttaccattctcaaaattagaaagggtggatttcgcaatccctaattcttcaaaggcagatagtgaaaatccgtgttgaattctaaggtcatggaaggctttcccatatttaaaatataccatttgttcttctttcgcttaaactaattttttaatagtatatttcaaattcaggatttttgcaattcttttgcataaaaaaaagcactgaataatcagtgcttttaactatttacgtttacgagcaatcaaatgaatcggagttccttcaaaaacaaaggctttacgaatttgattttccaagaaacgaagatatgagaagtgcatcagttcttcttcgttgacaaaaacaacaaaagttggtggtttaatggcaacttgtgttgcatagaaaatcttcaaacgttttcctttatctgtcggagttggattaatcgctacggcatccataatcacatcattcaaaacagaacttgaaatacgtaagttttgagcatggtgaatttctttaatcatgtctggaagtttattcaatcgttggccagttttagcagacacgtaaacgattggtgcataatcaaggaatttgaactttgtacgaatttctaattcaaactttttcattgtatcattgtctttttcaagggtatcccatttattgacaacaatcagaatccctttacctgcttcatgagcaaatccagcgatacgcatatcatattcgcgaattccttcttcagcattaatgaccatcaaaacgatatctgaacggtcaatggcacgcatggcacgcatgactgaatatttttcagtgttttcgtaaatttttcctgatttacgcattccagcggtatcaatcataacaaattcttgatcttcagaatcaacgaagtgtgtatcaatggcatcacgagttgttcccgcgattgggcttgcaatcactcggtcttcaccaagaatggcattgataagagatgatttaccaacgtttggacgaccaatcaagctaaacttgatgacatcttcattttcttcttcgatttcattaggaagattttgaacaatagcatcaagtacatcccctgtcccaatcccgtgaacagctgatacaggatatggatcgccgagtccaagtgaatagaagtcaaaaatttccattcgacgttctgggttgtcgactttattgacgataagaatgacaggtttatctgtacgataaagaatattagcaactgcttcatcggcatcagtaattcctgtttctccatcaacgacagcgataataacatctgcttcggtcatggcaatttcggcctgtgcacgaatttcagtcatgaaaggttcatctgaaagttcaatcccaccggtgtcgatgatgttgaatttacgggttaaccattctcctgtggcatagatacggtcacgagtcacacctggaatgtcttcgacaattgagatgcgttctcctgcaatacggttgaatatcgttgattttccaacatttggacgcccaacgatggcgactgtaggtaagctcatatttttatttctttctttgtttacttattgtttgaaaaattatgatagttaagctaaagatgttgtaatataaaggctatataattttatagttcagttccgtgattaattttagataatttcaatcccaaataggcttgtaaaaaatggcgcttgactaagacttatcttcatgtttttagccagttgaggcgtaacttccatgcgttcaaattgattcgtagaaaaatcaatccctgcaagtgctgttttccaaaaattagccgcttctagttgattttttagcagttcaacatttttaaaattacaggcagtgaagaaagtttccttagcttcattttctaaaaagcgaacagcttttaatgtacttcctgaaaaattggcataagtcaataaattctctgtaaattgaacatcttgcaaatgaccttccgtaaaatcagtgcctaataatttacaggatttaaatactgaacgataaatgccaattttattgaagttcagattggataaatcacatttctcgaaaacgcaatctgtaaattcactgatcgtgttgtcagtaaattcaaaggttgtgtttttgaaagaacaaccagaaaaaatggtccgttggctaatcgtcaaagtctgatcagtaaattctgcttgatagacttctccatcagtaaaatcttggctgctcgctgcttgaaaaattgtaggaagttttggttctaagatttttttaatttcacagtaattttttcgcctttaaattttctgttgaggctgaaatttctggttgtccccattggtcaacaatccgttcagaccatttatttaagcgtctatttccagcatagccttcttgaacctgatcatatttttcaatggtttcactcgtttgctcaacatacttttctttaaaaacggtcgcttccaagggaagacgcggttttactttgttcaaacgtgcggcttttccaagagcaatcccaaaaataggataagtataatcaggcaagcctaaaactttagaaatttctgaggattggtcccgaattaaaccaaccatgaccccgttgtatcctaaagactccgcagccaacagtgcattttgcccagcagttgccgcatcaactgaagtaatcaataaactttcaattccttgaggttgaaaattcccctgatgtaattcgactgctttttgggcacgatttaaatctccaacgaaaactaaataagccgcacaatttttaattgatttttgtggttgaaattcataaatcgcatctttttgatcttgtgactctacaacaatcacagaatatgattgaaaatttttccatgttgaagccatttgagccgcttttaatattttttctaaatctttaggctcaattgcttcttctgtaaaatttctgaccgaagtgtgattcatcattaaatcaatcgtttcatttatctcagtcatgtcgtctgtttgttccctccagtcgcatttcttctgctaaatacttgacgcgttccatgacacgtttagctggccaaatctcatcagctcttttagtttcagccaaatgttgttcaagttcttccatttttaaatttgaagtgaagaaagttggaagattttcttgcattcggtgttgtaagatgacttgtaaaatactatcacgcacccaagcattattttgttctgctccaatatcatctaaaactagaacttgactagcttttatttcattgacccagactttagcattgtcaaagtctaaatccgaaataaaagttggataatgaagtagagtcgtcgaaataccttttttagctaattcatttgccatagctgcaagcatgaaggattttccaacaccgaaatcgccatagaggtaaagtccctttttcttaggaaaattggtaatgaaatcaactaaagcttgataaggtttgattctttgaacatcatcaagggcaatatcagctaaactaacttgctttaaatcttttggaagaccaataatacttacacgacgcatcaagctctgagcagcttgttgttcagctaactcattcgttgcttgataagaaacgtccgcataaccatgattcataattaaaactggttcatatccatcagcagcacgtttttccccttttttaaacttatcatgttcacgtacatattcataaaatttcgagtaagagcgttggatttcatcagaagtcatttgatgctcagcaataaaagcttgaacatctgtattttttagaacttctgtgactaatttttcaaaattttctcgaatatcttgtcgctttcctaaaatatctccgatagattccattaattttgctccccttccaattttttgagagagtcaagccttattttttcaagtttagcaagttcctcttggcttgttttattttcatagtcaggatttgaccattttggtgcttcttttttgattttcgttgagtgcttggtaacttcagtcttagccttagcagttgcttgttcttctcgctccaaaatacgctttacagccgcctccgctgtgaatactttatttctcatccaatcattcgccaaagcattgacaaagtttgggctgagtgaagcatttttttgttgaaccaaaacataatgaatcaaaatattttgaacttctgctggtaatttttggcgagtcaaattagctaaaattttatgctcatcagagctaacaaaacctccagcttgggcttttatctgacgaataaattcatcaggctcatgggctttactgacgacaatcaaatctgcaaaaacttttggaaattctgaaagtgcgggttgtggttgacttgttgctgaaagactacgaattaaatgattcatattcaaactcttatcggcattagctgtgcgttcagcctgtttgaataattcgtaccaattgagttcaaatttttctgcaagagaataaagtgttaatgaatcttggttctcatttgataaaatataaccttggcgttccatcagacttttaaatgcccccatatcaaattggttctcttttagtgattggtttggtgtggcttccctatcaaaattaactttataaacttcatggaacttcttagaaatttctttccctttgggttccattgtcttagctaaagctgtgacacgattttcaccaattcttgatattaaaagttgtctataaaagtcatcagcaaggaaaatttcaaaattgagaggacttttcacttcaaaataaaggctactatggtcatcataaactcgaactaatgatagagctgaaagtctgtcaagtgcctcaatgaacggattaagtccgagatttagatactccaaaaaatgagaaattcgacccgttgagaaactcaacatcatttggtagagggcaaaagcatccgtcccaataattggtaaatagagtaggcgaaaagtctcagcgtcaaagctggtctttcctcgattaagcattgtaaatgaatctcctgctctcatttttccctcactctagttttactgactgtttttaatgacagttctttatccaccgatttaatgctcattaagaaatcagtctttattttttagtaatattttttagaagctcttctaattcactgacatctttaaatgagcgataaacactcgcaaatcggatataagtaatatcatctaattcagctaattcttgcatgacaaattcgccaatcacatctgattcaacttcattactatcaagctgccgaatttttcgttcaacattggcaactgttgtttcaatatcttcacttgaaacaggacgtttataggctgaacgaactaaaccacgaacaattttttcacggttaaaaggttcgcgtttgtcatcttttttaatgactaaaaggggcatttcttcaatacgttcaaaggttgtgaagcgaaaaccacatgattcgcagacccggcggcgacgaatcgcatcttcggcttgtcttgaatcaacaacttttgattcttcagaagaacactttggacatctcatattattctccttagtttagataataaactgttattagtcttactgacagaaattttctatttattaaaaattctgtcagtaacttttttaattattgttaatgatggaatcgtcagctgcgctgacaatccctttatcttccaataaaacactctctggtcatgttttattgccgcaaatattttaatttatttttttggtaaaaattttgcttctagtcgataaatcacttgtcctttttgtgaaaacttttgttcatattcagtcatcacattttgaggagcaaattcttcatcttggtgtaaatctaaccatactttttttagctccatgccatagcttgctaaagaaactaatgagtattcaaacaagcctcggttgtccgttttgaaatgtatttcaccttctggacgtaaaatcttttcgtaagttgcaagaaaagatttataagtcaaccgacgtttttcatgtcgtccttttggccaagggtcagaaaagttcaaataaacttgatcaatttcaccgtcagcaaaatattcgctcaaagctgccccatcaacgagcatcatttggacgtttggtaaatcagcttcaatcgccttatctaatgcataagataaaactgataactgcatatcaattgcaatgtaattaatttcaggatgcaaagcagccattcctgtaataaaagcacctttcccacaaccaacttcaatgtgaattggatggtcattgccaaaacgttctgaccaacttcctttaaagtctgctggattttcaactacgatatgtgcgttttcagcaagcatttcgcctgctcctttacgatttctgacgcgcatttttacctcaatttgttttatttttattggaaaatcagtgaatctgactttccttttgtttgttgattttgattattcaattataagccaaaaaataggaaggtccaaaccctagcctatttttactaaaataattcacaaaatttacgaagtcccaagatttcttggtttacttctttcatttttcctctagaaagatattcagaaatttgccgaagaaaagaaagttttccataccaatccactttttccataatgtcagaacgtggtctcacaccagaagtcatcagccacaaagaccagttagttggtttgatatagtgtgataaaacatgtgccatatcaaccatggaatctgataaaaagaccgtatcccaatctacgagataaatttttcctgaattatcatccactagccagtttttgtgattgacatctccatgaacaaccacgacctcttcatttttgatttcaggaatttccttgcgcatttcttcaataattcctgagagaaaatggtttgtttgtaaggcttcagtatttctgacacaatcctctaataattgttcaggcaaaacaatctgacttcccaattttttataagattcaactagtttttttgagtcatgcaaatgtgataaaatatgattaatctgacggtcttccatatcctcaggacttagcgtatgaccatcaatccaaggttgagcagataaggtgtctccttcagccgtccgttttgtccataagactttcggtgtgattccttccagataaatgcttggcaaaaaaggactaccattttttttaataaaaacgcgttcttcatcactttttccaaaaaatgcattgcctgagccgccttttacaggcgtcatatcccaatcagctttcatcatccttatctcctcctttcctttaaaattctattaatcattttttgatacatctactttatatccaaaaattaagcgtttggatagtgaattagaatagtttgagtcaaaatatcagcatattgatatgactctgttgttttaggaccacgagctgggatattttcaataatgaaatgtgttgcgtaggcttcaatcaagttcactttatgacgattttcacgtttacgaccaaattgtgaagtaatttcaatcgtttcacccaaatgtgcttgaactttttcacgaatatcaacgatttttcctatttcttgattttggttatccattttttcctccaaataaggtaaaaatcggattactccgaactttaccttattaatctaattttatccttgattatttacttctttttctaatctaaggaactgtatatctgctaagttttcataatataagagaacataaagcttgtattttttatacttcgcttatatttataaacagaattagacaattactcatattataacacgaaacactaaaaaaaatctagtcgccatatcggttatcaatacttgcaaatttattatgctctttaataaagagtaattcaactgttccacggcttcctgaacggtttttttcaataattacttcaactttattatcttctaaaatttcttcaccgtcttcatcttcaccattgccacgttcataataatcatcgcgataaaggaaggctacaatatcagcatcttgctcgattgatccagattcacggatatcggacaaaacaggtcgtttatcctgacgttgctcaacaccacgtgagagctgtgatagagcgattacggggacttttagttctttagctaaaattttcaactgacgagaaatttcagagacttcttgttgccgattttctcgtcctgttccagaaatcaattgtaagtagtcaataacaatcaaaccaagatttcctgtttcttgagctaatcttctcgaacgcgctcgaatttctgaaatctttatccctggtgtatcatcaatataaatactggcccgagacaatgttccggttgccataaagtagtcattccactcttgatcattgagttgcccagtacgtaagctatgtgaatcaattgaaccttcggcagcaatcatccgactaacaagactttctgcacccatttccagtgagaaaatagcaacggtccggtcttgttttgtcccaatattttgcgcaatatttaaggcaaaggctgttttaccaaccgcaggacgggctgctagaatgattaattcttcttcatggagccccgtagtcatattatctaaagcaggatatccagtagcaatccctgtaatatttgatttctgctgggctttttgctcaaggtcatccatgtgaatggctaagacatcagatatttttttgaaaccatttgtattgcgtccctgttggacatcaatcaaacttttttctgcttgagctaaaatatcatccgctggcgaatcttgctcataggctttttcgactgattcggtcaaacgattaattaattggcggagaagtgatttttcggcaacaattttagcatagtaggccgcatttgctgctgtcggtgtcgccgttgctagttcagcaatataggctattccaccaatcgcttctaattctccctgattttcaagatgtgaacgaatggttagaacgtcaattgcttcacgagcatcagacaatttttccattgttcgaaaaataattttatgagcattcttataaaaatcatccgaacttagaaattcttttatttcgactaatcgttcactatctaaaaaaacagccccaagaacggcctgctcagcatctaggtcttgaggcggggcttttattaaatcaatttcgggcatctattttaagcctcgcttattttgactttaaccatggctgtcacatcacggtgaagttttactggtacgtcttttgttcccaatgcttgaattttgttaatcaattgaattttgcgtttgtccaattttagaccaaattgacttttcaatgctttagcaatatctgctttatcaaccgcaccaaaagtatgaccggtttgtccaactttcatcttgatttcaacaacagtttcatctttttcaagcacttctttaagagctttagcttccgctaaaagttcagcttcttctttttctttagctttcgcttgtcctttgacttcagaaagagctgctgctgttgctacttttgccaaatttttcttaatcaagaaattttgagcataaccagtcggtacttctttgatttgacctttttttccttgtcctttaacgtcttctaagaatacaactttcatttttcattttctctttcttttaatatttcaattaaatcatcttgtacttcttggatattcttttcataaatctgtgtcgcggcattgttaaaatgtccaccaccgcccatttgttccattattgtttggacattaaatccattacgagaacgggctgagattgagatgtatccatttgtatgttgagtaattgtaaatgctgcggtgattcccgccatgtctagcaaagtatcagcggctttagctgttgctatattatcatatttttcatgtttaagtccaatccctaaagcaataccaggtaaaatcatttgtgaattaagcacgatttcatttgtctttttgtatttttcaaaatcagtcgccataatcatcttaatcagatcattgtctgaacctcttgaacgtaaataagccgctgcttcaaaggttctttcagttgttgcttttgtaaagttttttgtgtccagttcaatcccagcaagaacaatacttgcttcaattgttgacatttttctttgattattatcatgaaattgcagaatttcaactgtcaattcactggcagaacttgctgatgattcaatatatgaaagtagggcatgttctggaaaatcatcatcacgtctatggtggtcaatcaccactaatttttcaaaagatttataaaaatctagatttaaggtttgactggttttagagtggtcaaccataataagtaacgaatcttttttcttgagcttttgagcggtttctaatcgaacgatatgtgtaaatccatcagaagattcattcattttattaattgcacgttcaacatctggcaataattgctcagggtcataaaccacaaaggcttctttccctgacatattagcaaaagctttcattgccactgctgcccctaaagcgtccatatctgtaaatcgatgacccacgataaaaacatcttctgactcagcaatgattgtccgaagggcagttgagatagcccgtgctcttgttctacttttttgagttctactttctgaatttcccccaaaataaactggacgagcttgcggtgtattttcacgcaaaacaacctggtcaccaccgcgtacttgagccaactcaaggttattaagggcaacttttccgatagtaggaaaatcattccaaccataagccacaccgatagagagtgtcaatggaatttctttttgagctgaaagttctctaaattctttgagaacagcgaatttatcattaatcattttttcaagaatacgataatcacagaaaaaataatgacgactgctgtttattcgacggagataaattccatacttgtcagcaaattcttctaaaaatgacgcgataaaactattaatcgctgttcgaccactatcagtaatcaaatcagttgcatcatcataattatcaactgaaatcgcaccaataactgcacgactgtcattaaattctgatttaaaagcaacttcttttgtggcatcaattaaataaataaggtttttatcagaatcaagttctgcaacatacttttgcttaccaatagtgatatattggtcatcacttgcattttttaatatttttttaatatcatcacgattaattactttgtcattccctttgaaaatcatatcaataaagggattaaaccattcaggctcgaaggtttcattattgaaacgaatgactccaattggcatattatccaaagtagcattgagtgaattttctgcttcatcattgattttacgaataaaatcttgacagcgcaactgataatttcgggtttgagatagtaagatgatcgtaatcacaatattcaaaatcaacaaataaaccaagattgaacaacgagttgctgaagcatggacaactatggtttcaatgatttgaacaataaccattatgacaataatagcaagcggtgaaaaccgacggacaaaattcataatattactcctatattcctctattttaacataggacagaaaaaacttaaagaatcaccgattgtcagtgatttttctcttataattttttattaaacattcatcatttttactgacgaagctgtcagtaatttttgaatggctgtcagtgattcaactttcatgtcagctttatcttggttcattccaaaacgtttatcttcaatggcccatacagttgcatcagctgatttacctgcctgaattcctttttcagaatcttcaataatcaagctttctgttgcttctactcctaattctgacattgcggtcagataaatttctggatttggcttagtttctttaaagtcatttcctgaaaggatgacatcaaaataagaacgaagctgatgagtatccaacatttgattaatatcaagcattgacgagcttgaagcaagggcaattttcacttctttttgacgcaaaaaagttagaatttcttggacatcaggaaataaaagttctgcatagggcatcgggtgattgattttaaaattctcataatcggcttgtaacttactagccgcttgttcatcaaagtcgtcacgcaaaatccgaggccaaatatctttcatatttcccccaataaaatcactcgggcttaaatgattgattgaaatcccatgtccgccaaaaaattcttctcggcgttgtaaataatagcgctcagtgtccacaagaacaccatccatatcaaaaatcactgctttaaatttcataaaaccattataacacagtccataagcatggttcaatagactccgtcaaaagacatttttaagagttgaataaattagttgacaagacaactaattttagctatattatattgagatggaggttataaatgaaagataatcaatatgaatatcacggagtacagtttatcggaaagctttcctctgagatttatcggagaggttatatttattttacaaaacgtcttctcccttttggaatcaattacattcaattactttgtttgatttctttatatatcaaggacaatcaaagtcaagaacaaatcactgatgatttgagcattgataaatcaagcgtacatcgggcaattagaagcttgattgaaaaagaatatgtagtgagagttcgggacgaacatgataaacgagcttaccgtgtttcactgaccaaaaaagccagagccattcaaagtcagattgaagaaatgacaaaagaaagagaaaacttactctcagaaggaattgatcctaaagagaaagaaattgcttttaaagttttgaatcaaatgatacaaaaagcaaatcaaatttatgaaaaggaaaaaagaaaaaatgatgaaaaaaaataaaaaagccgttgtattaggtggtggtggacattttggtatcgcttgggaactaggttatttgagaggtttggaagagggaggactaccaatcagagaagcagatatttttgttgggacttctgctggctcacaagccagcgttatcgttacttctgataaagattgggacttaaactggaaagagcaaattgaaaaagagattgatgaaatcactccaatttctgatgaaaaaatgggagagcttttcaaaacctttgaaaatattgcacaaactgctcattcagccgaagaatggatcactgctgaggccgaaatttctaaacaaacaaaagcttttatcactaatcaagaacgtttagacatgctaaaagaacgttatggttcaggtcaagcttcttggaataataaattgcgaattgtagcaactagcattgaagacatcaatcgaaaagtttttgatgaaacttcaaatgtggatatctatacagccttacaagcaagtgctgctttacaaggtgtctggccttcagtcgaaatcaatggaaaacacttttttgatggcggttctttctcgatggaaaatcctgaccttgtcaacgatgctgataaaatgatagtgttttctaccggtttacctgtggcggttccttacaaactggatgagttactcactcaactggaagaaaaaggaacgcaaaccactttagttctcccatcagaaaaagttatgaatattttaaaagcctttcattataataccgtagaagcaaaaatgcgtcctactgttgctgaagctgcccgtgaacaaggacgtgctgatgctccttttataaaaaagaattggtgataatttttatgaattcatagtcagcattttcatgctatcttctaagggaaacttactttggaatttttctaaatgtaagttttttatttaatagtgaaacatcgcttatttattgaatactctccaaaataaaatgagttatttattgaaaattatctgaaaattagctataataaatcaatttataatttaatttaatcttgaagggaaggtaattttaagtgaaagttgcaaaatttgggggttcatcactcgcatcagctactcagatcaaaagagtttttgatattgtccaagcggataaattaagaaaatttattgttgtttctgcaccaggaaaacgttcgggggctgatactaaagttaccgatgctttaatttcttattataaagcttacaaaacagccgatgataaaggaattcaatattatcaaaattggattattgcaagatttcgtgaaatctatgatgaacttgagttaaaaagttctgtcattgatgaaattgcggacaatatccacaacttagctcatttagatttggagaacgtctttacttatgacacttttttagctgctggagaaaataataacgctaaattaattgctgacttctttacacattctggcttaccaagtcgatacgttcatccatcagatgctggaatcactgtttcttctgacccaggaaatgctcgcttacttggaggggcttatgaacatatcaagtatcttaatgaccttgaagaaaccctaattattcccggattttttggggttaccaaagaaggcgaagtctgtactttttctcgtgggggttctgacattactggctcaattattgcagctggtgtgagatctgaactttatgaaaatttcacagatgtcaatggaatttttgccgcacatcccggaatcataaaaaatccagcttatatcgctgaattaacttatcgtgaaatgcgggagttggcttattctggtttttctgtcttgcatgatgaggcccttgtccctgcttatcgtgcccgtgtccctctggttattaaaaatacgaataatcctgagcatccaggtacaaaaattgtcgtgcaaagggaaacaaaaggttctcccgtagtcggaattgcttcatctagcgccttctcttctctttatgtcagtaaatatctgatgaaccgcgaagtaggatttggacgaaaggtgctttccgttttggaaaatttaggtgttcgttttgaacatatgcccacaggaattgatgacatgtctatcattattagaagtcgttatttgactcaacctatttccaaagccttaatttcaaatctcaccgagtcccttcatcctgatgaagtttatattgaccgtgatttctcaattattaccattgtaggtgaagacatgaaagaacatgtcggtgtcacagctagggcaactgctgcactttctaagcaaggaatctctattgcaatgctttcccaaggttcaagtgaagtttctgtgatgtttattgtcaaagaaaaatatgagcaagaggcattgaaagccatttattcagccttttttgattaattatttaaataaaaaatagctctaagagctatttttttattcgtttattttttccacagtttccaatttctcactggaagttacacgattagaaaaattatttagtaaatcaggcacatcaattcccatcgttcctaagacatcaagtccttgttttaaactttcttgtgacattccgagaatttttgaagaaccttctccaccatagatattgattgaatcaacagcttggagattgcttgagacgctagcaacaacatctgggaggatttcgagtgccatgttcaatttggctgcatcattcatttttagcattgcttccgcttttttatcaatcgcttccgcttcggcaagccctttaagacgaatagcctcagcctcagctttcccagttgcttcaatggctgtggcttcagctaaagcagtcacttcacgttgtttcgcggttgctttagcagtcgcttcaatggctgccgcttcggcttgagctctgacttcacgctcacgagcgtcagcttcagctttagcaatttgagcagccttagctgcttccgctgctttaacgacattagcttcattttcttgagctttacggagtacttcttgtgtttctaagtccgtttctctttgtttcttaattaattcaacctgcatttctgcttcggttgtttcttttttagaaatcgcttcttgaatggcataagcttggtcagcagaggcttgagcttggtcagcttgtgctttggcttcggctgcagcaatcgattgttcttgctcatagtgggcaagactgattgctttttccttttgcgcattggcaacttgtgtagcagcaagagcttcggctttttgagcatcttggtcagctgctgctttttgaatccgcgtttccttatccgcattagctacggcaatcgctgcttcttgttgaacacgagctacttctttagcacccaatgctttgatgtagttttggtcatcacgaatgtcattgataacgaacgaaacaattgaaagtcccatttttgataagtcagtaccagcttggccctgaacctctcctgaaaacttattacggtcttcaattaattcagaaaccgtcattgttccgacaattgcccgaagatgtccgcgaagtacttggtcggccatagcgtcacgttgttcatctcttttacctaaaaattgctcggcagccgtcgcaatatcctgcaaagtcgaacctactttaatcattgctgtggcttcaaccgttactggaattttatcttttgatagcactttttcggttttaatgtcaatcgcagcagattgcagactgaggtatcgggcattttggaaaatgggtaaaacaaatgttccagaaccccgaacgactttcaagcgattgccttgtgagtctttattgactccttttgaacctaggccagaaccataaacgataagagctgcttgaggtccagattttttgtaattggcagcgataattcctaacaatatcaggataataacaatcactgcaattgccaaaatgtaaagtagtggcataatttctcctttagataataaatttttatttattccagcaatttttaaagttattgattgctaaaaaatcgtttgtttataaggaataacataagcaattccagacttactttcaataattagaacttctgcaccttgttctatctgatcaatcttatcttttgacgataaataaatttttgctggcatcgtcttacgggattcattgacaaaggttgtcatgacttcacctgttgcttcttttgaactgattgccgttgtcaaaattcctgtcagtaaatctttttcatcagcattatatttctgatctgatactttattgaagaaggccattcctggaagtaataagaccgtcaataggataatgagtacaattataaccaaagtaataataataaaaatcatagtcttattctccttgaaagcgttttgttacactttattaatattataacattttataatgcctattgttagtgtaaattacctatttatttagttttatgttttttcgcagcgactcttttttgccgttcaagctctttttttatttttccttctggagcaaatttttcttcccaatcttccggcttcaagaccttatgggtcactgggtcaaaatgtggacggccatctgggaaaattttacccatatttgcttgatggacagcattaaaaatttcataagggtcaattccagaaaggacgagcgagccataagtgaaataaagtaaatcaatcatcgcatctacttgcccagttaagctgtcttctttgtgttctttcgacttgactttatctgccgctttgtccactgcttggtgtaaattttcgactaattctgtgaatttttcttgatttccatcagcggaagcatagagaaactcaacaatctcttcaactttaaaatcagcacggaatcctgcttctgttggcggaaaagctcttggaacttcttgtgttttgccatccattagacgatggaaatctttaactttattgaaattttgatcttttgatacaaaatctttttcaactgaataatgaattaaaccatggtaggcaagagctttagcaattccatcttggttattggtatccgtaacataagtcgcaactttttttacctcggctacagcattacccatagcaatcccataacccacaccagaaatcattgtcaaatcattttcagaatcaccaaaacacatcacttgttctaagttaaaaccaaaacgttcgcctaagcgctgaatccctggtaattttcctcctgattccgaaattaaatcaacagaatagggattacttctggtaaccaaaagttctggaaaggcttcttgcaaacgagctgtttcatttcttgtagctaccatcatagcctgatatataaattcttcttcgttatccgccagttttgaattttgtggtaaaacgcggcgaatgacatgtttgaaactgtttctagcgactccggatgttccagagggcaagactcctgatagaaagcttgctagccgcgtttctccaaactttaacaagcctgaaccgtttacaccatgtgctgtccctaaagagatgtccgaatgattttctgtcgcataatccattaatttctttaaggttttttgttctaaaggattttggaaaataacttctttgggggtgaatatatactgaccattataagtgactgcaaagtctaagtctaaattctctagcaaaggcatcacaaaagcaggcccacgtcctgtggcaattccaacaaaaatatctttttggcgaagctcttgtatggctttgcgggtactcgttgctactccacgggttgaagtaaatagggttccatctaaatcaaaaaatactgcttttatatccatctctcaaatcttttctagctctgatacagctttcatttattatctaaattatacagtaattttaaatctatttcatttattagttattaatttaataaataaaaagcagttcctcgaggtgctccaccagttcctgtgactgcaggtccccaccaaaccacacgtccagttggttcaatatcaatatggaatgattcagtaccacttgccaagtgaccaactaaagatacagtaacttctggtctaaaatcaggaataatccatgatgaaccgtctccgcccatctctgccccatgttttacagtggtcattgttccataaaaacgtacctccacaaaatttcctttttttgttagcctaatgctcatcccgtttccgacattaacattaactgttgttgttgtttttatacctccagtaatattcaagttttttactgttgtatcttcggtaaatgttttatttccagcaattgattcgttaccagttttatgaacaatatttccgccactggttaattcagagttgattgcttccaaatcatcattaatcgtttctgctccattttgcatgccacgatatacttttttaatactagccattttcttctcctatttctattatttggttagtgttgttttaaaagcaacactttctgacttgtcgctttcaacattgccatttatttgactaacctggacgttgtatgatgtgcccgcctttagattttccaaatcaaatgacagaagtttacttccacctacaggcacaccatctaaataaacccgatacttcatttcatcccaatcgtacttgcttgagactatactagaaactgggttagtatcaacgtaagttcctacaaactttggccagtcagcagttgtgacttcgctagctgatggcatgtatggagtcagttggtcttgtaattcacttttacttggcatccaaggagttgctactgaacctgactctagttttggatttctaactctaattgtaaaactaccttcactatgaccactgaatatagtcgaaaagagtgcttccgtgttgacagcagggtcttcataaggtggtatcgttgaagtttgtgttattcttatccattggttcagcattttgctagggtctttaggtaaatctatagaacatatacgcttccatgagcttattccgccaccgtaagagtatcgctgacccatccaaaactcgtcaagatgtgttccagcagggagattccaacttgtgaacataacgtccatactcatcgtatatttgtcgttaggtttataatctctaggtttcatagagaaaccatccaacaggcttctaccaacccatgtattagtcccctttattgttagttcaccatagccattttctactttgtcgaaatctttaaagaatccatctttggttttatctgaactattaactaacaaattcaagttgggataattagcggttaaactgtcagtaacagtcgaaccttgttcccacttatgaccagcagtccataaagcacctgcgcctgatatttcatatttggcataaacaacatcaccagcgttcaaagttacagtaaaaatgtctctcgtccaatcaaaattatttcctaaaatcttgttaggcaataaagcatttttttcatttataaagataagtctgaatacatttgcattatttcctgaacttttaacataagctgagaaagtataaactccgctttgtggtgctttaaatgttttatatataccgacccatggttcagttcgttttttaacagttagacctttatatgttccgtcagttacccaactttttgaatttgtccaatctccactaaaatctttagtaccgtctaacaaattcaaattcggataaacagtcgtgaagccatccgtgccgtctgcgctgttagcgtaggcggtgtgtaaataatttttatctgccatattatcccccgttttcccacgaaatttttgcacttgaagaagtgatatcataaacaattagattagttggtggcttcactttttcaacatagcctttggtgattgttgcgccctcaataacaaaacgcataacctcagttccgttgattaacaacagttcgttaccattatttacaacttctccgtccattgcataaactgacggaagctcaacattgactttatttctgatatagcttaatgaagaagctaggttataaattcgctctccgccaaatactggaccagtatcaaatccattcgcttcggttccaattgaatttttgtaataagttactttcacatccggttgatactctgaatcgtgctcaattactacattaaacccgcttggaactttacgataaataattttattgaggtctaaaacttccgcaagtaaccgtcctcctggatcaattgattcaaggatttcacggtttgcttccacaaactgttcccagctatttttaccatcttcaatatacttattaaagattcgataaagctctttgaaagtccaccaatagtttgagtctttgaagggttgcgaataaatggatttctcaacaatatagtgaaaagtccgagtggagaattgctcaatccattgacttccttcttgttttctaaagctaaaatatgcttcatttcgtcccaccatttgcaaagcattatcactggcaacatatttcagtgttccatttttagcatcaaaggagacaacactttcttctgataccccttgacctgtaatttcttgtgccattaaacaaaagaacggctgtaagccttcaaagttcttaggttgaccattctctacaattcgagcaacaatcgcttgactgttgacatccgcatgtcttagcttaacaatgccgatattgttattaggctctgtggtggacagtgttataaaatgttctgtcataatagaccctttctaaaatttgatataatcccttggattcttaaagtgagcgtgtgatgatggccagtattggtccataaattggaagtgcaaatgtggtccagtgaccgggccagtcgctcccataagtccaatttgttggccctttttaacattttgacccacagaaacatcgattctgctttgatgtgcgtaccctgtataaagtccatccgcatgcttgatgaccgtgtaatttccataccagttataataattacttcccgcttggaccacttgaccatcgtttgaagctaagattggagttgttggattaccattaaccaagtccatagcattgtgaaattcttgcgctccagtgattggactagttctccaacccatttcacttgttacggtaatagggcttgaaattggagcaatataacctccgccaccgcttgggatttcaagattaacaaatttgttataccattcttgggcccaagtactacgttcagggtgtccgtttaagggacgttcaaagttagctacaaaagcttgcgttgcagtattgatattggtcaatgtcatgaattgagtccaagaataaggataagaacttttcgcaatccattggccgttttgtgcatgccacatcaagagcttaaattgggctgtgattgtgtcaggattgtcagtcactcctgctcgtgtcatgagattaatcatataaacacgtccagagctagcgcctgaactatccgtccattgccaaaccccataaccgaaaccaggacgtccgccaccctcatcagccgttggattggcatcagattccccctgtgcattcccaagtaatgcggccgcggcttgtttagagaaaccagccccaattgccattgcccagatttgccagtagcgtttatcacggtcacttgtgaattctggtggatgttttccattccatccattatcaccgccgccagagcttcccccaccgttggtatcaatttttacaccattaacatagagttctttggtattagttttaccgctaattgttaaatttccatcaacttttacttctccgtaaagatttaatttgcgattttcagccgtactgtctttgggaatttctaaaacatttaaaagcgctccgttgtttccctttgatgacaaggcgaaagaataaccatgattttgaattgcattaatcccttggagttgtccgcctgtataagttggcgcaaaagcaaacatctcattttcggacgacccatttcttttaataaaacgaattttcccttggtcaagttcaataatgaagtcatgatgaactgaacgaatcttgaccccttgcaaaactccggcattaataaagttagcattgaaagtcccgtcaagtgtccatgcagtattacttttgccattatgaacatcttgaattgtcgtccattgaccttttttgcattgcttaaaagatattccagcattattttgaatcatgaaatactgtgaatcttgaatccttgggccatccataaagacttgctcataggtctctcttgattgtgatacaccagcttcaattccgttgaccatgtaaatcgagccaccgttcgcaccagcacctcgcataatatcgtcttgatactttccaatttctgtggagtcataaaatgtcattttattattatcaaggtcagagatattgctttgaacttgtgacaactggcgattaattgagtttccacttaaattatcgcctagactagcttgcactcgtccattaacatggtcagtaaccactttaaagactctagtttggtagtgataatttcggtcccctctgtggattgaaacagtatttccaattgaatcactccccaatatctcagtactaaactgaacgagtggccgtcagtaataagccagttggtcataagtcttttgtaaaagttcgcttgcatcttccacatcatcaaagacaacaaccgttttacgtggtaacatttttccgtttgatggaatgccatattctttcgtcatttctggatattcaatccagttttgacctttaggtttatcaaggagctttccattagactttttccattcaacatctgaaaattcaattcttcgcccataaccgtcaccaacttcttcacccttcccacgtccaattagggcagtgacaatatttgtgcggtcttgttggtggacaatttttagaacttcctcaccatattcaaatcgcttattggttattttcccaatttggttatagcagtgaatgatttttttagtaatcttatttcctgtaatttcaattgaaaaggtaaactctgcacctaactcttgtagagcttttagagcttttagagcttctcgcatggaagtatagtagaaagtactggaaactgttttaattggttcacagacacctaatacccagtcacaacctgaatcagataaaagctgattaatcacataagaaaaagacctatttttaggtcttatatctttgatgataaaattatccagttcatcaacggcaaaatttacagcttcaaatgaaagcagattatcttcatcttttgcagttaaaattcgatataaagagaactcttgttctttcgtatcattgactgcaatatagctggcatctttaattgtttcatcaaaaggtaaagaaactgaaagtgtgtcattcattaattcagaagcgttagttgtgatttcttttgtctgaacagattctatgaattcatcggaatcataacttttgatgacttgttgcatcttatctaaaaataagatattactcactaaagcaccgcctttctatattgaatcgttaactcatagtttggacttgaaaaatctgttccagttgtcagtctgatatttttgaaatcagaatcaaggtctaagaggttattgtttactttcccattgagaaaagtattgcctgcttgaaaatcaaattccaatagatctccttttttagcctgtgatgatttcaagcgataatttccatcagttgcaagtaaaccctttgtcaataacttgaatgacagtttatccggtttcactggataaggcaaaacttcaatcactttgttttttacactttgaatttttccgtgtttaaatggatcactacaaaggacagtaaagcttgaaatgattgaattagtatctccagccacattatctgcagtttggaaacgtccataaaacgtatattccagatcatcattaaaaataatagggacatcttcttgacgaatcaagaacgcctttaaggtatcaaacttttcttgtaatactcgggggtccctatcctcaagcttatattttatcgtcaactctcgaggaggatatttaacattagtgatcacacctcctacttgcatgtcttgtgtttcaaagctgagagaatacatttctcgcccctcaactgccaatgtttgataaccttctatgagttcctctaaccaagccccatcataactcatggcgctggttggaataaaaggaaggttgcgataatgcttctgttttgtcgtatctctaaacttgtacatttctacctcctaaaatcccatatttaagttaattgcttgaccctgtgcattagaaatgtcatccacaaaggctttaaagatttgattcccaagcttcacagtgaatgaagccggctgttttccttggttaagattcacatcatgagaaacttgactactgattgagcgattagctgccgcaacgttcgccccaatatccacagaatagtcagaattaatggcatttgcaatcatgtcccccattcctgaaacattagattgaacgttacggaagcctccagttaaaccagaattcaaaccattcataatggcattaccagcgggagttaaaagttttctgtcgacacggattggacctttatgcttccgaatccaatctccaatcccgctaatgaacttcatcccatcttcccatttttgtttgagtcctttgacaaatccgtcaatgatggctttaccaatatctagcaagtttatattttttagattgttaaatgtcgtttttacattatcaatcaaatcacttacgctttgtttcaaaccgtcccaaattcctttgagaccgttaatcattccgttccacaagtcaattgtgccttgtttgaggttttcccaaccttgtttgactccgttcacaatagcattggcagaatcaacgacccactgtttaaatgaagcccatgtatccttgacccattgaatagtagcgttccataaatcaatcgttccttgcttgaatgaattccaaccattaacaattccgtcaacaatagacttggccatattaatgacccatgttgtgaaagctccccaaagactttgaaccgtatttacaactgtcgtccaaatattagaaacagtttgtccaaaagcggtaaagaaaccaacgataatttggacataagtagttactaatgtttgaatattagtaaataatgtttgccagagcattgcaaaatcttctttgaattggttaaagtccccagtgattaaatcaatgagtaacaaaactggtcccataacaaccgtcttaataatctcccaagctgaaccaaagatagttttgacttgcccccataatccgctaaagaaatcaagaattggttgaaagatttttttgattgtctcaacaaatggagctaaggttgttgtaacgctatcccaagcgctagataaccagcttgtcgtacctttccaaagattagtgaaccactccttaatgccattccaagcgtttttaacactatcaacggcattttttgcaccttggactgttccatcccagagccctttagctccatttttaatgttgttccaggtatcactgaaccatttgaccgcactgtcccaagctttagtaatattatcccaaacatctttggaaattttaactagagattgccatgcagaacctagaaattttacaaaatttgaccatattttctgacctgtttttgtttgcgtaaagaaatagactaaccctgctacaatagccgcaattgcaataactatcaacatgattggatttgcatccataactgcattaaaggccacttgaactgcagtagctatcttagtgacagtgttccaagctgtaatcgcgcctttccatagtttatatgctgccacaccagctgttattccagctactaaaggtccaatccaatctttattttgattaacgaactcaaacatggttttaaatgtagcaattattcttgcaattacactaataactggaggaatagtttttgtaattgcactaaaaacttgattaactacagtttttaacttgtcaaaattctgagcgattgaaccaagaccagcgctcttcattccgttatcaattgcagataaaacattctccaaacctttccttactgctgtttttacatttttgaacgaggtttttatccctgctgaatttttcttagcaagttccgcaaatcctccaacaccgtcattcaatttaattaatcgactattaaagtcatcgaatgtaattttcccactttgtaaagcatcatatagatcactaaccgaatttacaccttggtctttaaaagacttagcaactttatccattgcaatgggcattgtttcttggattgagctccacgattccatgtcaacagttcccttagataacatttgaacatattgttgcattcctcggcttgcatctgcagttgaagcaccagaagctagaaaagcattgtttaacgcaatagctgtatcagttccttttgttaagcttcctgtagatatagcaagttgttgagtattggatacaatttcatcaagagaggtaggtaagccatcaattcctttattcagttttgccattgatttatctacatcagaagcagaataaccaagcgcctgcattacaacaggatacttatttaaagtatcaaatcgatctattgcaccatctaatgaatttctaaccaaacctaccgcagaatcaacaagtttaaaaaccccaacaccattagcaatacctaggatagaagtatttgtattttgtgatcttttatctaatcctcccattgaactatctgctttattcatggttgaggtgaaatttttatcaacagcactcagaaccgcttctacactataagattccatgtttttcctcctttcttacttatttgcttttttcatgaggttaattagttttttgtcctttttaaaagtactgtccgaagtttcgattcctaaaatatcattttcaaatttttctttatcaaaaaacttcttgaaggtcgaataaactggaacttgcttcttaccttgttgcttagttgattgaacttgccaatttgcccatgcttgttggtaaataaattcttgctcatcaagtctttttagcctataagctttcagccttaattcatactccgaaatggtcatgcgctctatatctcttagattagcaattcggagataacgcaaacaatttaactgaacttgttcatagagtgtgtcaaaatctgttactgtagatttttgctgacttctttctcgaagttcaacgtttttttcttggtaaattccgacttttttaactcttcgagtactaaatcaaaaagcgcatcaataccattttcttcaatccattcaactatccctttctcagagacacgaggattttctgttgcattcgcagtttttagcatttcaacaagtgtttcgatatctccgctaaagaagttcatcaaagcattatctaagccggcttttaaagtcatcccgcgctctgtgacttcattttttttattcaattccttaatgaatcggtaaccaaagataaaaaaatactgtttgttattaattgttaattccattttgatttctccttaaaaaataaagactagagcgaatctctagtcttttgtttatagtatttaaattgtcacttctacaactgtactccaggcagagccagtaatattttcagctttatcccctaacagtatctttgaagacatactgaacaacattagcttgttcagtagttagtgtggcatatcccttttgaggtttaccgaacactccaaattctaaactcaattcaagcgcatcttctgagttaggttcataagagaaacttgtaagataagcacgaagatatttcgctttgtacttgcctgtgtctaatccgagagttgctttttcagctttatcaatttcccacacttcaataattgctgcatcatcaaacgctttgtccatttcgtcaagatgtggatcaccatttgctgcaatagatgtggcagacaaactatattcaacttctgcaagagcaccaactggtccatctttagttgctgtagtgttgtaatctcgagttttttcattcgagtgttctgtttggaatgcaagtttccaagcggcttctgttgatgctttactaagcacacgatagagcaagataatatctttcccttgtttggctgttaattctgccatattaaatctcctatcttagtctaaattctaagttaatcaacgctcttttaagcggtgtatttgttgttgtatcgtccagcatttgaatggtacttgcttgtaaattcaaagcccaagaatagccatctgtggcacttatattcaatgcttgattaaatatattgcttgccatatcagacacttccttgcgcttcttctgtaagccccaaacagataatgaaagacttactgtgcctttaatatccgttttatttggttcatgaatagtttgagtattctccaattcaacaaatggatagcctacttcattcattggcttataatcataaacggtatatcccaaagcttgtattcgtttgaacaattcgtcaaaaatagattggtctcgagttttaatcatttcgtcaacttttctaaatcatttgtgaatacttttttctgaatgttaaacgcaggttttacaaatggttgtgcagcttgaaatcgcgtcccatactctacatatccagcataatcagtatgaggcccagtcgttcctgaaagacccccatctgtgagttcactagtaattgatcgtctcatattcccagtatcaacgggagcaagcttttgcatattcttgttcatgcttacaatattgctttttacaacatgtttgacatcatcaagcgtggcattttttctcaatttcttttgcaaggcatcaattccagttattttcattgattgacctcctgcaaaataaaagtgtttctcttgcttggattgcggtaagtcattaaaacccactttttattatcaaactcaatgtaatcatattttggcatattaaaaaggggcatcattcgcatgacttttgccccttgtttaatatctccaaaaacttctacacttctgtcagttccaatatcagtgatatttgcgctaaaaacagttctggtaggctccttttcaacccattcgcctaaatcagggtcatagtgggagtcaggcgattctttgataaaagtaacttcatctaaatatctcaatacaatctgaacctccctatcttcttatcgccctcagtttctcttgattttcgccatgattcaatttcatcggcatactcgtcaaaatcagattctgaaaatgtcatgcttaatccttcttgtgagtaggactgcatgccttcttgaccgatacgattaaaacgcttcaaggaaacatccaaaacaacatattctagttctggcggtacttctttaatgtcagaaccaagaataagcaataaacggtcacgagtgcgtttttcgattacttccaagcgctcatccaatgaaccgcctaaaagcatttttaaatcatcagtgatagccataagcaactcctaattttgaaatcaaatctgatttcttatcgttttttgtatattctatccctttagtttcaagaagctcttttagctgattaacggtaagcgtcgttagttcatcatttttcacttgcttggtcgcatttatgtttttatatttatgcaagtggcgacttagtagccgccccattatacacccgtaaatgtgatattaacaacttttgttaaatcatagagatacgctgcgtaatgttcatctgcagtaattacagttgttttagtaacaatatcacggtcagtttctacctgaactccacgttttaaaactaatttcaaagctgggctatttgaaacaatcttgaacattagagctgaaccctcagctagttttttagatcgtacaatttgagcgcctaaaacatcagcgtaagttccgttgataagagcatttgctcctacttctgaaccaatgttttttgcgtttgcatctttacgaatttttgccgcatctttaggattgacgataagaacataggcttgtgcatcctcatcattaaagatatccaatgcagcttgaaccccgtcaacgtttgctttagtagaaacagtttgagaggtagtcttagctgctttcaataagtcgtcatcgactttatttgcaagagatagcccaagttgtttattagattctccaattggatcaccataaccagataatgcggcttcatccgtgatttctgtcccttttgcagcttttttaattttcactgacttagtagtagttccgattttatctaacgaaatttctccgccttctgcaacatcagcagcatcgccaatataagtaaaagctgggaatttcaaagtattacctggttgtccttgaagtgttgtgtcaacttgtgcaagaggtgcaaacctaagtgctttattcaattcgtatgaaacaattggtgcaagcacctctggatttactaagtctgcaagtgttgttttttgttttgacattttaatagcctcctgttaattttttaaattcatctggatttgattttgctaattcagctttttcagcataagtcatcgaatcaaatttttctttatcgactgatattacattacccggaacacgtttaggcgttgttcctgtgtttcgtgctttttcccactgtgagcgttgattatcaagtaaattgaggaaagtttttacattgctgtaagttttttcttcatcaacatcaactaacaatcctaattcagcagcactcaaagcaattccactttctttcaacacttcatcagcttgactggtaatgtttgaaattttgatttgtgctttaaggcttgcgatttcatcgtctttagctttttgaagttcggcagctttttcttcgtcagatttttctttaactgactttttgccacctttttcaagttcttcaatacgagacagcgcttggtcaagctgtgtttttgtttcatttttttcagcctgctctttaccaattcgtttttgaagcttttcgacaattttgtcattgtcagttgattgttcttgttgctcttctacgtttgtttctgtttcagtttccgaaccagcttcagacgtctcatctgctgcttcttctgcgaacagttgcaaattaaggggtaaaagttctgtttgttccatttctggttcctcctactcgcatttaaagacttgggagtctgattttctcgtgttttatttagtgtccacaacgttcggaaacggacataagaaaaacccatggaataccaaggatttaaagtttatttgctataattgaattactggctcatttgcctagtatctagtagaaaggaaaaataatttgagttctataaaaaatgcttacatcaagttctggtacacattgattttggtagctaatcagaaaaaagattcagatgctgaattagtggttttgacttccaatggtacgtatattggcaaacctgtatcttcaagcgaacttgaaacagactttgtaaaccaagcttgggaaatgattttttcagagagtaaaacaaataaattttctgaagaaataagcttaatacatttgaaaaatgttaggacacttgataactctgagtcctatggtaccttgacaatttttgcggaagatgttttaggtatcagcggaaatggcgatttaactgctccgtctgacgactgattatccccgataatatctctggggaaccaatccctttgactttataactaaaaggctgtaactggacagccttttttggttccttatttctgttactttcctgagtattttcttcaaagctataatcaatttgagaaagattatctaaaccatcgattttccccataaacgtaacagtaatttcagaaaaattattactatcagagttaattgtaacgttcgtcaaatgttttatttttgcaccattaactatcaacccttcattaaatttcacttcgttgtatttcggttcattattcattgaaatctaccctttcttttattgcgcaattcttcaatcgctttgtcagcttctgtcctgtcatcaaaagcttgcttgtactcatcttgactgattactttcctatcaagtaaatcatcccagaaacctttatcatcaacatgcggtgctgtgctgcatctacagaacggatgcatgtttggtgcattaataccaggcgacatatctttaagcttgaatattttaccattcaatgctccacagataggacaagctgacggttcagcaatatattcataactttcaatatcggcttttttatagctttcttcttgaatagctgtttgaattctcgttgtttctgaaactagcaatcgttgagcattgtaagtcgcattaagcttgcccttttctgtcatcagccttttaagttgtggggctagtgctttcggattgattccaccagttactgaacgaatgagaagtttttcaatatcagctttcaattcaaattgatactgccaaagtttgtcagagaaactggcaaatccttcgactttataacttccatttagcactgattcaactagactgttatagcctttctttggagcgcttaaaccaagaattcctgcttgtctttcaaattctgtgagagctgcaccagtcaaattctttgagaaatatttgtccaaatcgtcaaatacagcaatcaattctaaaccaatgtttgctttcagaagttctaaacgattcactctcatggtcaagttataaagtttcaacacttgatttgcttggtgcgaaaagtctttttcttctacgtatttcttagctttattggcaaatgctttgacatccattttatccgcacgtttcatggcttcactgatagaaattccttgaccattcgcaaagttctgccagttggcattgatttctttttgaatagcctcttgagcttcaaatagcttatccatgatttgtttcatgcgtttggtgtcatctttgatttgttgctcttgccaagctttctcacgttttttccagtaatcaggagttttcataggttactcctcatttgtttcagaaactactgtatctgttcccttttcactaggttgcttgtcctggtcaaagatagctgtagaagcttcttcttttttgattttttccatttcagcttggacatctggaataacagatatgacacttaaagcagtttcttggcttgtgattcccataaggatattagcagtctctgcttgttccttaatatctttaggctcattacgtgtaaaggtgtactcaatatctttccaagagtctttgttcgaaacattcgtacttaactcacaaaatagtttgtatcgactattcaaagaagattggaacttacgttgaaatgacaaagctaagttactcattgcttgaagcttgtaagctaacgagacaccacttgatgacccgaaagattcatcagagatattcgcaaccattgtagtttggaagattaatttagtcagtctgtccaatagattttctgtttgagaatcactatccggcttttctaagaatttgacatctacttttgaagtagaaccactttgattattctgattcttatcataataattaattagacgattatctttgatatttttagcatcttcttcgtctatttctgctcccatgaaaaccaaatactgatcgctaaaataatcaacgtcatttgctttttcactaatagctttattaaaagcgttgactaatgaaataacagattcaaagatactcattcgttcttcgttgaaatagaactctacaactggtaaatctggatatgggttgtaagtcccttctccaaagctaatttcgtcattttctccgctgattttaatagtttcaagtagagtataaacttctccttgaagttttttgtcctcgtcaacaccatatctcacggcaaataaaggctcttgtttgactgtatcgtcatagaccataaacatattttctggactattataaacaacattcgtttgagtgtcctcgtcttgatacaaaaactcaaaagctcgaccataaatacatgccatttttgcaagttctgattcttcatcttccatatcattcaaattatcaaattcttgtaatttagtaagtatttctttatctgaatgtgactttttaactggaatcccattaaagtaacctgtgaaagtatcaacgatatatttagtgaaattaacagctaaacgattgtcaggcttccaagagtcttttgccggttcatcatcaatagccataattccaagatacatattttttaagtactcataccgagcaacttctaatttatgtttttccataaacttggtaaccacttcaactgtgattggttcatcttttgaaaatgtcattaatttaggtggtttgtatttcaattagaaatctccttttatattttaaatgattttaatccggcttttattcgcttaccactcattgtctcagcaatcccggttgttgcatcgggcgcatcatcgtgtttatttttaccttcacgctgataagttgtcattgcttgatagtattctgggaaacgagtccgccagtcattaggaaatcgaacgtgctgttctatccaataactattggaataaattcgggcttctttattatttccttggaagaaatcttctacagcacaagcaactttaccttgaatcttatccctgacagaacgagcaaaagaccgaccgccattgttgcgctcgattcttgatgcattcactctgttattaattaattgattggccactgcattttctgtgtattccatcggcttttgagtgtaaataatgtctagcacatctgcaaagccgtctgtggtttcaccccacacaatcgaacagagatagtctttcccagtgtctgcagtatcgcaatagttccaaatctttttgtactctgaacgagcattgtaggtttggaactcactatataatcgacctttgacatcaatcggctcttgttggtagttggcgctggcaatatcagcacccattgtttttactttgcgcttataatcttcaagagtcagaacgtcagcacatagcatttcatttgtctgttcattgaaagctttaaaattaatatgctttactcgatagccattcttaggcagttcacgcaaagctcgtccggctaaatcttcactatgccaacgagtcatattgattatgattttaccgcctgactccaaacgtgaaagcatggtattaacaaaccagtcccaatgtttttctaatactgtcgcgttgttagcttcctcagcattcttgataacatcatcaatgataataatgtcagcaccaaaacctgttgcagtccctgttggagaggttgccagatagttattatagccgtccgacaaactccaaaggtttttcgcagcatctccatacttaattgcagcatcgaaaatatcagagtaaacgattttgttctcatctgctttttcttcttgaagcgtattacgaacatttttagaaaagacagtagataaagtttcgttatatgaaccagtcatgattttcttcgtgtggtcattaccaagcacccactctacaaatttaccaagcgtgagagatttcccatgacgtggcggaagattcaaaactaaaacatcatgctcattatcatttagaaatgactgaaactcttcacacatagtcactaaataagccctatcacgtttataaaagcttggcatgatgagattacagtaatcaaagaaaaagcgcttagacagctcaatttttgcccctagcgctattttatccatcacgactagccaactttctaagttcttctgtcgataagtctacaaaaggattggttttgactgaaccagataattcaactttgcttgtataatcaccatccattttattaagagtgtcaattgccttaatcatgtcagcttctttttcggcatttttagctatctctgataaagtgaccattcgctctttacgagtcattatagcagcatcttgagcttcttcttggagttccttataccttaccaaaaccttaccaaaaagttcgcttgcttttacatctacagttgaatctttccactttgatgattgcttaaatgcttctctgtatgcttttcgttggctcatgccagaaattaggcattgaacaaatttttcatgtcttgcattttctaatactggcatttaatctcctttccaacaataaaaggctgcccattggacaacctatctttttcatagtctagctatacttatcatttcttcaaccatttgtaaaccagaataaatattccaatgaataccccacctacaataacagatgcaaaggccagagctataaaattaatttccattattaaacttcaactcctagtttgttatttacactttcaaaaagttctttaaataatccctcatgattataatagtcagtgagttttattttaaggacatctaatgggtcaactttttgtccagtaaaatcttcctttagagaagaaacaaccattgccaacagcaacattatagtggcagaagacctatttatagattcattattttctgattcattatttcctgattcagtattttctgattcagtattttctgattcagtatcattacttcgataactttcttgaagcatttctgttagtaatttaactgttcttcctgaaccatatccaagtgtttcttgaacaagcttccgtaattttttctgtccgttcttagaatcaagcgactccattgcatttgtatcaattgcaagttcggtccagttcatcataatctgttgcagattcccatcttttcgataaaattcatcaatctgtaactccttattaaattcaaattctctgtcactttttaatttatcactcaccatttctggaattttctttatcatataaactgccaaaataaatatacatatacttataccagaaataatataatccaaaacatccttcacaacttaaaaaaatcttaattctccacactggtggaacaatttcgatggcggaagatgaaaatggtcatgtttccccaaatgcaacaaatccaatgaatgctgtgaatatgcaatttgatgaaatcgacttggtaacagaagatatttttaatcttccaagtccccatgttactttaacagatatgttggttttaaaaaatagaattaaaaaggcatttatttctgagaattttgatggtgtggtgattactcatggaactgacacccttgaagaaacagcctttttccttgatacgactctttctcgtggcaaaccgattgtcctaacaggtgctatgcgctcaagtaatgaattggggactgacggaatttataatttactgacagcaattcgtgttgctgctgacagtaattcaagtgaccgtggggtacttgtggtaatgaatgacgaaattcattctgctcgttatgtcactaaaacgcacacgactaacgtgtcaactttccaaactccgacgcatggtcctgtcggtttactgaccaaaaataaaattatctatttccacaaagatagtgaaaatcaacatttggatgtggcaacagttcaaggaaatgtaccgatcgtcaaggcttttgccggaatgactggtgaaattttagatttattagatttagagaagttagacggaattgtcattgaagcattaggtgccggaaatctcccacctattgctagccaatcactgcaaagactcttggatgctaaggttcctgttgttcttgtttctcgttgtttcaatgggattgccgaaccagtctattcttatcagggtggcggttcacaactttacgaagctggcgtgatgtttgctgacgaagtgaattctcaaaaggcacgaattaaattgattattgccttaaatgctggtttgaaaaatttatcagaattacgtccttttttggaaaattaaataaaaattactgacaaaagaaagaatcatcagctgactgatgattcttttatttgccgatttaaagctcattattcaatcgctactgacagaatcgtcagctctgctgacaattccttcatttgccgatttaaagctcattattcaatcgctactgacagaatcatcagctctgctgacaattccttcatttgccgatttaaagctcattattcaatcgctactgacagaatcatcagctctgctgacaattccttcatttgccgatttaaagctcattattcaatcgctactgacagaatcatcagctctgctgacaattccttcatttgccgatttaaagctcattattcaatcgctttaaactgtcagtagattcatttcaagttatcttgtaactcttgccaaatttgttggttttcttctaaagaatatgaatttgcacctgaggctaaagcatgtcctccaccgtcatgtcttttagcaatttcattaatcggtgttacttttgagcgcattctcactcgaaaatgcccatcaacttgctcgacaaagattgcccatgattcaattcctcgaatatttcctggtgtcgaaacaatacttgaagtttcagcgtcgcgtaaatcaaactttttcaaaatttcttgagttaataaaactcgagcagctccattttctgaaacttccatattttcataaacaaaaccttgcaaacgggcaactttcatatcaaatgacgacatttcacgtcctaaagctgggcggtcaaagggatattcagcaagttttgaagctacttttaaagtattgggcgaagttgctggatataagaaacgtccagtatctccaataattccggcataaaggagacgcgcagcttccttattcaaatttagaccattttcaaatgcaaaatcagcaacaatttctgatgctgagcttcgttctggctcaactaacaataaatcgccataggcatcgtcattcggatgatggtcaattttaatcaaaaaatcagctttttgatagcgttcatcatcaattcttggtgtgtttgctgtgtcacaaacgatagataagtatttttcatcttcactaagttcaatcgtatccatttcggccaaataggttaaggttggttcatcataaccgaccgcataaattcttttttctggaaaattttctcttaaaatagcccgcaatcctgcctgggaaccaatagcatctgggtctggatttttatgtctgtgaatgagaattatctcataggctttaattttttctaaaatttcgttcattttttccccttttttaatctatcaaatgaaaaataagttttaagtctgtgaataatagaatggacagtagaactgacaattctgtcagtaatttttaggttaattggacattaactaaaactttggcaacgatattattgacgtggtagatttcacagtcgaccattgctccaattcgtgtttctccaattaccttaggataaatttccaagacattgtcaatcgccgcagcccccatcatgtgcatgtttaaggattcaatgataatattacgacggcgtcttttggtaaagacccgttgaaccacttggctgatgagttctgaaaaaacaccattcgcaatcgttcccacactattaatcataaatggttcaacagtcaaagtataagccgaacctttttctaccagacagttggcaatattatcactgaaagtatgggccacttgactctcttcttgagctttttgaagactttgcagaaggtctgattttgtaataatccccgcataagaataattttcatagacgacaggcatcatatcatagccttcatatatcattttttgcgaaacactagccacagtcatgcttgctctagcaacatttgctcgagtcattactttatttaagggtgtatcattttttttattagtgacatcacgcatggcaatgaccccaactactacattatagggattaaccacggcaaaacgactatcattcgtttttttcactaaatccaaaaaatcttttacggtatcttcttctcgtaaagttgctcttttttgatgaaacacatctccaacggtaatgacatcttttttgatgagttcattggctaaagcatgactaatccgattggccactgtaaaagtatcataagaagttcgtaaaaggggtattcctaactgattagcataatctacaacctcttggtcaacatcaaagccccctgtcactaaaacagcattttgttctcttaaagccaaattttgaatttcttttcggtccccgacaatcactaaaccattgggtgatagatagcgtttaaaggattctctttgcattgccgaaatgacaaatttactgaattcaacttctaaaccggcaagtcctcccaaaacgtccgcattcgctacttctgccaacttaccaaaggtcaaacgattggcaactttttggcctttaactgctactctaacagttcccgaacggtcattaacagcaactaagccaagtgtttctgcctcttttatcgcacgatatgccgttccatcagcgactttcatacgattggcaatcccacgaacactgacttgtttgccaatttctaacccttcaatgtaacttaatatctcttcatgctttgacataaaatctcaaatttccccaatctctgatttttttcgataaatttcatagtcattttttctttgctcatactgttcaaaatttcttatttttgcactatactggttgcttcctttaaattttttgaccatttgatagcctgatttaagggcaactttttttgaagctggattttctttatcaatcaataattctaattttttcagtgcaaattgttcaaaagaaaattctgtcagtacttttaaggcttctgtcagtaatccttgattccaataattttgattcaaaacataaccaatctctgctgactgatttttttcagaaatttttacaaaatgaatatcaccaatcagtttatgttctgctttcaattcaattgcccattttcctaagggatttttcatataattgttggcaatcgcaaagcgagtttcttcaagagaaagatgtggcgcaaaaacaaatttgagattctcaggatttccagaataagcaaacatctcctcggcatcgctcagcacaaaaggacgtaagatgagtcgccttgtttcaataagcctgaactcggccaatttgacataaatattcatgatgctcccttttttgatgatattctttcattaattataccacactcggcaagcccatatttgaaaattatgaccttttggatgacttcatttttttatgtcccaaaatgcttggctaaaacaagttcaattcatcctgaaatcaaaaaatagttagaaaaactatgaaagaaaaagctctttaatttaaggaacttttgtaattttggggctcaatgctcccctcatttagtgagctatgttataatttctatggtagaaaaaatgaaatatataaaaaacgatttaatattaaaaaacccattgtccttttgggcaaattttccagaaagtgaacgtttcttttggtttgacccacaaaaagaagagtttgttattggtgcggaacgtctaagagctgttgaccctgataaggataatttatctgacattccttatcttttccacagtcagactttttttgatgatgtcaaaggagaactatggaaaaattttgggggcgaaacgattgctttcaagcattattttgttgccaataaaaaaacttcttattatctcacttgtgatcctccaaaaaatattagcgaaatccctcttattaagattaagcaccaaatcagtgaaaagccttctgacttttcagactgggaagaactttttcaggccatttcgcaaaattttactgacggaaaaagtaagaaaattgtagcttccagagaacttgaattcctaagtcaaagcccttttgagctcgaaagtattctccaaaatcttcttgaaaataatcctaaggcttttatttttgcttatcaaaaagaacaaagaatttttcttggtgcctcaccagaaatcttagttcaaaaaaatggcaatcagttgttgagctatgctttagcaggcacctttcctaaaacaatggaaaatgcggccgaaaaattactgacagaccctaaaaatcttttagaacatgagattgttgtccaaaaaatcaagaaaaatttgcttgaaaaagccgaatcggtcaaagttggtcagacgggtttaatggagctaaaaaatgtctaccatcttcagaccttattgaccgcaaaaagttctaaaagctcgctcattgattggggaaaacatcttcacccaacgccggcattaggaggtgaaccgcgacatgaagcactcacttttcttagaaaacatgagaagcatgaacgtggactttacgcggctcctcttggtttgattgataatgaaggcaacggaacattaattgttggcattcgttcagctttaataaatgagcaaaaactttatgcttatgctggctgtggaattattccatcttctgatgctttagaagaatttaatgaaaccaaggtaaaattaaaaacgattttagaagccttatgacttctatttagaatatcaatccattagaaaaggacataatcatgaccaatgaatatttagctccctttgttgatgaacttttcaatctcggagtacgtgaagctgtctttagccctggctcacgttcaacggctttagccatgctttttgaagaatataaaaaatacgatacttatgtcaatattgatgaacgttcggccgctttttttgcactcggaattgctaaggcaaatcgccgaccagttgtgctagtttgtacttctggctctgctgctgctcatcattttccagctattactgaagcaaagatgagtcgtatcccactcattattttgacagctgaccgaccagccgagcttcaatttgttggagcgtctcaaacgcttgaccaaaccagattttttggaaatttcgtcaatcattttgaaaatcttgaagccccccagcctcaagcaaaaaacttttggacttatccgcgaaaagtggctcaacgcgcctttttatctgcccttgaccagatggctggacctgttcaaatcaacgttccattgcgcgaccctttagttcccgaattaaagagtgaaaactatgaaaaaggacgttctaaactgccttttaaattctttaaaggtcaacaaagcgccttttttgatgaagcattactttcttcaaaaacactgattttggcaggagccaattctgctgaaaattattcagagtcacttttaaaactcgccgaacaattaaaggcacccatcttggcagaccctctttccaatcttagaaatcacaattctccttttgtcatggacagctatgatgcttttttggcaaatgatgacttgaaaactgacttaaaagcggagtctattcttctttttggtcagatgcctgtttctaaaagattacaacaatttattgccctcaatgacgaagcacaatttattcaagttgaccctgctttagtttatcgcaatccaagtttaacaacgacaatcatggtccaatccaatgtcacaacttttgcaaattctatccaaaaagtgaatcaagacttttcatatttggagaaatggcaaaaggcccaagaaaaaatgcgtcatcaacttgaaaaagtggctcaggaagaaaatccatttgaaggacgtttcgtccaagaactacaaaaacatttgaaagcacttgacgctcaacttcttgtttcaaatagtatggaaattcgcgatatagattattggtggaaaaaggaagattccaaggtcagaatcttaggaaatcgtggtgtcaatggcattgacggaaccgaatctacagcgcttggtattgctacaaccggaaaaccaacggttttactgacaggcgatttgtccatgctccatgacttaaatgggctaattattggtaaaacgcatgaacttaatctgacaatcgttcttttcaataatgatggtggcggaatttttcatcatttagcgcaaaaaggcgtgccaaattttgattatctcttttcaaccccgcatggcttgaattttgagggcttggctgaattgacaggtttagattatcatttggtcagtaattatgctgattttggtcagcaatttgaaacttctatctgtcaacctggcattcatcttttggaaattaaaacggacaaagatttaagtttggctttgcataaaaaatatacttcttatgaaaattgataaaaaaataatgacgattgcgggtcttgattatgctgtcagtatttggggaagtgggaaaattatttttgcattgcatggtttttccgaaagttcaagcacttggcagaaacttagtttgacaggttacaagattgttgccattgatttattaggtcatggttcatcagcaaaacccgatacccttgctccttacaagcttgatcaagtactgtcagaccttcatttacttttcacacaatttgctgacgaaaaacctttttcacttttgggttattcaatgggtgggcggcttgcgctccgctattgtttggcttatccgtcggctcccgttgaaaaattaattttagagtcaacaggacctggaatttttagcatcagtgaccgcgaaaaaagacaatttactgacgaagagttggctcagaaaattcttctgaatggctctgaatggttcgccaatttttggggaaatctttcactttttaactcacaaaaaaaactatcagtaaaaattcaaaaagaaatttggcagcgacgcgctaataattcaccactagctcttgcccaaactttgcggggaacaggtcaaggtcagctggattatatcggggacaagatttctttagtaaatcctgaaattctctatctctctggtgatttagatgagaaatattccaacattgccaaagagatttttgcgccaaattctaatgtcacttggattcccgtcgctggctcgggtcataatatccacttagaaaatcctgccctttatcaaaaaatattagaggaatttttggcttagtcaaaaagctttatgatataatggaaaagtgatgcctgtgccatccgtgcacttgtcagcaacattcattagtcaaataaatgagtttttacaggcaatttgtcagtaaaatcgaaatcttattaactagaataaaaataatttatgtaagtgagtttgttctaatcagaattatgaaacaaaccatatcttatttaactgagtttggtgcgctagaaacctacgaaaaaagataaaaattagaaccttcacttcgtgaagaaccataatttttcctatttttctcagtttctaaacaagcgcccctcacatcttattttaactgagttcggattcgcaaaagttgatgaaaatagataaaatggaacctgggcggtgcccagaacctcatttttctatctgtgcaacaagttgctacgctgtccattctcgctaaactgctaaagcagttagtcgaaatggcaattttcataacttctaaacgctcgtcctcacatcttaaaggagaaattgtgtcaaaatttaactgggttgcccttaatcgtaactacgaagatattatttatgaaacttataatggaattgcaaaaattaccattaatcgtcctgaagttcgcaatgcttttcgtccaaaaacagtcgttgaaatgattgacgcttttagtattgcacgtgatgacacaaatgtcggtgtcattattttaactggtgctaatcatggcaaaggtgaagataaagaagccttttgttctggtggcgaccaaaaagttcgtggaaatggtggttatgttggtgaagaccaaattcctcgtttgaatgttttagatttacaacatttgattcggattacgccaaaacctgttattgccatggttaatggttttgccatcggcggaggtcatgttttacatatcgtttgtgatttgactatcgcttctgaaaatgcaaaatttggacaaactggtccacgggttggttcttttgatgctggatatggtgctggtttacttgccgctatggttggtcaaaagaaagcgcgtgaaatctggttcctctgccgtcaatatactgccaaagaagcaatggacatgggcatggtcaatacagttgtaccttttgaccgtctggaagaagaaactgttcaatgggccgaagaaatgctggctctctcaccaatggccctccgtatgctcaaaggctcgatgaatgcagcgactgacggacttgctggactgcaacaatttgcgggagacgcaacactcatgttctataccactgatgaagccaaagaagggcgcgacgctttcaaagaaaaacgtaaacctgattttgaccaatttccaaaattcccataaacttttgaaaaattgctgataaagcgtcattttggcgctttttgtgatttaaaagttactgacagctttttaaaattatgaaaaattactgacaggatttctgtcagtaaaaaaatacaaatgaagggaaaaattgagttcactcacatcttaaataatgaaatggttaaaaaaacaggcggaactttatccccaaaaaacatttttaaatgactttacttttgaacaaatcaatcaacgagtggataaaacagcaaggcatttagctccactcgtcgctaaaaagactagagttgcgctcctctcagaaaactctgttgaaatggcggttgtcttgtttgccttactcggtttgtcaaaagagattcttcttttgaatacacatctaaccacatacgaactgactgagcaagtcaatgaactcgaaattgatagagtcttcaactctgatttattgaaagaaaaaatgactgacagcatttctttttcagatattttggcaacaaaagctgaacctgtaagtctgtcagtcaattttcctgacgaaaaaatcgctgtcatcatgaatacttcggcgactaccggaaaatttaaatctgtgcccatcacatggggcatgatttcaaaccatgttaaagcctcgcaaaagatgctcggtctttacgaagatgataattggctcatcatcttacctatgtttcacgtcagcggattatcaatcatcatgcgtagtctatacaacgcaacatcagccacaatttttgataaatttgatgaaaatcagcttctagaagtggtcaattctggaaaaataaacatgatttcactcgttccgaccatcctgaccagaattgccgacaaattgaatggaaataatttacgattaattctacttggtggtgaatttattcctcaacctttaatccaaaaatgccaagaattagctttgccagtctataaaacatatggaatgaccgaaagtttttcacaatctgttacttttaatattttagattttccagataaaacaatctctgtcggtcgacctttaccaggagttaaaattgaaattcgcaatcctgatctttctggcgttggcgaaatttggctaaaatctcccatgctgatgaacgcttatttagggcaaaagccttatggtgctgcttttgaaacaggcgatattggctatcttgatagggatggctttctctatctgctcaaccgcagaaaagatatcatcatttctggtggcgaaaatatttatcccaaagaaatcgaagatttagtatattctcttcctgaaattaaggaatgtgccgtcgttgcaaaaactgatgccaaatggggtcaagtgccgattctttttgtttcaggtcagatttctaaggaaaaattagaaaactttctcactgaaaagcttgcaaaatataagcgtccgcagaccatcattttcatggatgaattgcccaaaaacgcttctggaaaaatcttaagaaaagagctcaaagcatgaaaattgaaaaaatcacaatgtttcatgttcaactccctatgaaatttaattttaagaccgccaaaggttccttaaatctccgcgatacaattattataaaagttgaaagtcctaagggcctttccggatttggtgaagttgttgctttcacgactcctttttatacctcagaaacttttgctgattcttggaaaattttggaagaaacttacctgccagaaattttgaaaaaggaattctcacacccttttgaaatacatgaattttttagaagtcccttaccaatggcactggctggacttgaaaatgcgcttctagatttgtattttaaagaaaaaaatgaaaatttgatagctggacttttccaagaaaaattagctgataaaatcccacgtggtgcggttattggacaaatgtctgacgagcaaaccattaagcaaattgaccgacttattaaaagtggtgtcaaaagaattaaattaaaaattagtccacaaattgggaccgacttgattaaaaagctggtaaaaagatatccacaaattacatttgctcttgatgccaatcaaagttttcaactgacagactggccagtcatcaaagagctggacgaacttggtctggattgtatcgaagagccttttgatatcaaagatttatccgaattaaaattactgacagaaaacttcttaacaccaatttgctttgacgaatccgttcaagatttggaaagtctaaaaatgctgacagaactccctttcaaaaccatgctcaatgtgaaaattggtcgtttaggcggactttaccaaagtcaaaaagctattgaattttgcagacagcatcagattggcttttggattggcagtatggttgagtctggtatttctaagattttacatgtccaactcgccgcgctttctggaaatgctatggccggtgatttatctgattctaagcattattttgaccaagacctaatcaaaccagaaatttctttcccagagggatttatgactgtccctactggagctggcattggctttacaatcaatgaagaagcgctaaaccgttatactgtaaataaattgagcttgacctccttgaaatgagtgaaaaaagaaaaaaactggaacctctactttcaggtgaatcttactttgcaaatatcatccacaaccttgaagctctgcttcaagcaaaaccacttttttcctacatacgctcagttgtctcttttggcaatgtcgctagctacgccgtccattccagctaagtactgttcttcgctacgctcgaatgtccatgctaaagcgcaacgagaatcgcaagtacttgctggcagggcaagcgtcagccaaaaagggattttttatcatttcaagacagtcagcgataaactgccatcagagatatcagcttgttgctgtccctgaagtctattcactaaatgtcaagaccctagggcggcctcatatcttattaaggagatttccaatgaacatgattgaccaactcaatatcacagattttcaagtttttactgacgaaaattctgacaagtctgtcagtaaaatctataaattcacaagtaaaatgttactcagcgattttcacgctcagccgcacggctttttaaatggtggtgcaagtcttgcccttgccgaaatcacagctggtatggcaagtaatgcaatcggctccggtcaatattttgcccttggtcaaagcattaacgccaaccatctcaatccaaaaaaatgcgaaggtttcgtaaatgtccgcggtcttctcctcaaaaacggcaaacgcaaccatgtctgggaaatcaaaatcactgacgaaaatgaaactatcatttctcaaatcacagtggtcaacgccttggtcccacaaaaaaaactctgactatttgtcagagtttttttacgctatcccgaatgattaggaggctttccgaagagtaattttcagaaatttctttttcaattgaattaatcaaacttcccattgccacatttcccttttcaacttggttaatggctactgttgtcaatttaggcgagataaattcatcaaattctgcatcatcaactcctactatcgaaatctctttaaaaatttgatttaactttgctgccaaaatatcagcagtagcataaattgccgtaaaaggctgctccattaaataaactgacacactcttcaaaatttcctgatagtctgcactttttgtcgttgcaaacaaaatttcgcccttaaaaaatttatgaaaagcatgataacgtttttcaataacacttggttcttcttgattaaagtcaaaactataaaatagaacttcttcatgccccatttctgtgagatgattagcaatactttctgaaattttttcctcattggtgccaataaaatttcttaacttatcatctaatttttttgtatcttcaaaataggtatctatataactgactggagttaatatcgcttgatcaatttgcaaaaagtctttatttgataccccgaccacaataaaaccagcgaaagcccagtttctttgaagttgctcaatcccctttgcattttggacggtatgaaccattgtaaaatagccctcctccttcgctcttcgctcaatcccagttaaaactgaagaaataaaagggtcggtaaaatctatgttttgagatttattataaaataagacaccgattaatttcgattttcctgaacgtaaattggctgcattttggttgggaacataattatattttttcactaaagcttgaattttagcttttgtctcagccgaaacgcgtgaatctttcccacggataacattagagaccgtcatcactgatacatcagccattatcgcaatttcttttaaagtgatttttgtcatagtcttcgtttctaacaagaggaagcattcacctatatgtttaagttttcagaacctctgtcatcctattatacaaagcttcctctttattttccactgtaaagtaattcaaatagactattttgtaattcttgattttcaattgttttgataaaggccacttgtttttcatgttcttcaatcaaagagagctgctgtaaaatttcatctttttgctcataagaaatttctgcaatatctaatcttctaaacaaagtagtagaaaaattccaatcgaaattttcttcttttccatttaaatcaatagaaaaatctcctcttttagcagatacaatttcatgttccccgtaaataatcgtatgtttgcgagaactttcttttttacttgtaactgtaaaaattccattaacaaattctgctttagtttcgttgtcatcttctaataaaagatactcaccatcggctccaggaaatattttccagattatttcactaggaatttcttctttttttagaggatttttatctagtggaataatagctcctgctttagcgaaaacaggcatttctgttatttctcgataaactttcaggctgaccttcccatcataaggttgaccgctaaaaaaatcataccaagttccttctggaaaccaaacctccacacttcccatctgtaaaagagaattcattttttcggtaatcggtgctaccatcagttgttcaccaagaagatattgatttcgatgctgataagcttcttcttccatcggatattcatagtagagtggttcaacaagtgctctaccttcagaagctgttattaaattggcgctataaagatatggaattaattgatgacgaagttgtaaaaagtcaatcattgattgttcaatcaccgcatcaaaatgccagggctctttactagtgaattctgattttgaggaatgaagtcgattgattggtgaaaataccccaaattgcaaccaccttaaactgagctccgcatctttgtaaccttgcatgtgccccccaatatcatggctccaccaagtatagccaatatttgaagctgtactcgtaaaataaggctgaaaatccaaacttgcccatgaaatgactgaatctcccgaaaatcctaaaggatatcgatgactccctggtccagcataacggctcaagatgatattatttttatgcttcttttgagcattttgatattgataatgattgagtaaccaaagtgggtcaactcctgatttagagattgccccttgttgccaatcaatccaccaaaaatcaacgccttctttttctaaaggtccatgaacctcttcaaaataagcttttcgaaattttggattgtcaaaatcaaattttgctgcctcttctaattctgtatttaaatcaagcgtttgagcaacctgtggataaaggtcttcaaaagcacgaattccatcagccggatggtcattcaaagttactttcagttttctttgatgtaattcatcaataaaattttctggattaggaaataaatttctattccatgaatagcctgtccatccagaaccaaaacgacttggaacctctgatactttatgccaatccatatcaatcacactgacagataagggaactttcttatcagtaaatttatccatcaaagccaaatatgatttatcactgtaatcgtaataccgactccaccaatttcccagagcaaaccgaggaagttgtggtgtatttcctgtcagctgataaaaatctttcagagcttatctataatcccgtccataagcaaataaatataaatcaattgtgctgacagaattaccagcaatatctcctacttctgtcagaacttttcctttatccgcaaggactgcaaaaccacttttagacataatcccatcctctaaaggacattcaccatcaatcatatccaaggttctagttgttccttttaaattcccatcagatttttcaccaaaataccagcgatttgaataaacagaaaagttaaattttacatcagcaaataaactcgcatttgtaaattctccaccattgtaataaagatgaaccgttgaggtgataatttcaatcgtctcttctttttcaatgatatcaaaattgacctcagaaaactctcgattttgtaccatttgtgtcattctatcttcaaattcaccggtctcactatactcaatacaaatcaagtaatcagtcaaaaccgtgaatctagctttatcaaattttataatattattattcatatatttactttctaattcactgaccatcctgtcagtaaatatctcactataatctaatgagtcactctttcaattctgtcaaaaacttgtttaatcatgattgaattgacaagattaatcacagaaaagccaccaaaagttaagaaataaatcattgtcagtaaagcgtacggacttgtaaagctgaaatagataattaaaccattaaaaatcagtaaaaataaactttgaaaccaattttgaatacttatcaacagaagattataaactgtttttttcaaagaatttttatatcttccaatataagaaaatccataaacgattagtaaagcaagaattaaagtgcctataaaagctgccgttctcattaaaaacgacaacaatagtggcaaatgacccactaaacgaaaatcacagaataaaataaaagtcagcaaacttaaagtggtaaaaaaattgtcgcttgtttaaaatttattttgaagcttttaaaataattcttgaccacacttccttttttttgatgcaatattttttgtaaactcgtttgcaaggcgcaaaaactcgctccgatagtaatcactggaagtgacattaaaataaataaagtattcaggattatcaaatctgcaaaaagcgccattattctcattactgaactgtcaatatttaatagttttcccatcttattcaattttttttactgataagctgtccgccacttttaataatagaccagaggtttttagacctctggtcttttataacaagctattttttcaaagctttttggtaacgttcataagcgtccgtttgtattttcaaatagtcttttaggcccatttgatttaattttgcaatataagcctcccaatctttatcaatcccacctttagtaacccattttgctgtttcttgtgttgtgtacgaactcaaatctggataaacttgagcaattttttgtaattcatcatttgtataagtaaccgaaggaaaggcaggtcgagcatattgtttcaactctgcatccatttttaatttttgtgcatcaccatttgtaggggcttcaaaagtaaccttatcattcaaactgttatcccatgatttaggcccaaaatctcgcaaagaattaatacacgcttgagtgtctgctgagttatccccagttggttttaaaactttgtaagcctcacctgatttttcagtcccaactccaaaagctccataataattttgaatggctgcatcgttagtataaaatttatcagcccactttattagtgcttttacatttttagcatgagtcgttaccataaattcatctcgcccttggttaaaatggtcagggtcagacatcacatattgatttccatcagggccttttaatgcaggaagtgcaacataatctttagcatttttcccaaaagttgcatcagctgtccaaccaactgacacaccaactgtttcagtatcggccattaattttgcttgtgcttgcgtagggtctagcgtgtacaattctgggtcaatcaaccctttcgtataggcatcatgcatggcctcaatcccttttttgaaattatcagtcgagcgaatataagctggttttccattcaacatcatcatttcatttgaattatcagctcctcgtagaacaccaaagggtaaagtgtaagacatagtggggtcaaaatttcctgttccataaggaatttcatctgccttcccattgccattagggtctttagttttaaaagcttccaaaactttcacaaattcgtcataagttgttggcatttgtaagcacagcttatccaaccaagctttgttgataaataattgattcgcaatgattggacgcattggggcttctttaggtaaagaccaaatatgaccatccggacttgtaatcatggcttttaaagccggattcttcttcattgccttttgcaaattaggcatatccttgacatatttttccaagggaatgaaattagactgattttgagcaatttcttggtctgtaaaggtgattgaacccataaaagcatctggtaaattccctcctgccatcaatgttgacttcttatctccccaatccgtattgagataagtatcccacttcacattaattccagcttcttttgctaactgatttggaaatttagtataatcattcccccaatcagcccaacgaactgttgcaactgtaaaatctttattgcttgaattcccctctttactagagattgagtttccacaagcagaaagtaaagcaagtgctgcgagcattgaagccgctccagctgcaacaaccattttttgatttttcatttgaaaatctcctataatttaattttaaaattactaattaattcctaattcaatctaataacttactctttaatcgctccaaccatgacaccttgattaaaatatttttgtaagaaaggataaaccatcataattgggagtgtagaaacaacaatagctgcatatttcatcatatcagcagtttgacgaagttgtgaggctacgtcaccagtagcttgactttggagtgtttggtttgtaatcaataattgtcttaatattaattgcaagggttgcagattttggtcagtaagataaatcaaagcattgaaccatgagttccaaattccgactgctgtccaaagaccgataactgccaaaatcgcttttgacaaaggaagaacaatttggaaaaaatatctaaaggtactcgagccatcaacttgagcagcttcccaaagaccatttggaatagactcctgaaaaaaggtccgagcaacgataatattataaggggaaaccgcaaagggaacaatcatgacccaaaccgtattcaagagtccaaaatttttagtcaccaaataaattggaatcaatcctcctgtcacaaacataggaacaacatagagtagcgaaatccattttcttccaaataaatctcttcgtgataaggcataaccgacagggatattaaccaataacccaaatgctgtccctgcaactgtatataaaatagtattaaaatattcaggtattttagataagtatttatatctttttgataaattgaataatcccattttgtttccggatgattaaaatactgagcaagcaaataggcaatgtagggacccgttgttaaaccagatgagcctaatgcactggcaaaagctagactggaaaaagctggatgcggaccaaagaaaggggaaaaatctgccgaataagctcgcgttcccacgcgatagtgataaggaaactctattaacttactttctgaaaaataaggtttaataccttctgtcaaatcaaaaaaagcagcttcactttctgataaatcccaacctttttcattttcatgagttgcgcctatgagaatttctccttcttgaaagggaataatatctgctgctccttctaaaaataaaaccggccaatctttagtatcaaaatcggttttaaatgagagcaattgtcctttttgaggccgaacatcaacatcaatcccaatttcggaaaggagttcttttaatgccggacctgggcaaagtactaaatcatctacaacatcactttctccttgatgaacaatctcccatttttcgtctgcttttagaatagttgcacgctccgcaaaaaatttcactcctcttgcttgtgctcgctttttcaaatgtgctaaataagcttttccatctaatcgtgctcctcccgatagatataaactttcacttggcttaagtaatggaaataagctgacggtttcctcttttgagagcaccttaatctcgcccatctctggtgcgttttttcttctttctaaagctaacttctctaactcttctaagtctgaattttttcgtaaaaataaggtcccacatttttcatatacttcatcagttaattcaaaatcagtttttaatttttcaaaaaatgctgcaccatctttagctagttgataccatttttgatttcttcttttagaaagccatggtgaaataattccagcactcgctttagtggcttgatttttttcatcatcaaaaagacttatctcgaatttatcagtgtccagataattcgctaaggtcatcccaattattccaccaccaatgattgaaatttttttcatcatgactccttttcttttttaaataaataaaaatcaagacgtattatgcttgattttgattttcttttaaatgttctaactctttacagtatatcatttttaaaactgtcagtaactttctttgttttaatctaatctcaatctttcaatttccatgacaaaaaattttggacttgttcatcataagtcattgtaaaataaggttgctttttatctaacttgcgaatttctttgatttcagtacaggataattcaaaatcaaaaatattgatattttcggctaaatgttcgactcgagttgaacgtggaaaaactatgattccttcttgaatatgccagcgtaagataatctgagccactgtcttattatatttttgagctattttttttaaacgactttcatcaagtagtctttgatcgccatgtccaagaggataccaactttcaattttagtcccataaggtttgagaaattcttggagttctttttgttgatggtaaggatgtgtttctacttgaagaacacttggtttaatgtcagcaaagttaaataaatcaaccaatctctccccatcaaaatttgaaattccaattgattttacttttcctgatttgacagcattttccaaagaaatctaagctttacgataatttccaacctgctgatgaagtaaaagcaggtcaatttgcttaagatttaatcgttcaagcattcgctcaatggcttgtgaagcatcatcataatcagaaggccagagtttactagttatccaaatttcagaaattggaatttcagaagaatggatggctcgaccaacagagcgttcgttttgataagcatgggcggtatctatgtgacgataccccaatctcagcgcttctttgactgcattttcagttgcttctccttcaggaatttgataaactcccaagccaaattgaggaatgatatttccatcattaagtacgatttgtgtttgcattttttctccttttatttttcattaactgggttcgtgaaaattaaaactaaaaatcctatcagtaaaaatactgtgatgaaagccattatcaaatgataataagcacttaaatcaatgacagatgaactaaatagaacaacgattgataaacctaccggtcctccaagttgatgcatcatatttgttaagcctgacgcagcacctgataattccgggggaactcctgccacacctgccgctgtaagtggggcaagtagccagccttgcccaagaccaataatcatcatttgaaaagccattgcataaaaatatccccattctggttgtgatataaatgacaaaaacattcctgtcagtaaaatcacttgtcctaaaatcatgactttactatttcccaaagcttttgttaatttaggcaaaaatagagcagcaataaaattaacaagtgttaaaggcagaaaagcaagccctgactctaatggtgaaaagttatacattttttgcataatttgtggaagaataaaccagtaagtcaacatggccatcataaaagtaaaacgagcaatgtaagaacctgttcgatttcgattcttaaataactctaaaggtatgagagcataagtaattcttttttcccataaaagaaaaaccaaaatcaaaattaaagaagcaactataattaataaattacttatggtaattccgtaaacaaatagaactgaaataatgaccgataataaacttccaagaaaatcaattttacttggcttgatttcattttgttgaactttcgcaagcgttaaaacaattagtaataaactaaaagggacattcaataaaaagccgacacgccatgaaattgctgaggtaagccaaccgcctagaattaaaccaaaacttgaaccaatacccgcggttgctccataataagagatagccttcattcgcaaatttccctgatagctatccatcagtaaagccaagctcgttggcgcaatgatagctgagccaattccttgaactgctcttgctataatcatcatttctgttgacgtagataaaccaaccgctaaacttgatagtccaaaaataaaaaggccagagacaaaaattatttttcaacccattaaatctcctaaatgccctgccaacaaaagaaaacctccaaatgtaatggtataggcatttgaaacccaagaaaggcttgcttcgttcatatttaaatcctgagatgtttttacagtacttgtgaaaattatcgaattatccatcaaaattaaaaaataggaaaataagataataaagatgactaagccaaaagtttttttatttttaatgaatttattttaaaacaaaaatcaactgatgaaaaatgcttattttagtattaattatgcttataaagcatattaaaaaataaaaaatttactgacagattggtcagtaaatttttaatcattttcttgtaagtattgtttgataaatgctctagtgactggtgtcaatggaatatttttcttccaagcaagaacgctatatgtcttcacttctggacttaagggaatcgcttttaaatcttgataatttctaatgagtgcaacttctgtaacgactgcctcaccaattcctgtacgagcaatctcaaaaagatgaaatccaagattgaagcctccaataatatttaaatcactcacttggcagtccgcccaatcagctatatactgacgaacttctggtcgttctgaaatcaaaattcgttgttttttaaatacttctggccttacttcatctaattctgcaagttctgaatcggatggtgtaagcatcatccaacgctcaggaaaaccaattttttctacattatatttttctgtagacgttggctctaacaaaaatccgacatccacaagtccattatcaatcttccatttgatgtcatctgcatttcctgacaagattgtaaaagtgatggcaggatacctatttgtgagtgtttgaagagttttagcaatgctagaacttgtccacccttctaaggctccaattgtcaaatatcctgataattccgcatttttccggtcttcaaaaacttggacagtcttactggtcagctgtaaaatctcttcagctttgattttaagaaattgaccatcttcagtcaagataagctttttcccatcacgcataaaaagctgagtatctaattctcgttcaagttctttaatttgtctagataatgttggctgtgtaatatataactgtcagcagctttggataccgtcccagcagtggcaactgtccaaaaatactttaataatcgaagttccatttatccttatcctcttcaaatttttattgcttctgttgaactttgattcaaattcatttcgcttggaagcatgacttcatcataattttcaattttgaatgttaaataatctaaagcagattgtttttcaataatttctgttctcaattgttcaacttgactcttcaaaatttcaattctttattctttagtattaggatttccttcagttaccaataccatataacgtgtcaaggcttctacttgcactcctgcatctctcatatgtttgacgaattttaatgttctaatattcgcttctgaaaaatttcgtattccagactctgtccgtgcaattttaggaattagcccaattctttcataatatctgatattatctgtttttatccctgataagtcggcggccttttttatattcattcttttattttaacacttgaagtgaactttaagtcaataaaaaaacatttaacaaaagttaaatgtttcaatttacaaattaagccaaggctcccattggatcccatggaagcagaacttgaggttttgcttcataagcagctaattcttcttcgcttaaaaggtctttgcggacaacaatttgataagtatattcatccatccattcatcagaagcaacgaaatatcctttttgaccggcatctttaccccaagaattttcaactttccatttagttgaatttccgtcagcatctaaatcaacacccgctaaaaccatggcatgagtcatcagtgattcgccatagtcaagacgtccagccttactttgtgtgaattcaatatccaatgaagatttaaaatcataagaatccattgtcaaaagtcctgctgaacggtttgattcttgaccaacgtcacaaccaaaccagacagtttcgcccgcttgcatttgggcaatagccaattttttgaaacggtccatctcaacgttcaagtgtttgacttctttaccaccgactacattaccaagaaattcaacggtatagcttttgttataaggtttatcagcagttggagcattaatgaccgaaacataattgttcaaatcaatcccaacatattcgttgtagaattcttttggcgttccaacaaattttttgtattcattatctttgttgcggaaagcaaattcaaaattttgtggtggcaaacctagagttacagcaaggaaattaaaaacttcttgtaaaagttcttctttgaccgcttgaacatcaccgtcttgctcaattgtataacgtaagatttcagcatcttgtcggagcaatttgttcaagtatttattcaattcgcgtgagctacttgaagcttgtgattcaggataaacagcttttggaacaattccatatttgtcaaaaatggctaccatcatatcccattgaccaccatcttgttgtggagtttgcaagaggaatttcaaacgacggtcgtccatcgcaacatctcctataatttgttccataaaccagtttgatttttcatatttatcccagaagaaagtataagcttgtgaaaattcaaaatcttctgttttaaattcattaataaatttatgacggaaagtgttcaaagcagcaaacatccagcaacgtccagattgtttttgattcgttacagggtcttttgtcaagtcaagtgaaaactcaggcaaattcgctgcatgtgaaccacgcacttcgagtgatgaaagcaaaccatttttagtcacggcattttccaccgcacgcaattttgtgttttcagcaaaattttcgtagagtttttgtgtgaaatctgatgttactgtcataatacctcccaataaatcgaaacttctgacaaaagtttcgataaaaataatcattatcgattttgattaatgatattctattattttttacattcttctattataatctaaattatcaaaaaaatcagctaggaaagctgattttctaaatctttctttgcttctaaaagccacgggtgcgcaactttcaagccatcattgatgatgaagtctatataataaagtgctgcactttgcaaatttactgacagagctgtcagtaatccttctttgtgcattatccccaccatcccaagaaattttgtcagcaagaaaaacaatcaaatctaactctgtaaaattttccttcagtgttgtgtggcactcaatcgctgacaatatattttcgtcagtaattttaaaatgctcacgcgccagatatttagaaagtttttgatgaataatcaaaggaaattcacgctcttctgtcagtaattctataccaaataattctgctttttctactcgctgatgatttggataaaccccaccaatatcatgcataagtccagcaacaaaagcttgactcttactgataaactggttaatctctttttgttgcactccatcagtaaaaattagcttcaaattttcgtcagtattttttgcaattaatttttctttttgaactatcacacttttctctgaataatcaattaccagttgttcagctgtctttgccacggctaaacaatgttcaaaaagttgatcatttcgcagaaaaagcctaacctcttcaaccaactgcaactcatccattttatcactctctaaaatcacttattttctgaaaagatactatccaaaccatttatgagtgtttgattttttaatgactgattatcaatattgtagtccccgattatccaagaatgttttttcagatttgcgttttggtcctcagaaaattgagcaagcattttgaattgttggtctgctgtcataaatataatcacagcaccaattcccttagcaagaggctgcgttttatccgttccatcatttaaccagtaagtctttgctttcattgatttatttgctaaatcctgctgaaaagcctggttatcaatttgtttataaccttgactggccaaataatctttcacactactcaactcaaaatagagtgatggggagctagatgatggaatcatctgcttaatagatgcactcacttttgtttgtcccgtatgatttgctacatgctgtccacaggctgctaaaattattaaactaagaactaatgataaaccaatttttgttttttgttgagctgacatttagtttccccaagtttttgccaattttatttattttcactttaattgacaagcgataatttggcactttcgtttgatttattactttatcacccctaataaactttaatcaaataaaactcagcttttttaataattataccatttcttcaagcaagcgaatcagaccttgggctgattttttccctgcttcaatgatgaatttatcaaaattaacattggcatcatggtcagctgtatccgacatcgcccgaataattacaaaaggtttcccaagtgctgttgcagcttgtgcaatagaagccccttccatttcgactgctaaaacatctggaaaatgttctttaatttcagcaattttactagaactactgatgaaactgtcagaacttgtaatcaacccaacatgcacattttctaaaacctttttcaattcagaaacaaagtatttgcttgattcaaagtacaaaggttgttgagccatttgtccataggcataaccaaaagcagtgacatctacatcatgataagcaagtttatcagcaactacaacatctccaattgccaatccttgagcaaccgctcctgctgaacctgtattgataattgcatcaacatcaaaaatgtcaaccaaaaatccaactgccaaagctgacatgactttaccaataccagattgaaccaaaactacttcgtgacggccaattgaaccactatgaaaaactaaaccatgacgggtatgtttttcagcattttctaaattttcaacaagtatgcgaatttcttcatccatcgcacaaataattcctattttcatttttttccttatttctaattattttgtttaaaagtaatacaaaaagaacgtaaccaccagtaaaacaacaattaaagtaacaatgaaaagccatttattaattgctttccctcttttttgagctttagcgttttcaatccttcgacttttataaacagagtttttacttaattttttttcaatactgtcatatttctcagcaatttcagtatcttcttcaagctctctttgaagcctacgttcaagatttttcttctcttgatttgcttgttcaattacctcatccgttaaaagtggtttaggcattgtcttcaacctcctttttaaagtgttgcatttcccaataccaaatagccataattgtttttgcatcggcaatttgttcaagttcaatcattcttttcgcttcgcttaaagtaacttcaatttgttccaaaaactctccatcatcagcgggtcttggatgctctacctttgttaggtctgacgagaagtacacataagttttttctgatgaaaaaccaggtgttccataaaaagctgtgatttctgttaaattttctgctcggtaacctgtttcttcctcaagttcacgaagcgcagcagccttggggtctttttcttctcctatttcaagctttccagccggaatttcaaaaataaatttttccaatgccttacgatattgaccaaccaaaatcattttattattgtgaacgggtgcaatagccgttccaccattatgaaaaacaagttctcgaaaactttctgttcctcctggcaaactaaccgtatccctcacaacatgaaaaatctttccttgaaaaatttcatctctagtcaaagttttttcttcaaattttttatcatcaaaatttaacattgtaccctttccatggaatttacttttgaagtaagtaaaatttccctctcatcaaatcgaaggaaagagcttcatgagaaactctttcttattattttaaattattgtccacgataatgtggcatttttttcgcacgtccaagtttattcacttgttttccacgtccaatttcaactgcttcatctggcacatcctcagtcacaacagacccagctgctgtcaaggcatttttaccaatatacaaaggtgcgattatggttgaatttgaaccaataaaggcaaaatcatcaatttcagtattgaatttatttttaccatcaaagttagccgtaattgtaccagcaccaaagttcactttttcacccactgttgcattaccaatgtaagtcaaatgtccggccttggttcctttaccaagagttgagcttttaatttcaacaaagtttccaacatgaacttcttcactcaaaacagttcctgggcgtaaatgagcataaggtccaacattacttccaacactcatccgactttcttcaactgttgagttacgaacctcacaatttgaatgaatttccgaattttcaatgcggctaccatttgtaatcaaaacatttttaccaataaaagtgttccccttaatggttacatttgcttcaatcaccgtttctgccccaattgttacttcactgtcaatataagttgttgcaggatcaatcaaggtcacaccattaaccatatgttcatggttaatacgtttacgcattgtcccttcagcttgtgaaagagccacacggtcattcacacctaaactttcatcaaaatcatcaagaatatgagcagctatcgtttgacctgcttttttgaagatttcaataacatcagttaaataatattcaccttgcgcattatcagttgtgatttccgtcagtgctttaaagagcgatttattatcaaaaatataagtccctgtgttaatttcggtaattgatttttcaaaatcattggcgtctttttgctcaacaattttttctactgaacccttttcatcccgaataattcgaccgtatcctgttggatttggtgcgatagcagtcaagattgttgctgttgctttttgggcaaaatgataatcaaaaagtgctcctaatgtttcgcctgtaattaagggagtatcaccagcgataactaaggttgccccttcttcattagccaacaaatccgcagcaatacgtacagcatgtcctgttcctaattgttctacctgtttaacaaattgagttcccttaggtaaagtcgcaattacacggtctgcttcgtgtccaacgatgaccacgtttttggctatctccacttcggatacacttttaagcacatgcgccagcattgattttccagctacttgatgcaacacttttggaagtgctgatttcatccgtgttcctttaccagccgctaggacaatagcgaatttattcatagatttctccttttttgttacaaataaaatgtttacctaattataccataatcactgaccattttcgttatctttttaattcaaacactcacagtacttctcaagttagcaaatcttttttcaaaaaaatagctagatttaatttgcgatactaacatatcgatttctcgctttaaattatgataaaatggactgaaagatagaaaggattttatttatgcaaactataggatttattggagtcggaaaaatggccacagccatcatttctggacttgataaaaataaatttgaaatcatcatttctggtcacaatttacccaagacaaaaaaacaagctgaggaacttaatgttaaagctgctgaaaatcatgaagaacttgttcaacaatcagacttcattgttctctctgtcaaaccacaggttcttccatctgttttaagccagttaattaatcatttatcaaaagataaaactttgatatcaattgctgctggattaactttatctgacttaaaacatctagctgattcagaaaatcaaccgattattcgggtaatgcctaatatcaatgctcaaattggtcaatctacctctgcgattgtcaaaaatgaatttgttgatgattcagctgacgaaatagcccaagaaatttttaaagcagtcggctctgtccacgagattgctgaaaaagatttttcaacttttgcagcaatcgcgggctcaagtcctgcatttatttatatgtttattgatgctatggctcgcgccggtgtacttcgtggacttcctaaagatcaagccactgctattgtttctgaaacagtcaaagcctcagctgaaatgcttctaaagagtggtgaaaatccttggtctttagttgataaggtttcaagtcccggtggaactactgtagcaggtgtagtaagcttagaacaaaaccattttggtggaacagttattgatgcaatttctgcaacaatcgaaagagaaaaatatcttaaataaatttaaaaatctaaaaaagaagaatttcttttttaaatttttaatttcaaataataaaaaaaatgccaaatggcatttttttattaacgacgaagtcccaatgaagcgataagttcacggtaacgttgaacgtcttttccacgaaggtatccaagaaggttacgacggtgaccaatttttttcatcaaaccacgttgagttgcgtggtcttttttatgagatttgatgtggtcgttaaggtggttaatttcccaagtcaatacagcgatttgtacttcaggtgaaccagtatcgccttctttacgagcgtattgagcgatgatttcttgttttttttcttttgaaattgccatgagtttttctcctttatttgtattgcccagtccgagtgacagcttggcaagcatgaaaccaagaacgggttgtaaaaaactactctaccatgatacacttttttgactgattttacaagccaataagaaaataaagagaactagaaatataatctagttctctttaagctttaactatgtgatgttgttttcgaacttgaagtagaattttctggcgattgctcagttgtacttgaagaagacgagctcgttgttgagcttgaagctgatgttgattcagaagttgatgtttctgatgtagaaacagaagattctgaggatgattgctcaactgcctgagtaaccttaacaacaattggggtatctatcgaaaccaattcaccaacagttggagtaactccaaatacccatcctgtcggacttcctggagtatcaatatagtttaaagtaacattagtgaagccagcttgtttcaaaattgctttatagctttcagcatcctgattagtgtaagatggaatggcaatttgttttccacttgaaacttcaaatgtaattttatcaccacttgtcacatcaaaactagaaccctttttaggtgtttgtttaatgattgtacctgcggcataagaatcgctagggacagaggtttgaatcacttgactttcatcaataccataatctttaagcagagtggccattgcatcatcaattttttcaccaacaaagtccttcattttgataatattttcatttccagatgaaacgtaaatatcaacagaacttttagaccttacgatagctccacttgctggattagttttaatcactttaccttcggcaacggttgtgctttgttgtttatgaaccgttcccaccttaagatcagctgctttaatctttttcttcgcttgatccaatgttaagttattagtcacattaggaaccttaacatttgtcggtgtagaaacagcccatgcaaaggctccaccaccaatgacaagaaggagaacaacaagactgataatcaatccttttttagattttttatttttattcttattgttttctgtagttgatgattctgattgcgctttttcctgatcatctgttttcttatcaatcaaaggattagtatcataaggattaattagattggcaggcatgatttttgtttcatcatggtccttattgaaaactaatttttcttccccacgtcgatcaagactagtcgaagtagctacatctgtcatcatttcttcaacatcaacatatcgattgttgatatcttttgctgttgctttgatgacgacattttccaatgcttgcggaacttctgggttgaggtttatgatgcttggaatattttcttggaaatgttttagggcaattgctacggctgaatccccatcaaaaggtatttgacctgttaaaagctcaaataaaataatcccaatggcataaatgtctgattgtacagtagcatttgaaccacgcgcttgttctggtgatagataatgaactgagccaaacattgtatttgtttgagtaagtgaagtttcagaaagagctttggcaattccgaaatctgttacttttactgttccactacttgaaactaaaacattttgtggttttaaatcacggtgaataattccatgtgaatgagccatatccattgctgatagaatttctgtaataatttcaatggcttcatcattagctagaggagcattttggttgatgtattgtttgagcgtcataccatcaacaaattccattacaatgtattgttgactttcgaattcaccgacgtcagaaatacctacgatattcggatgagagagttccgccatcgcaaaagcttctctttgaaaacgagcgattgcaatgtcatcattttcaaaattagaacgaagtactttaattgcaacttttcgatcaccaaggaaagtatcttctccttgataaacgtttgccattcccccacgtccgatttctttgataatccgataacgatcggcaaagattttaccgatttgaatcatcaactaacctcctgtgcttgtgtttcggcttctgatgtttcttcgaacttaatcaaaacaacagtaatgttatcaagtcctccatgttcattagctaaccgaatcaaagcctcggatttattatctaaagtcaaatcttctcgttctaaaacttccataatttcagtggttgaaaccatgtttgtcaatccgtcagagttcattaaaatgatatctccagcttgaagttctaaagcttgaatatccgcatgaacttcattagtctgccccagtgaacgagtaatgatatttttattaggatgtacttcagcttcttcttctgtaatttgtcctgcgtctacaagctcttgaactaaagaatggtctgttgttattttatttaactcaccatcacgcatcaaataagtacgactgtctcccacatgggcagacacaattgtgtttccttttataactagagcttcaagagttgttcccattccttgatattcatcaagtttaccaagacttgcaatattttcattttcgttgcgtacttgatttctaagccaaatttcaagagttgcttctggtgttcccgcatcaaaaaatgtctctgaccaaagtttgccgagatcttccacggtaagtttacttgcgacattacctgctttgtgtccacccataccatcagctaataaaaagagctgataaccggcacggttgacataagtaccggcatagtcttgattagtactacgttttgaaccgatatctgataaaatactatattccactttttctccttaacaagaataaagttttatttttaggtctaaaaattactgatagagtttaaaaattttcgagaaaaaatgattctttctcaaattctcaaaacaaaatattcgtcagtaaattattcacctatttttttaaatttcgcgatgaagaatccatccgtatgatacatttctggggtaatgaaaagacagccctctttaatcacttctggtttttcatttgaaatttcaacttgttcaaaatttggatgattttcaaggaactcatgaacaacgtcaaagttttcttcatcaaaaattgtacaagtactgtacaccattataccactttttttcaggcttttcgaggcgctgtttagaatttctaattgaattttttgtaaatctatgaaatccgaactttctttccggtaacggatatctggtttacggcgaattaatccaattcctgaacatggagcatcgactagaattcgatcaaatttttctggaccaaaattctcataaatcattgtcgcatcagctttttgagtggtaattttatccgcaacatgctgacgttgtgcattttgattaattaaatcaagtttatgctcgtataaatccaatgccgtgatatgaccagttgtcaaatattgagccatatgtgtgcttttcccacctggggcagcacaggcatcaagaacttcttctgttccttctaattcaagttgaggagcaactaattgacttgtttcatcttgaatcgtaattcttccagtttgaaactcttctataattgaaaaatttccgctgtcagcaattaatgctgtttctgtcagtaaagacggacgagtcccagcaatttctacagttggatcaatttttcttaagctcacatgacttggtttttcaagactttcgaggatttctcctgttcttttcccaccgaattggcgaaccattttatccaataacagttttggcattgaatatttagtttcccaatctttaggttcttcatttctgtgctcagaacgcataaagtttcttaaaacagcattaataaaattagctgttgcttgtccatcatgtcgtttagcaatttttacagcttcatcaactgctgccgaagtaggcaccttatccataaataggacttgataaattgtgagtaataaaagcattttagcccaaggtttaggctctttttttaataaaggagtaatgtaccactctaataaagcttttttagaaactacaccgtagacaagggctgttacaaagcctttatccactgtggatagttcagaatctcgcaaatttcgatccaatgaaatatttgcataggcatcattaccaaaaatatcatttagtacatcgagtgcggtttgtcttgcattttttgtcatagagctattatgacatactgtgtcaataaatgtcaatagataccgctaaaccttgttttaggggatatatgcaaattattgtactaatgaatacctatgagttacatctaaaacgtaactaaaaacgtaactaatttttgtcgggcaagaggctgtatatcttagatatacagtttttttattttaattaacgtaactaaaaaactcctttgggagtttctactattatatgtacctttttattatggttcttgctggactcgaaccagcgctaaccccgttatgagcggggaactttaaccaactaagctaaagaaccaattatgataatctgtagcacttatcttggttattatatcagatatttgtggacggcactgcagattaccgacgttataaataaagaatatttttattctcgcccactaaattaattatacaatattccgtgaaaaataaaaaatgccagcaaattgctgacacccatgtttaaaaagagcatatttctcaaataattaatttggctttatattactttctttaataatataattgggacgtttttttgtttccagaaatattttagcgatatatttaccaatgattccaagagaaaggagctgtaaaccacccaaaagcaaaatcaaaacaatcaaagttgggaagccttgaacaggatcaccaaaaacaagtgttttaagaaggtaaaaaacgctgagtagcactgaagctaaaaaacttataaaaccaacaaatgttgcgatatttaagggtgcttccgaaaagttaacaataccgtctatggaatattttagcaatccaaagaagttccaagatgttgtaccagcaacacgttctcggttttcataaggaagatatgtcgttttaaagcctacccaactaaaaattccttttgaaaaacggttattttctttcaactcaagaatactatcaactacttgccgagtcattaaacgaaaatcacgtactccgtctaccatttcagtgtcagatattttatttattaatttataaaacgtttttgcaaaaaaagaacgaataggaggttcacctacccttgatactcttcgagttcctacaacatcataaccttcagttatttttgtaaacatttcgtttaacatttctggtggatcttgtaaatctgcgtccatgacggttacaaaatcaccatctgaaacttctaaacccgctatcaaagcagcttctttaccaaagtttcttgaaaaactaatatatttcacgttatcatatttagtagttaaattttttaaaacctctaacgtattgtctgttgaaccatcgttaataaaaaaatatgttttttctagaggtaattcaacactttgtttatttacttcgtttagaaatatttctagtgtttcttcttcgttgtaagctggaactattattgagagtttgctcatcctcattttttttcactccttctttttgtatagctatatctcctgaaaatctatttaaacaataagaaattcctaaaccagatagcaggcaaatcagataaatatattggaacatatatttagttccgccagattcgaatatcaaaaggaacaacaatccaccaagtaaactgagagttaccacaccaactttccatgttctattaaagtataatgcaataatacttgaaataagggttattatccaaaaaatttgacataaaaagttgaaacttggtcttaattttccattttcataatatatttgttgtattttgtttgataagcttccatttgctgaataagcataattaagccacaaaccatcacgatgatatcctataactcctgtatcagtaatttggaaatatttctgtccatagaattttatagttctagccagaccgcgattggctgttctctctacaaataattcaatatctttttttgatttatcagatttatttttctctgcaagtgtgctttttaagtctcctgcattccaagttccatgaatagattcacgattatcctcatctccaaaactccccatcaaaataaaatgggccattggaagttctttcgatttatcaattttaactattttttgattacttacgaatagattaaacattgttaatgtaagaattacggttaataaccgataaaattttttaagatataaaaagaccctgaagagggtctttttcttttgattcaatgtcagcccgacttttttatcttggataccaattttaaaattagaaaaactattcctgctacaaagatgattgagactaggaatactagacttaagataaccataattagctcgtccttatcataaaagataacctaatcctattgatgtaatggcgccgaaaactatgggtcttaaaaagcaaaacgtagcaaatagaagatagactagatttaaatcgctatttttttcttttatatataagtaaagatagaagataaaggaaaaagtgggaattcccagtaagagcagaaccggcaccagccaatcaaccggacttatctcacttaatatcttactgagaagctcaaaagacttattcataaagctaatatgactaaagaagggctcagataagcaaagccaaaccattagtaaagcgggaattatttttttgattgtcataggctataccttctttctactagattttataaatcaaaggagcgttcacgacctgattatttaatcaaagataatttcctaatcctatttgcatggtaacaaagaagattggagtgacggtcgccgaaatcagagtcatcatgatataaattatggatttattatttatttgcttttctttaatggcaagaaataggcaagaacctaaagatactattggtataacaaataataataaaattgtggctagaggacgctattagaaattttttctatcgttctgaatacaaaactaaaagaagaatttaaaatactgttatgtatgaaaaagggagaagtgacacagagccagattaataatataaagggaatgtgtaaggttaaaaataaatatttttatttcattagttagtatcttcctatttcatgaggtctatatacttgtgtttttagtgtgtaaaactagttttcaatcacctacgtaaaaccttctttctattttcaaacctcgcatatagatttttaaatcacagataactcccaaagccataggataaaggggataaaagataatatttttttcatattcatatctttcaatttatctgttaaaattctcttttctattttttcattcgccccactaagaaactagtattatcttctttatttttgtccggtaagaattgactgatatttttattttgaattacaaaagatagcccaaccctattgacgtgatgacaccgaaaatcagaagacttaaaaaacagaatgtcgctaatagaagatagagcaggtttaaatcagtatctttttctttgatatacaagtaaaggtaaaagataagagaaaaacacggaatccctaataacaggagaacaggcacaagccaatcaatcggaattatcttgcttagcccatcagaaacaaaacgaagagaatcattcataaagctaatatgactgaaaaatggggcagatagccagagccagaccagcaataaagcagggattgttttcttgattgtcataggctagtaccttcctacctgataaggagcgtacgctggggtaaatagagtgggtaagcctgttggtgcaatgacaccacttcctatcccatacacaactggtaaattaccagtaccataataataagcttgccacacaagttttgaacaataattaggatttatttctttgatattggtagtaattctgtaatcaaggtgtatatttttggttgctcccccatatgtacaatagaagtgtgtatctgcatattgggcaacttgtcttgctagtccagtgtttctcattctataaacagacgtccactctttaatgtgttcggtaatccattgtctttttggaagttgacgattattgtctgataagccattccaccaaccgtttccacccggcatttctaaaacataaccgtccgcatttaaaatggctgcgtgtccgattactccagtaggaaagtcaccgccaacaatcaaaatatctcctgcctgagtgtctctacaaaacttgtcaatattatcttgcgctgttctcagtctgatatttgaagcggtagggtctttggtctgcaagactggttcttttgtatcaaccatgactccgtaattattgagctttaaccatgattcataagtgattgacgaatcatagtttttgtattcttcataagatggtctcatgatagaaatttcatctttttcccaatttgctttcggataaagattagggttaatgatgttttcactaactgccttatcataaagacttccaatatctgtgaattcatcagcattaacaagtaatcctgtaaacagaactaatcccagtagtagtgcgacgaggcttccaattttaaattttttcatttgcttttctcctttttaggcttaaggcactgaatatttcttgtaacaatctttccaattcatttgtgcaaaatctcctttctattgggaaccacaagtggttcaaattagcactctcttctttctaaaatcattataacagctgttccttcgtcttcttctattcgtgccatatctggcactctaaataaaaaatacaagtatttctacttggattttcatattttttctaaaagaattagtcagcatttctaaaaacttgcatatttttagcaaagtagtcatagccactgtaaatagtaaagaaaacacagacataaaagaggattgttccaatatataaaggatttccaatgaaaaggaagatgacgcttaacatttgtgtagctgtcttgattttgccaggcattgctgccgccataacgactccaccttgttcgacaagcaatagacgtaaacctgtgacagcaagttctcggcaaatgataatggcaacggcccacattggaacaacatgtaatccaacaaggacaacaaaggcaaccatgttaagcattttatcagctaacgggtccgcaaatttaccaaagttactgaccacatgccatttgcgagcaagatagccatcaagccagtcagtaaaagaagctatcgcaaaaacaattgctgcaacaatccacatgaccgagctgtgatcttgggaaacaaaaccattaaaatgagctccctgtggtaaataaaataaaatcacaaagattggaatcataaaaatccttgccatcgttaattgattaggtaatttctgtttcatagttctccttttacaaccaaaaacaagccatcagtttttctttactgagcagctgaatttgttgttgttcgattaatttgtagagtaattttggccggtccagttgttgtcagcgaagataggtctaaggctttaccattgactgtaagagtaagtccttgaacacttccaagtgtaatcactgaattttctgcacctgttgtcactaaaccagacaaagtattggccccatcagttaaggtttgaccattagccgcaacatttgaatttgtcatgccaatccaaattgtccgtcctgcagcagctgagaaatcaacttttacagggtcagaaatattgctgatggttgcaaccattgctgagcttgaacctgtgatagcaatcgttggctcaagcacactactacttgcttgtgtactactttctggtggttttgtagcacttgttgcagccttagaggtactggctacactctttgaataagaataatcattggttattaaatcaggtgtttcaggtttattcataatcactgccgcaaaaacacctactacaattaataatgccgctgctgataaagaaataattgggacataatgacgccaagtttttggctcttcttcctcgggttcaacccgctcattaggtttcacaaaatgataagtctctaatatatcctccttatcctctactgtgattccctttccttcatcataagcttgaatgattctatctgcattcaaccctaatttttctgcgtactgtttaagataagccttgatgtaaaagtcacccggcaaggctttgtagtcgtctgtctccagtgcgacgatatataatttttgtacttgagttaattgttctgcttcagaaagaccaagcccaagcgaagttcgcttttcttttaagacttgtccgattgttttgattgtcaacatatcctcccttcatttttgtactgcccatcggttgttaattatcactgttctttaatatgtttggagattttcatcatctcaccttgggtattgcgctgattaagtttatagaaaacttggagcggcttttaatttactgactcgttttatccgaatcaactaaaatttctgtcagtaaatttttcaatttctgtcttactgacagaataactttatttaggtagaatggtaaattctactttcttcatttcagaaataaattggtcagcaaatttttcaatttctgataggcttaattctttcaagatttcaggaaaatcaaagaaatttatatcatcataaatttcagatgaaaattgattggcaatatattcaagcgaatttaatgagctaaaataatcacccagcatttctcttttaagtaaatcgagatgctcttcactaaaatctctatctattttataactttttatggcttcttgcaaagtttgacctaattttttaggattttctgtgtcagctgtcagcaccgcaaagtgaaatctcttatccaaatcaaaggaaaatccaaaggaatcatcgattaaaccagcgttataaagttcttcatagcgctgactggtcctgccaaaaagcaaatctagaaaaagttgattggcgagtttgtacttaaataatgtctttgaatcttgtgcaagcgcgtcttcacctcttaaacccaaagagaattttggcattgcaacttcaagttctaaagttcccccagtgattggctcactcgcaataatttcttttcttttaatttcccttaaatcagcaaaatcttttttcgcttgattattgcgtacaaaatcagccatcatttcaatatcaaagggaccagtcaaaaacaaattcatgtttttaggatgataaaaaacttcataatttttatacaagtcatcagccgtaatcgcattaatcgttgctggcgttccagcgatatcagccgctagtggtgaatcaggatacatttttcccaaaagtcctgcaaaaagacgccaatcactgtcatcttgatacatttgaatttcttgttggataattccttgttctttttcaacattttccttagtgaaataaggtttttgaacaaaatcaagtaaaagttcggtacattcgtaagaattttctcgagtagaaaagagatatgaagtacgcgaaaaacttgtgaaagcattagtttgagcccctaatgctccaaatttatacataacgtcgccctcttctttttcaaaaagtttgtgctctaaaaaatgcgcaataccttctgggaaagtttggaaatcttgctcacctaaggggacaaaacttgtatcgagggaaccaaaacttgtggtaaataagccataagttcggttatagtctgcctttggcagataataaatagtcaaaccattgggtaaagtatctatatataatctttcccctgttttttcataaaacttacttttcaaggctgacctccatattttcctgattcacagtaaatcctttcataaaatattctgcctgtagacttagtaatttggcaactcttatcaaatctgcttttgaaactgattcaagtgcgcttaaaaattcagacatcggtaaaaatttatctggaatgagcgcttttacatattctaattcaatattatttgatggagaatcttgacctataaaataagcatttcttaacattgttttcgtttgctcaacttctaactctgtaaaatcccctcttttaattgcttcaagttgttcaaatattaaacctcttgcttcttcaaaattttcagcatcaattccagctgcaatttttaaaaagcctgtgaaggaatcaaaagttgatgaaattgaataagctaaacttgccttttcacggacattaataaataattttgaatgagcaaaaccacccaaaagtccattcatcacttgaagcgcaagataattctcatctccgtaagccactggcatttggtaagctaactgcaaaatggattgcgctacatctttttcctcggtcagaactgacaattctgtcagtgattgttgataaaaaatttctttactgaccgctctgtcagtaaaattaaagtctgaaaataagtcaatcactcgtttttcatccacatcacccaagacaaaaatatcaatcgcattctcagctaacattttttgatagtactcaaaaaggtcttgaggattttctttggcgattagctcacttgttccaacacttggcagagcctgattgacattttcaaaaaacaaattagccaattgacggctggcataataagcccgatcatcattcattgaagctaggtaatgcaataaatttctttgctctcttttgaaaatttcaggattaaattgcccttgacttgcatcaggttgaaaaatagcaattttcaaaaaatcaactgctgctcctaaggtatcaaaatctactaatcttggatttacaaaactcatgttaagtgaaagtagatgctgctttccttttttggcaacccctgtcgtaaatgaagcgccaaacatctctgagagtttacggctaaaatcttttcctgtttgatagacagcatttgtgctttcaagcatattagataggaggacccgtttcccgagtctatcagctgataattcttctcgaaaacgaaccatcagccttactgttttaaatttcgtttctttaatcacatggagcataactccatctgtcatttttatttctgtcaattgactatcactttcctattttatcaagcttttactagttcttaatgcaacccttattataccaaaatctgaggcgattttgtgagatttcccaacaaaaattaggaataaaagttaacttaaaggcatcttattttattaagcttatttctaaattttcaatgaaataaacttcagatttatgttaaaataagactatgaaaaaatacattttatttgaagaatacattgcactcggacaagttttgaaagaacttggtttaatctcaacaggaggacaagcaaaaattttccttgccgaaaatgaaggaaatattttctacaatggtgaagttgaaaatcgtcgcggaaaaaaactccgcgatggagacttacttgagttcccaacttttgacttaaaggttacttttgaacaagctgacgcaaaagcgattgccgaacacgaggctgaaaaagctgaggaagctcgtgtcaaagccattgttaaaaaaatgaatgcagaaaacaaaagcacgaatcctactaaaaaagcaccccctcattttcctggtagaaaataatgaaactcaagcaaattgaacttaaaaattttcgaaattatgaagatttaaaactcgacttccatcccaatctcaatatcttcttgggtcaaaatgctcaaggaaagacaaatattcttgaagctattcactttttagcccttactcgtagtcacagaacgagtcatgacaaagagttaatttgttggtctgggcaagaaatgaaagtttcaggattggttgaaaaggctcatgtaaacgttcctcttgaagttcaattaagttccaaaggacgaattgctaaggctaatcatctgaaggaaaatcgcttggctgattatatcggacaactaaaaatcttgatgtttgcgcctgaaaatttagaattggtcaaaggttcgccagccactcgcagacgatttatggatattgaactcggacaaattcacgctgtttatctttatgattccatgcgttataatcgcgctttaaaagagcgaaatgcttatttgaaatttgaccaagcaaagattgataaaaactttttgacggttcttgatgaacaattggctgaacatggcaataaaatcatgtttgaacgtaaaactttcattgaaaagcttgaaattcatgcaaaaaaaattcatgaacagttaactcatggtttggaaacattaaaaatcacttataatcaaaatgtaaaaactgatttttcaaaagaattattgagtcgacaagatcatgatatttttagacatcagaccaccgtcggtccccatcgagatgatttacagttctttatcaatgagatcaatgttgctgattttggtagtcagggacaacaacgaaccgttgctctttcgattaaattggccgaaattgatttgatttttgaggaaacgggtgagtatcctattttacttttagacgatgtcatgagtgaacttgacaatcatcgtcagctggatttgattgaaacaagtttaggtaaaacccagacttttattaccacaaccactcttgaccatctcaaaaatttaccggaaaatttgagtattttccatgttactgatgggacaattgagaaagaaaaagaataaaaaattactgatgaaaccactagcatattcgtaaaagcttaagcgtcaacgactatcctatgatggaaattttgtcagtaattttttgtatctgtcagtaaattttacttttcgtcagtaaatatttctttggcaataaatatggcatttaaaactttagggaagccgacatagggaatgcaatgaataaatgtttcaacgatttcctcttgtgtcaagccaacattcattgaagcctgaatatgcacgcgcaattgattttctaaacctccttgactcaacaaacttgtgattgtaatcatttcacgctgcttaaaatcaagcactcctcggttataaattgttccaaaggcaaattcgatcatcatatcattcaaatcaggggcaatatctttgagtgattcttcaacaggttttgctgctgccccgtcaatttttgctaagttttctaaaccaatttcttttttgttcattttatttccacctttctatggtaaaatcagtataaaccctcaagttaacttgagagcaagtaaaaagaggtagaaaatgaaaaaaacttataaaatttcagaaatatctttactgacaggtctatcagtccctactttacgctattatgaagaacttgaacttctaaaaccccaacgtaattccagtaattaccgagaattcacagaagctgatcttgcttggattgaatttatcaaaagagccaaggcaactggcatgccgcttacaaaaatccaagaatactcaaatttaagagaacaaggcgattcaacaattatccaaagaatttcgcttttagttgagcaagaacgaattttacgcgaacaaatcactgacctagaagctcatttagattttattttacaaaaaaagcatcattactatgaaagtctacaaaaaaactcggaatcttaaatccgagtttttttatttacggtgttccatacagaaaatttttgacatattttactacagttggatttttgggcgcttgtgaatggctcgctttggttggatataaagttgaagttatttcattcccgttattcttgaagagatggtaaattgaaaaactatctgcccacggaatagcactgtctgtctgcttggcactattaaaatctccttccaataataacatttgaactttcggagatattctttcatagttttcttcgatgtattgatacatttgtgttttaattaaaggtccattttgcaagacattagtcaagctttctccgtattggagattagtcgctttattgtattccccatccaaagatacatatttattaacagggggaaaatttggattattggctgtatcaatcatatagtacacagcacccgtccctcctgaagaataaccgacgagattaatccaaggaatctgataattctgcatcaaataagagactactttttgtaatccagcagaatatattgagccagagtctgttccttttactgtcccaaattcaatcatcggatactggttatcttgtgaaatttgtccttcaatttttaataaattattttttttggtatctgcagtaattgccaaagatttatgagcgggtacattttcaatcggaagtagccgttgaactaaccaatccactggtgtaacacttccacttgaacctgcaatataaattgtaggatagattacttgcttatttgaattcgaagttgaggaagtactctccttaacacccgctgtcgttgacaaactcgttccattatcacttttagcatgtgaatgctgagctttcgaccaagataggaagaaaattgttccagaaagaacgataactaaagcaataaaagtcagagaaagccttctaaaattatttttatttcttcttaactgtctttttttcatccacttcattatatcaatttttttattaataattatcacaattttatttacattttcatgacgatttcatacaaaaaaagctcaaaaaattgagctttttttcgaattttagataattaatcagtagccttttggatgactttgatgccatttccaagcatttgtaatgatgtgttccaaatcattttttactttccatcctaaaatttcgccggcttttgttgagtccgctacaagttcatctggatcgccagaacgacgttcacccatttgacttggaatttcttttcctgttacttttcgtgctgtttcaagcacttcaagatttgaataacctttacttgagccaagattaaattggtcagatttcccaccagatttaagatattcaagtgctttgatatgtgcttcaatcaaatcttccatatcaatataatcacggatacatgttccatcaggagtctgataatcatcaccataaatggtaataaattctctttgtccaagtgcagtttgtaggataattggaattaaatgtgtttcatttttatgggcttcaccaattgacccatcatctttggcaccagcaacattgaaatagcgcagagcaacataagtcatatctgtggcttgcgattgccatttcatcattttttccatgattaatttactttcgccgtaaggattaattggtttttgtggtgttttttcagaaattggactttcctcaggaataccaaaagtagctgcggtacttgagaaaacaatatgcttaacaccaaattcttccattgtttctagaatcacctgagctccgccgacattgttattgaaatacatcaatggtttttgcattgactcacccactaatgaataagcgcaaaaatgcataattccttcaatattttccttttcaaaaacactagctaagaaagcatggtcccgtacatctccctcataaaaacgtactttttctgacacagcctcgcgatgacctgttactaaattatcaacaactgccacatcgtaaccacgattaacaagcatatctaccgcatggcttcctacatatcctgctccaccaagtactaaaactgtcataagatcctccattttctatttattatatcagatttttttaagtttgtatcaacttctaatcattcttatttcataatcagagaatttctccactaaataatgcttcataatatctcttattgattcacaaaatcaataaatttacgaaaaccttcatgtccttcttgagtatccttaaatacacctgcgtcttttaggacttcttcaaacacttctcctactgccccttgaacagtggcatgaaccgtttctctagtaaaatgttcctcatttttaagctgttcagcccaagctttatgaatttcgttcatttggttgtcctgattaagaagatacctttcaacctccaaaagttccgtttccaaacgagcaggcaaaattgcaagtcccatcacttcaattaaaccaatattttcttttttaatatggtgtagggctggatgtggatgaaaaataccatctggatatttttcattagtattattatcgcgtaagaccaaatctaattcatattttccatctcgaattcgagcaatcggcgtaatggtatgatgaggtgttccatctgtactttttgctttaatctgaagactttcatcactataaacttgccatttttttaaaaagtcatccgcagcttttgaaagttctacttgattttcacttgctaatcttagaactgacattggccaattgactattccacaagaaacttctggaaaatgagcaagttcaatagtttcacgaagttcagcctttgccattggaaaatcatgacgacctgcttgataatgatcatgtgtcaaaattgaaccacccacaattggtaaatctgcatttgaaccaatcatatagttaggaaatttatccaagaatcctagaagattatcaaaagctcgtttattaatctccattggttgatgtttagcatttaataaaatagagtgttcattaaaataggcgtatggagaatattgaaagccccagtcctcgccgttaattgaaacttgaataattcgatgattggaacgagcaggcttatttcctaggccataaaatccttcattttccaagcaaagttgacaagccggataagaggaagcctttactaatttggctgctgcaatcgctttggggtctttttctggttttgagagattaattgttatttcaagttttccatattttgtcaaatgactaaaagctatattgcgtgcaatatcccgagtttttacttgattcacttgctgtgctaattcataaaaatattgagttgcagcatctggagaagcctgatatttttcccagaaatcatgattaattttacttggacgtggtgtcataaaattcatcagagcggcttcataaaattcatcttgccctttcgcaatcacattattttcatttgcaatcgccagaagttggtccatcaaaattaatgaattagtttcatgaacctctttatcaacttctgcccaatcatttagaccaagaaaatgaagaagttgatttctatgatagagctcatcaagtggctcaatcgttccattttgtaaagcaagactaatgaaatcttgaattgattgataaattgacataaaatactttctaatttacttctgtaagtaaagttcttgcttttctttattaatgagttttgggaatgaatacaaaattcaagcacttaattttgagtgcttgaatttgctatcactaatttaatgttaactcacttaaatcactcattaaagttttaaatattatttggtgttattcaacatctagctttgttgagccagaaccaatttgagcaacatagaagcttgctggataaccgacaacttcttcgtaaacttcaccgacagctttttcaaaggctgaaacattgtcatgagcaacaagagcgattgcacaaccaccaaatccagctccagtcattcgagcccctaatacgccggcttgttttttagcagtttctgctaaggtatcaagttcaagtccagtgacttcgtaatcatttttcaaagaagcgtgtgaagcatttagaagttctccaaattttgttagatttccagcaacaaatgccttttgggcaattttcgtccgattattttcataaacagcatgacgtgcacgtttaattaatgtttcatcacctatcaaatcggtattggcatcaaattcttcatttgatagttctccaagtgattgaatgtccaatttagtttgcattcttttgagtgcttcacgtgtttcagcaaaacgttcgttgtattttgattcagtcaatgcccgcggtttgttagtgttcatgatgacaatgtcataatcacgaagttcaacaggaaccatttcatattttaaagtgttgcaatccaacaagattgcctttttgacttcaccaaaaccaatggcgaattggtccaaaattccggagttgataccaatataatcattttctgttttttgtcccaattgaaccagttcaagacgaggaacacttagcttaaataaatcatccaaaacaacacccactaaaagctcaagtgaagctgatgacgaaaggcctgatgctgtaggaatttctcctttaatcaacagttcaaaacctttgtcaatttcatatcctgctcctttgagcatgacaatcattcctttgacatagttagaccaaagttcaccatccttattttcaacatcatctaagtcaaattcgatgacgcccaatttaggaaaattttctgagtaaagtttgacttttttatcttctctcagacgagctagtcctgtcgttccgattgtgattgatgctgggaaaacatatcccccattgtaatcagtatgttcaccaattagattaatccgtcctggactgaaaaagtattcaacttcttttgtatctccaaaaacttctgcaaatttttctgttaacgctgataatacagtactattttcgacaactattgacatttcttctctcctctaaattcatttccttaatttgtatgtaaactataaatggtggtggcttgatattcatctcccgcctttaaactaatgtctccaagttctggaatctgttgtgacccgggtgaaacttgacattcaaaggtaataccaccatgatgaacttgatttttcccgtgataaacggtccccaaatctccaaagtttgctgtaaaaattacaatacttggttggtcagtataaacggaaactgacaagtcatttaaagataaacgcgcttgttctttctcaaggctctgttcatctaataagaaggggtggtcaattccaccaaccagttgaacttgttccatgctagactctaaggcttttgataattgtttttcctgacggaagtctaagtcagtattttttatatcaacgatatcgccacggacaatttctgtttgatcttttaaaggtacaaatcttgaagcagcaagcttgagttgatgattttcaacagacttgctagcatccccatttaagttgaaatagacatgtcctgtgggattaaataccgtatctttgtcagaaattgcttcatacttaattttccaattgttctcttcatcaaaagaatgagtcaccgacatctctattttaccaggatatccattttctccatcattggaaactaagctaaattttacttggacttcatctcctaaatcattaatttcataagtccaaagtttggtatgaatgctatcttctccaccatgtaaggtttggggagcttcattttgatttaaatgatatgtttttccagaaatatcaaccaaaccatctttgattctgccagctatacgtccaactgtggcccctggataagcatctttttctaagtattcttgggcggaatcaaatcctaaaacaaaatgtttcccgtctttttgccaatcaacaatgcgagctcctaagtttgtaaaagcaattgtaacatcatttttgttcgttagactaattaggctacttcctaaaccaaaatcttttgttgtagtttccatgtgatttcctaactagggctaacctgaggtcaactttttcttaaaagttttactaatgaaaatttagtatatctataaaaagttatccattccaataatcaagctgtcagtattttatagcccaactgacagcttgatcagtacaaaaattattgtattttaaagtttaataataaatctatgtactgtcagtaaattgttttaattatttcaaacgttcttcaagttctgcaacgatttcttcatgacatttttcagttaatttaactttgagtaaataaacagccagagcgataatcattaagaccgctgggactacaaaggaataaagtttgaaagttgcaacaccataagtgtgcccagagatatattttgaaccggtcattcctgccgcaatcgctacaaatccataaataccatttgaaaaggcacccgcaatcttatcaagtaatggacgcatcgcaagcgttactgcttcattacgaactccatttttccattgaccgtattctacagagtcggtgatggtcatcaaaactgacaagaaaacgagttgataaggtgctgtcaaaaagattaatccgcccactgtcattggtactgaatttcctaaaacaaagaggacataaccgacaagcattgaaataatggcccctgtcaaaactttacggcgtccaaattttttagccaaggttgggaacattggcactaaaatgattgaaccaataaatccgacaatccctgtgattgaataaagactagcattaccaataacgaaagtaaagttcaggattaaggttgctgttgttgctacataagcaatggcaaataaaatatatgagagtgacaaccacatcaattggtcatttttgagaagggctttgaaaacatctaaggtatttgttttcgttccttcttgacgaatcactgatttttgttctttagttccccatgcagtcactagggcagaaatcccttgaaccaacgcggcaatgacaccgaaagcgaagaaacctcttgcaccttgtgcatgtccacctttagtgaagaaaattgtaattggtattgctaaaattgttgcaccttgtgccccaattgctgaaccaaaacgagcgaatgttccaagtgtttcccgttcagaatttttttctgataaagctggaatcattgaccagaaagcaatatccttgaatgagtagaaagcatcaagaataataaatgcaataacgaatacgatggcaaacaatgtccgatttccacttttggctaatccgaagaagtctgaaaacatgagcataatcatcaaagatgacataatcccaccaacgaccaaccaaggtttaaatttaccccatcttgtgtgtgtattatcaataatcgaaccaataattgggtcaaaaataatttcaaccaaacgaataataacaaccaagcctgtcactaaagcaatcattgcatcctcatgaggtgaaccggcaaacatttgtgccgttacaaaggcaatgaagaatgtactaattgaatagtagtaaacatcatgtcctagtgcaccaaaagcgtacgataaacgttgtttcatttttccctctttcatgggaatcctcctttatactagatctactcatttttgagtaaaactgcagagatactgccttgtttttgagtacgaagtgatttacatcactcatttctatcacccatttagtagtctggtatgaagaaatactgtgattgtaaaactttatttttgataattttcaaaagcgaaacagtagtatatttcattttgaaatcgctcacatttagagtataacactttggtttaagaaagggtttccaattttggcttatcttttggaaacactttctatttttatttagtgaaagaaaaactctgacattatctaatatcagagcgaccttgttttaaagtataaatagaataggcatcaattaatacccgcgataaaattgataatgagagtcgactgtgaacatctaaatcaaaataattgacttcaagactgcttttataacctatcaaactaatatcagaaagattggtcagattagtattggcattgacagtcaaggataagattttgggattctgagctttggcaattcttaaagcatttaaaatttccaccgtttctcccgaaagagataaaacaataatcaaacttttttcattaacaaattgagcatagtaagccatgtattttgaatcatcgtgtaagctaactcttttacgaaaaagttgtaattttttcattagttcgtcagcaacgttcgtagacaaacctcgagaaaatattaatatttcttctgattcttgaattaattcaacagctttttcaatttcttcagccgagatattttcaatggtttttaaaagttcttcttgatttttagcgatcgctcctaaaacttcttttgaaaatccattaatttcagggagctttttctcacgaattgaatatctaaactccccataaccttcaaagcctttttttctgacggttcgatttacagttgataaagaaacatgagccagttccgccaactctgatatcgataattgagggattttttcataattttcctgaataatttgccaagtataggattctgcattggttaaattggacatgtttttttactccattgatttcttttttgttatcaaaaaatgttatctataactcaataatcaacacaaactgataaaaggtgaagaatacaagttaacgataaaagattctaaacagaagttagaacgggtactccatgtttccaagtcgggggaaataaacattgtagaaaataaaagtaagcagatggcttcaacaagtaaaaaaccaatgaaaatatcaatggtcattcttgcttttattgtatctggagcgatagttttttatttcaaaaaatagaatatttaggtcaaactgagaaaggggaattatgaagattaaatatattctttgggtcatctgtgccctcttacttttgaatacaggtaccatttttgctcaggaaataggtggaacaagtacaattggtgaagtaggatttttagaaaaaggaccaatagaaaaaccaccagaaacttctagtgcaccgattaccactaacaactcaaaatcaattaatcagaaattacccattgtagggagtactcaaggtgatactctgacattgatggcactcttattgataatcggcgcgggagcattaacgataaaacatatcggaattataaggataaaggagaactataatgaaaaaaacaataattagtcttagcggcatcgccgtcattagcacagccttattagcaaccaatcttttggaagttagtgcggcgacagtgggaaatacatcaagtggggctaatgtagcctttcaaccgaagaaaactcctaccaatccagtatcgccaggagatggtaaaacgccaattacgcctactacgccaggagtgcctaacacttcaactccagttgcttcagatgatgggttgactttggattatgttccaacgcttaactttgggacacactatgtagatgcttcaagccctcatacttggtcggcttgggctgcaaatgatggaagtggaaaagcaattccacaattcatgcaagtaacggacaaccgtgggactgcaactggaccaacaggttggtcagtttccctaacacaaactgctcaatttaaagggactaaagctggtgatttaaccaatgctgtattaacctttaatactgataaaactaataatgttgtcagcacctcaacaagtaaagcaagttctaccgtaaatacggcaactaatccactcacacctggaacagcggtcaatattttccaagcagatgcaggaacgggaacaggaacaaacctgcttagttttggtgcggcggatggttctagtttggtgacagattctgaaagcttagacgcttcaacgaatactacaggtaaagtggaccctaatattacgctcagtgtgccagctggttctgctaaagtagatacttatactacaactttaaactggaatctttatagtgcaccaggaaatgcctaataaagtattctcgtaagggagtctctcgcaagagaggctcaaattttattaaaatttggggttatggggggattatatatgaaaaagttacaattatttttatcatcaatttttatcattctatgttttggaggtgcacaagttgcttttggtcaaaccgatgattatacggtcaaaccaattattccggaaaaccaaacaaataaagatttgggatattttgatattactttaggcgcgggcaaagaacagactttgcaagtggaattatccaataataccgagcaagaaatgaagatagaccttgcactttctagtgctgccacaaatatcaatggtcttgttatttacgagcccacagaaatagaggctgaccgctcacttaaatataatcttaaggattatgtcacaagtccacggatagtaactttagcaccgctgacaagacagaagatagatattaaagtaaagatgccaaatgagagttttgatggtcaaatagctgggggaataaccttttctaaagaaggtcaaaatgataagaaagaggactcagagggaattaccgttaagaacacttattcttatactattgctcttctaatgaaacaaaatgagaatgaagtttcgccagatttaaaattaaccaagatcagtcctggtcaaataaatgggcgaaatgtgattaatgtcaaccttcaaaatccaacgatggcttatatcaatacgatgaatgtaaaagcaacaataaaaggcattaccgattcagatatagcttattattattcaaacccaatgatgcaaatggcaccaaatacaaattttgatttaccgatgccaactagtaatcaaagtgcggcgacaagggtctcagagccattgaaagctggtaaatatcgacttcaacttattgttaatgcaagaacagattcacaagaaaatatgaagcgaaggttgataataagaatgaacgttataaatatcagtggacctttgaccaagaatttacaatttctgataatcaagctcaaaaattgaatgatagtgacccaacggttaaaaaagaaaaagattggacttggctgctcttcatcttaggtctaatgttaattatcctgtttttctttctcattatttggaagcgaagaaaaaaatcacaaaaagaggaagaagaaaaacaagtgctgagagaaaaaattgaagctcaagaaaaaataattgatgatttgaataaaaaataatccctaatttttccaaaacaaaaaaccttccagatataaaatggaaggttttttatattatttgattagtgggctaatactgttaaagattaaacaacctaaggcaccacctaccagaggtcctaagactggaacccatgagtagccccagtcagatgttccaatatttttaattggaaggagcgcgtgcatgatgcgaggaccaaggtcacgagctggattgagagaataaccagttgttgctccaagagaaaagccaattgcggtaattaatccaccaactaaggcaggtgataaaccatctgccaagtgatttcgcccaaaggaaagaattccaatcagtaaaaccatggttccaatcacttcaccaaagaaattggaagggaaatggcggatggctggacctgtcgaatgacagcccagaattacagcagcatcttttgtttctgcccagtgaggatagtagaagagccaaagaatgaagctagcaagcattgctccgaggaattgaccagcaatatagggaagaacaagagaccagctaatattaccaattaaagccataccaatagtgacagcaggattcaaatgagctgcagacataaagctagagctatatacacctaacatgacagctagtccccaaccaaaagcaatggcaatccaaccagcaccttctgccttcgtttttttcaaagatacagcacagacaaccccgttaccaagtagaatcaggataaatgtcccgataaattctccaaggaattgaacaaaagtagagttcatatagatattctcctaaaattattttaaaatataaccatcagctaaagcaaggaagctctcaacttgttctttttcccatgcttcatctttacccatttctttcgccatcagttgggcgactttgggagccatttctttggcaattcttgcatcaaggaaaagtgcacgaatccgacgagcgagaacatcatctagagtttgagccatttcttcacggacagcccagatgacttcagaacctgtaaattcgtattttgggtgaagaggtaaggctaaagaagagtcttcattttggagagctaaaatctttcctttatcagaaccgtaaacatagagccagttttgacgttctctttcagttgtttctttggccccatgtattttcaatgttctggtgatacattttttttcaggaagtttagaggttttgattgctaaatcaacagtttcttcggccatttggcgataagttgtccattttcccccagtaattgtgaccagtcctgattcagaggtgaagagtttatgacttcttgaaatttctttcgttttttcgccatcaccttctttgggagcggcaagtggacgtaaaccagcataagcagttaaaacatctttacgttcgggtttcttttctaaatattgaccagcagtttctaagatgaaatcaatttcttcttcaaggggtcgaggttctaaaacgaattctgtaagaggtgtatctgtcgttcctaagattactttattgtgccaagggacacagaacaagacacgaccgtcagaagtttttggaaccataatggcatcttgaccaccgagaaatgagccgtcaacaatgaggtggacgccttgtgaaggacgaacagagggcttgtgttctttggtatccattgacataatttggtcaacaaagattcctgtagcgttgatgatggattttccgtgaagttcaaatgattcgccagaaagttcatcatgaagtttaacagaagatacttttgagttcgttttaacaagctcagtcactttgacataattaactagtagcgcaccttgttcagtggcagtttgcataaggttgatagccattctagcatcatcgaattgtccgtcataatacatgactcctccgacgagatgttcatgtttgatttgaggaattgcttcagcaacttttttcttagaataaatttttgattttccaatattcaatttacctgccaaagcatcatacattttcattccgatgctataaaatggttgctcccaagctttgtaattggcaatgataaatttttgattttttacaagatggggaccgttgcgagcaaggcgacctctttcatgtaatgcttcacgaacaaggctgacatctccttgagcaaggtagcgaacgccaccgtgaacaagttttgtcgagcggcttgaagttgattttgcaaagtcactttgttcaactagaactgttttataaccgcgtgatgcggcatcaaccgcaactccaagtccggttgctccaccaccgataataatgaagtcccaatcatcgggatttgcttttaaatattcaatatttttttgacgagagatagacatcttgttactccaattctaataagcgatacatttatgatacttttaatatgatttattcaaaagatcttgttgcctctacggctttcttccagccagaatagagtttattgcggcgttcttcttccatttggacgtcaaatcgttttccttctttggctgattctttaagttcatcaaaatctttccaataaccaacggcaagaccggctaggaatgcggcaccgagggccgttgtttctaaatctccagctctttgaacggaagtatttaaaatatctgcttgaaattgcatgagatattcattattcgttgctccaccatcaactttaagaatgggaattttgattcctgtatcttcacccatagcacctaaaatatcacgaacttgataggcaattccttgtaaagttgctttgatgaggtctttatctgttgttcctctagttagtccaaagattgcaccacgggcgtcttggtcccaatagggagctccaaggccgacgaaagcaggaaccatgtagatttcatcttcattttttgattcaagagcggcagcttctgagtcgcttgctttgtcaataatcttcaaaccatcgcgtaaccactgaatagaagaaccagcaacaaaaacagaaccttcaagggcataattaatttcaccattaatgccataaccgatggttgtcaaaagattgttgtgtgaaagctgaggtttatctcctgtgttcatgacgataaatgaacctgtgccataagtatttttgaccatgccaggttcaaaggccatttgtccaaagagcgcagcttgttggtctcctgccatgccagcaattggtacttttgagccaaagaagtggtaagtctttgttagaccataaacttcagaattagaaacggcttttggtagcatgatttttggaatgttgagaaggtcaagaatttcttggtcccattctaaagtattgatattgaaaagcatggtcctgctggcatttgaatagtcagtgacgtgaacttttccgtcagttaatttgtagacgagccaactgtcaatcgttccaaagagaagttcgcctttttctgcacgttcttgtgccccttcgacatggtctaatatccagcgaatttttgtggctgagaaatatgagtcgataatcaatcctgtttttttatgaaaaagctcagcatgaccggcatttttcaaatcatcagcaattgaagctgactgacgagattgccagacaatggcgtgatagattgggagaccagttgttttatcccagacaacggttttttcgcgttgattagtaatccctattccggcgatttggtccggcttaattcctgattcaataaaagcaccagcaatgactgactgaacagaattccaaatttcattggcatcatgctcaacccagcctgcttctggaaaatattgagtgaactctttttggcttgttccgacgtgttttccgtcatggtcaaaaataattgcgcgcgaacttgtggttccttggtcaattgccatgatatatttttctgtggcttctaatggtaatccctcagacataagttttcctcctaataattacgactaaatgcattctgtaaacggttactattatagtatgataacagaaagatgtcaagcaaaaaaatcacaaagttatgaggagagagtatttggtgaggttgtaattgcttggtattgttgaatttttgtggtttgaatgaaaaactttaactgattttttaataatttcacaaactttttggattaaaacttcagttgtaagctattaattataaattttggtaaaataattagaagaatagattgagaaagatgcaaaatttgcaaggataattatgattattttatttaataaaccttttgatgtactgacaaaatttaccgatggagagggccgcaaaactttaaaagattatatagaaataccaaatgtttatgcggcaggcagattggataaagatagtgaaggtctacttttactgacagatgatggaaagctcaatcatttgctgacagaccccaaatcgaagtcttttaaaacttatttagttcaagttgagggagaattttcgatagaagcggcacaaaaattggaaaaaggtgtcttactcaaagatggtaaaacgctacctgctaaagtgaaattaattgatgaacctgagtggctttgggaacggacgccccctattcgagagcgaaaagcaattccgacaagctgggtggaaatttcaattaaagaaggaaaaaatagacagattagaagaatgacagcggcggtaggatttccaacacttcgtttaattcgctggtcaattggacaatacacgcttggaaatctaaaatctggcgactataaaatcattaaataataaaaaaggaatcacttaagattccttttttagtttaaaaactacgtccgccaccagagccatcactgaaactattattgtcagaagaaggacgggggataatgcgggttgtaatgaaggtattaactagaatatcttctcgttgatgaagttgtagatttccatttcggccataatcgtagcgccatacggcatgggcatctttcatttgataacggcgatagatggtccaaacaaagccactggcagcaatcaaagaaataacaacggcaatcaaaattgagagaggttggaaactgcgatgaaaagtaatcgctcctgtttgactattaacggtatattttcttgtcgttggaattcctgcttgataatatttggatacttggtcaaaaaatccagagacagcctgatagtaattatcagatgacaattcgggttggacgatatctaaagtcttttcaattcggctagaaggcagataatacttaaggtttcctgtggcccaaatgtagactttacgcaggttcatgttaatgactagaacgacaccattatttttagctcctactttgtcagccagataggtttttgccatttgacttgctgatgttgagctgtcagtagtcaccacaaaaacacctgctttggtttgatttgctaattgctgggcctcttgctcaaggagtgtaacattccctcctaaaagtttaaaattgtcctcaattcccgactgaaaagttgccgcagaagtttttggagtgatcagtaaaaagaagaagctaaggaaaaatagggaaaagataattattttttttctcatgatagcagataccccacaatgattccaagaagaaggacgagcataaagattacaatcgcaactgtccaaagttttttcttatcaattggtaaaagtccggcaactttaccggtttgaccattcatggcatagtaaaaaagtcggtcatttcctgcttctttgtaagtcactagccagattgggagcagaacataatcttcatctaaacttttaatctgctggttactttgtaagttactgacagaagtatagccaacaattgttgattccatcagtccatcagcatattgacgaaattcccgttctacattttctttcatgtcaggaaattcaatatctcttttttcggttaaaaagccagaaagatattgatttttaaaaggaatagcagcagtcatgtcaaaaggttgaacagcaccaaccattttatctgacagattttttttcaaagcatttttgattaaatctttgaaagctgtatctccaccacgttgaatctcatactgggagtgttcggtgtattcagtatctccgacaatccaaacgcgtaagttggttgcttgtgctgaaattctaccagataattcagcatcaacggcccaataaggaaaataaacgcctgacagattttgaatttgttttttgtcaaaaaaggctttgggcacaaattttttcttgcccacccagtctaaaaattgttcttcagccgcttttctctcaatttgaaaagggagtattttttcgggaaggaatttacctgataaacgttcggtcagaacaacaggattatggcaataatagcaccaagttgaagcagttgtagcgtcagtaacgatttcggcaccgcaagaaggacataaaaagagtccaatttcttcatcagcagtttcgtcagtagaaaaatcatcggtttgattagttttatcgtgctccgttgggaatggtgtggggtcatcagtaacttttgccgcctcttgtttggcttcaaagtcagaaacttcttgttcagtaaaggttgagccacaatattcacaatggaatttttgatttttaggttcaaatagtagtggccccccacaatttggacatttatgtgtaagaacttggctttcgctcatcgtttctccttactttatgatatgaattctgctcagccaaaaagaattgaaataaaactagctcttacgctatgaaaagttttattcaggacttttagtcatttgaattcagttcagaaaattagaattttaaaatataaattcttgaaaatacgcaaagacaagcagccctaacttaggactactttatcttataaggatatatcaattggtttaaagagctttagcgacaaagggtttgccacattcaggacagaatttagggacgccatttgctaaattaacaactgccccacattcgttacaagccatgtttaattcaggcatgacaggagtagctgacggttttgcttgcccacaatttgagcagaacttaccagtattttttgtattacactcggggcaagtccaaatatctgccttattttctgcttgagattccatttgtgcttgatttgtttgtaaaaaaccagcaagattttgtccacccatattcatgcccataaaggcatttgctgcacctccggtgtttgagccagctgcttcaagaccacgagcgacagccccttgcacaaaaccttcacggatggatgggtcaccaagcattgctccttgattacgcatgttaatcaatttttgactgtcatcagtataagaaatacttgccacggcaacagaaacaatttccatgccacgtaattttttccaatcctcatcaagaacagaagccatgtacttgctgagctccatgcttttcgatgttaaaaatgaaacacgttcaccttgagcagaatactgattgattgacgtatttaatgccgttaaaaattcagccagatactggtcgttgatttcttgaatttccacatggtcagcatttttaggaatgacattggcataaaaagctagtgggtcagtaattttaattgagtaagttccgtgtgtacgtaagaaaagctccgcattataaaaattatcaaagtattggagaggtgttgctgtgccaaatttaatgcctttgatttcttgaagattgacataataaacttcttgtttttgaggagttgtaccaccaaatttgaaacgaaagaaactttcttgaatcgaatcacgtaaatcaccattgaaaagacttggtgcagtatcatttttgacggtataataacccggttcggcagtatagtcaatgattttaccaccatcaacaagaatcatcatcatattttcataaacgtgaacaacagaaccgtcagtaatcacatcttcggttcctttgcgattagaaccacgttttgcatcttttctcaccttgattcccttagtgaaaacggtttggtctgacatttcatttggctcaatgacctcaagccattggtcagccaaagccccaccgagtgaacctgttgcagctttaataattcccatgtattcttttacaaacaaactcaagacactcaatgttacgagtgatcgaatttgtcttcctttcctttagtgaatagctaggctatttgacttaattatatcaaatttatttgatgaagcctaccaattatttgaaaatttactaaaatcagactaaagtaggaatttattgattctctctgagccagtcgctaatttttggaagatattcatgtccgtattcaggtaagacataaagagtctttttactttgtattttattataagccgccatttgcgtaatcgggggaacaacagtatctttgccacctaaaatccaaatgacctcagccctaatccttggtgctaaattttgaatatcaatgtattctaactgattaaaaaaccagtcttctttttggtgaagtggatctttaaactggaaccaatatggaagttcttcaaaagcagattcctcggcaccaagttcataagctttgcgataatctgaaagaaatgggtaagttgcagtcactttttttataagaggagagagagcagcgcatgcaatggccagtcctcctccttgcgaagcaccctgagcacttatatttgtttcatcaacaaaatcaaagttggctaaaatttttgttgcgctcatcaaatccatgaattgccgaacataatagagatttccatatccttcatcaattccgcgaacgatgagaccttttagtgtcatgccagaagtttcagtattatcctgactcaaacctccctgaccacgacaatcaagagcaagtaccacatttccctcagcaacaataccaattttatccacccaatctccgctgtcacaatgataaccgtgaaactgtataatagctggatacttttgattcaaattttttggaacgattagttgagcatgtatttttgcaccatcaattgctttaaaccataaatgataaaaatgggctaccctagaggggagtttttttctattagttaaaattcaaactgataattattaactaatttaattttttcatcccaaaattcatcaaagttatctggtttattagaagctccttgataaactttccaacttgctaattctgtcataagcttctccaatttattcttgcaatatttttcgaaaaggattacaattgcattgtttatagataagtatatactttttaaggtggaatggcaagaaaaaatgaaggcaattaaagcagcaagctttggctattatgccaaagaaggagaactaaataatgaatatgctcagtggtcaatgagaactctcaaagaaaggacaaatattaatacgattattttaaccatcgtagctgaacaagcaaacgctcactcaacaagcattaattggcagaccatgccaccaaaggatgaagaaatcaaagcaacgattcgttatgctcaaagtttgggacttgacgttattttaaaaccgatgattaattgcgctgatgggacttggcgggcttatatcaatttttttgatattgatgttgtatgtgagccaaaatggtcggattggtttttggcttatagaaattttctgcttcattacgccaaaatcgctcaagaatttggagctacaatgtttgttgttggttgtgaactcgttagttcagaccatcgcgaagctgagtggcgaaaattgattgatgatgtacggggaagctataaagggttgattacttataattgtgacaaatatcaagaagatcatttgacttggtgggatgccgttgacgtcatttcaagttctggttattatccctataaccagtgggataaagaacttttgcgaattgaaaaagttgtcaaaaaatataacaaaccatttttcttttgtgaagctggtgctcccagtgttgaaggtggtgatttattgccaaatgattggacaaataaaggaaaagtcagccttgaagctcagacaagattttatgaaggaatgctgagcgcctgtgccaaagttgattttgtattaggttttggtctttgggattggaaagcacaaatttattctgccaaacaagcaaccaatgatatagactatgctttttacaataagccagccgaaaaattaattaaagattattatggaaggactaattaatttaaaatgtaatggatttcaaaaaaagtattgacaaaacaaaatcaaaagtatatacttatttcgttaaataaaaacgctttcaaataatgaaaaaacaggagaaaacatcatgaaaaaacgctacatttttggttcagcagctcttgcgcttctagctacaataacacttgcagcttgtggtagtaaaaccagttcatcagggactggaaagaatatcaaggcaacgattacctttgttgaccaaaaaacggatatgcactccaacggaatgtggaagaagtatattgctcaattcaacaaagaatatccgaatatcaccgttaaagaacaagccttgaacaactatgaccaaacagagcaaacgagaatgtcatcgaaaaactttggcgatgttatagcaattcctgcagccgtagcgccaaaggattatcccaacttttttagctcgctaggtaaaacaaaagatttggaaaagaaatatacaagtcttcaagaccgtacctataaaggcgaacaatatggtttgccatcagaagtcaacgccaatggctttgttgtcaattggaatgttttcaaaaaagctggcattgataaatggccaacgacgactgacgaatttatccaagacttaaagacaattaaaacaaaagaaccagatgttaccccgctctatactaactatgcctgtggttgggcacttgttgactgggattttcaacgttcatcagtagctggagatccaaactttgatttggcacttgctaaaacagataaaccattcacagctggtcaacccatgtataccatttacaatacactctatacagcggctaaggacggcttgattaaccatgacccaacaaccgatgattggaatacttcggtttcgcaaatggctcagaataaagttggtgtaatgatgcttgcgacgtgggctgttccacaagtccaagctcaaatgtcttcaaataaagatgccatcaatgttgaacctttcccacaaaaggcccctgatggaaaaacttatatgcttgtcggtggcgattataactggggcgttaataaaaacagtaaaaatcaagaagccgctaaagattgggtcaattggttagtagacaaatctgatttcgccaaagataatgatggaatgacggctatgaaaaatcaaccctatccagctgacctgaatgatacaaagaaaaataaagttgttttctttgaagcaggttcaacgccagctgataaagcagatttgttctcaaatattaataatggctcacaagttgggataggaacaactcaaacagttaaacaacaaattattgattcaggagatggctcatctaataagtcttttgcctcgattatggacggtttaaatacagcttgggcccaaaatgtaaaacaatataatcctgataagaaatagtaaaatcatgatttgaaacatattttagataaagatgatgaaaggtgttgggttggaaatttatttttccaacctttcatttttggagggagttaccttgaataaattatcacaaaaagcgcagaaaagattaatcatttttgcctttacgattgttccacttgtcttacttttgatgttttcctactatcctttagtgaaaatggttcaatattctctgaccgattggaatggaatctcgccaagctcaaactttgttgactttgaaaattacgaaaaagttttttctaatccaaattattttggtgttttcaagacgagtttatattattttttatcaagttttccgcaacttggactggctttactttttgcgacaatcttgtctttcaaagttaagtttgctaatttttggaaaggaattctcttttttccttacttgttaaatggcgttgccattggttttatgtttttatatttttatataacgggtggaactttagattcacttttacacttggttgggattcagcatgtgccactctggctgggaaatcaatctattaataatatttcattatcttttgtttcgatttggcgttatatgggctttaattttttgatttttcttggagcaattcaatcagttgacccagaaatttacgaggctgcagagattgacggtgcaaatcgttggaatcaatttcgctttattattattccagcaattagaaatatcttatttttgaacatcattttatctgtttcaggctcactttctgtctttgaagtgccatatattatgactggtggagccaacgggacaatgacttttgtcattcaaacggtgcaaacggcctttaactataatcaagtagggcttgcgtcagctatggcagttattctattgattattgtcgtggttgtctcagcggctcaatttattctgacacaagacagaagtacttctaaaaagaaagcaggagcataatgaaaaaaaacaagtagacagaaatttcgtatgagtcagcttctaaaatatattccgttaactttggcggctcttgtagcagtcttaccacttttggttgtttttattggctcttttaagtcactgacggaattcacgaattcaggggttttgagactgccaaaacattttacgttagccaattatagccaagcttttacgcaaggaaatatgctgacaggttttaaaaatacgctcattatctttgtgatttcaatgacgggtcagcttttgatttcatcatcatttgcttatgtgatgaaccgctttgactttcgactgaaaagactgattttggcgctctttacgatagccatgttgataccagccattacatcccaagtggcagtctttcaattgattaatcaattaggtttggtaggcacgcgctggtcagtcattctcctctatattggaacaaatgtaatcgccctctatatctttctacaatttttgcaagaaattccctattccttggacgaatcggccttgttagatggggcttcatattttaggattttctggtcaatcatcttgcctaatttgaaagcaccaattgtgaccatggtcattatttcaggagtgggtgtttataatgatttttataatccttatctctatatgccagaccctagcttacaagtgatttcgacggcactttttgctttcaaaggttcatcggttgtgcaatggcctgtgattttggctggggttatgattgttattgtacctattttgattgttttcattgttttgcaaaagtatatctataatggagtgacaggagcggttaaatgaaagtatcaggttttacatgggcaatccaatggatttatatgattgtactttcgtctctgatgttttggctaaattttctgcgtggctttattttattagggacaacttattcctttaagaaaagttttgcttatctgcgtggaacttattacgacaaataccgcgaaagaacacatggagttaaggttaaatttgatgtcagtaatttgattattatctttatgcttggtgtcttctttttggcaagtgactttccattatctaatctgacgacgtttttgattttggttagtattgcttattttgtattgacattgatttatattattttcaagacatattataggttagaccgatttgttgaggttattcaaaaaatgaaaaacaattggtcaatggtcttttatacattgatgattatcattttagcatttctcctgacgggatttaatcgaatctggtttgttttatttattcctgggttactttgtaaaatgatagatattgcttttagtcgattagaaaagaaagaagtgagatagatgacagaaaataaatgggcactagttacaggtgcttcaagaggaatcgggcgagaaattgcactgtttcttgctaaaaatcaaataaatgtagtggttcacagtcggagtttgaaacatactgaatctttaatttgtgagctcaaaaatttaggaattaaaacttttgcggttggtgctgaattatcagatgaaatgcaagtacgtaaaatggctgatgaaatagataaacgagttgctttagattatttattcaataatgcaggaatccaacctaaagcacaaactccttttagtctaatgaatgtggaagaatatatccaaacgtacaaagtaaatcttgtcgctcctatgattttaatagaaaagtttttaccaaaaatgattgagcagggatttgggcgaatttgtaatacaacaagtgggattatttataaacctgaacaaagtgcttacgcagcttcaaagggagctttagataaaataagcaaagacttttccaaaaaaattgaaggaacgggtgtaacaattaatgttgccgatcctggttggattcaaacggatcttggtggcaaaaatgctccaaatctagtggatacggttgtgcctgggatggcattagcagcctttacatcaaatgacatcaatggaaaatggatctcagcgcaggcttataagggcttgggattagaaaaagctttagaaaaattggaacaaaatttgaaagaaattacgtggtagtaaaaaaagatgattgaattaaaatttccaaaagatttttggtggggagcagcgactagtgggccacagctagaaggacggtttaacaagaagcacgccaatatttttgactatgattttgaaaaatttcctgagcatttttggcatggtattggtcccgatgtggctagtaatttttataatgattttagagaagatattagattgatgaaaaaggcaggtttgaactcagtaagaacaagcattcaatggtcacgcttgattgatgacttggaagaaggaacagtaaaccctgaagcagtggagttttataatgccgtcattgatgaatttttatcaaatggtattagaccgataattaatttacatcattttgatttgccagttgaacttcttcataaatacggcgggtgggcaaataaacaagtgattagtttctatgtgaaatatgctgaacaatgtttcagattatttggtgaccgagtgagtgattggtttactcataatgagccaatggtagtagttgaaggtggctatctttatcaatttcattatccagacttggttgatggtaaactcgcagtacaggtggcttataatttgcaattggcttcgagtttagccattcaaaaatatcgtgaagtgaatcaaaattctgatggaaaaattggaatcatcttaaatttaagtccaaattatccagcctcacaggataaagaagatattgctgcagcccattttgcggatttatggcaaaaccgactctttatggatgcatctgtcaaaggcaaatttccgaatgaattagttgaaatcctaaaagtatggtccgttggtcaaggggttaagacaccgccttttcacggcggtaacacgggttcgaatcccgtacggactatattattaaaactcgggaaaccgagttttatgttattgcggattagctcagttggtagtagcgcatgactgttaatcatgatgtcgtcagttcgagtctgacatccgcagttttttagagagactttgaggtctctctttttattatatttaagaaaataattgattttttttgatataatttgataaacggagaaattatataaaatgcaaaaacgatatacaacttggaatgaatatttaagaaaaaattttggtgaaaaaatatttaaagttcctattgatgctggttttgattgtcctaatcgtgatggtactgtagcacatggtggttgtactttttgtacggtttctggctcaggtgatatgattctcgaaccagaagcaccaattgcggatcaatttgcggctgaagtgacccaatttcataaaaaatggcctggcgttaagaaatatattgtttattttcaaaatttcactaatacacatgcccctgtagaagtgttacgtgaacgattcgaacaagcagtaaatcaaccagatgttatcggaatttcaattgggacacgtccagattgtttaccagatgatgttgtagaatatttagcagagcttaaccgtcggatggaagtttggattgatttaggattgcagacaacttatgaagaaacttctgatatgattaatcgtgctcatgattatgaaacttatgtggatgctgtgagacgtttacgtgtttatggcattaatgtgtgtacacatttaattaacggattaccaggtgaaacgacagaaatgatgttggaaaatgtgcgccgtatggttttagactctgatattcaaggggtgaaactacacttactccatttaatgaagcagactcgcttgcagcgtgattatcatgagggaaaattacagctaatgtcacaagaggaatatgtgcaagttatctgtgatcagctggagttgattcctaaggaaatcgtcattcatcgattgactggggatgctccacgtgatttgattattggaccaatgtggtctttgaaaaaatgggaagtattgaatagtattgatgccgaaatggaacgacgcggtagtattcaaggctgtaaagatgttcgtaaaagcggtctaattactttttaaattaaaagagatgaatttttattcatctctttttgcaaagtttgatacaataatagtaagatgatggaaaatattaatgacaaacttatcggtaatctcttgaattggtatataaaaataattagaaagtgatgagtaaatagatgttaaaacagatagaaatggcccactggatgttgaaagacatcataaatgttgatgatgttgtggtagatgcaacgatggggaatggctatgatacgctttttttagcagaattaggagctaaggtatatgcttttgatgtacaagaggcagccctagaagcaacagaaaagcgtttagaaaacaaagcaataaagacgcaaataatgaaaaaggcttctccagttgaccagtctaccctatcactaaaggaacagactttcaatgaagtttctatgacagagccgtcagtagacttgattttggctgggcatgaagaactgattaattacgttcaaagtccggttaaagctgctatctttaaccttggttatctacctaaaacggataaaaatatagttacaagggcagaaacgactctgtcagcattatcgtccttgacagatttgttggttgtgggtggtaggattgcgcttgttatttattacggtcatgaaggaggagaggaagaaaaaaatgctgtcattaattgggcttcaactttgccacaaaaggactgggaagtgacttcttatgcacctcttaatcaaattcatactccaccaattctagtacttattgaaaaaagaaaatgaatttaaatgaacagttatgaattttgtgtattcttttatctcttgttttttccaaaaaaaagagtaaaagagagaaatgcttaattttttaagtaaaaaactattttaaagaggtaaatataaacatgcaaggagttcttatcgcgcttgttccaatgtttgcttggggttctatcggatttgtagctaataaatttggtggtgatgctaaacaacaaacacttggaatgactttgggcgcttttgtttttgcacttattgttttcttattccgcatgccaacgttgacatggcaaattttcttaattggatttattggtggattgctttgggtaattggacaatttggtcagtttaattcaatgaaatacatgggtgtttcagtagcaagtccgctttcatcagggagtcaattagtaattggtggcttgattggggtttttgctttccacgaatggacaaaacaaattcaatttattctcggatttattgcgatggctgttttggtagttgggttctatttctcagctaaacgtgacccagaaaatgcagttgttgaagaaggacgtaattatactaaaggattgactgctttaacttactcaactttaggatatgttatctatgttattctttttaataacttagcagtactttggttcaatgttcattttgatgcactgacaattatcttgccaatgtcagttggaatgatctttggagcacttgtgatgggtcgtttcaaaattaaaatggataaatatgtttatgaaaatatgattgatggagtaatgtttggtgtaggtaatatctttatgcttatggctgcaagcgctgctggtaacgtaattgccttttcattctcacaattaggtgttatcatttcaactattggaggaattctcttccttggtgaaaagaaaaccaaaaaagaattggtttatgttggaattgggattgttctgttcgtaacaggtgcaattttacttgcaattgtaaattctaaaggataataaaaaagctgtcagtaaattgacggctttttttgtgagttaattttctgacaagttttctgtcagtaaaattttatagtttttcattaacgaaatttacaaaatgattccaaaaaacctttggagcgctactacgggggacagttttcttagcaaccaatggaatttgttctgcggtacaatttggaagatagcttaaactatcctttactgtagtagaaagtgtgacaagtttttggtttttagtcacagttgcttcaactggggctgtttttttcttactgaatttgactgtcagtgattttttatctgcactaccatctgtagcataaggaacaacgggagtgatattttgtggagcaacgagttgaacagatttttcttttccatcagtcacagcaatttctttaaaatcatctaaggattggtttttttgcacaagacttgtcgtacgtcaatgcccataaacatagttcatcagttgatttgtgagggtgaaaggagtcgagttgtcagcagcaggatctgtagcttctaaaacaactgtaatgattctaaaaccattttgatttgttgttccagcaaaacagtcaatttgaaaacttgttgaacctgttttcaaaccatccacaatagttcttgaagtagaaaatccactaagcatttggttggtattggttaaagtcattttttcttcattacctgtatcaaaaggaatttctgttttcttagtaatttgaagaacttctggaaaatcttgaattaagtgataactgagtgttgcaacggcttttgcactcattgtatttgttgctgaggcgccagaacctggataaatatgaccattcaaatcatcatttggtaagccggaagcattgacgagatggctgtcagtaattccccaatctttcatttgtgctgtcatcatatcaacaaattttggttctgagccagcaattttttcagctagagcgacagcagcagaatttgcggatggaagaagcaacgcattcaataaatctttgacagtatactgaccattttgagctagcggaatgttggaagcattagaattttgagttaattcataagcatagtctgaaataggaaccttagtagtccaagttaatttattctcagctacatttttgtaaactaaataagctgtcagtaattttgtgatagaagcaattcgtgtgcttgcatcgtcagcattttgcgcgtataaaattttaccacttgaggcgtcaatagcaattgctgattttgcggcaactgtaaagttatttgttgtagtagtatcagcactgacagcaaagcccgaaaggactgataaactcatcagtaaagtacaaaaaataattgcaatttttttcatgatttgattataacatagtgacttaagagatacaaatagccctcaaataatgtatcagcactttttaaacccacaagtaaaaagctagaaaaactctagcaaatttttgtcagaaaaaaggtaatctcaattatctagaatatgcattttattttgtaggcaatttggttattcctaaaaattgaaggagacacctaaccacaggggcatattttacctattttgtgataaaattaaactaggacaaactcgcgtggatcatccacatttttaaaatgtttatgaaaatttattataaaaggagaaaaatttgaattgattttaaaacatgaggaaattgttttagttctaaaagaaaaagtaatttaggactaggggaaaaaataaatattagtgtcttagaattttaaaaaaggaatatcaaattatgagagaagtaccattttgtccgatattaatcttttttgcgttttttatactaatttatctagggctaataatagcgataatcatgacggcatttgtcaatacttttcgtaaaaatgaaaacatagatgaactgtttttagatagatttgaacggctgactaaagaatatttttatactttatttaaaaaaggatataaacctaaaaaaggagagctacctgaatggattcgatggataagtaagccctaagggaaatgtttgcttagtccttgattttagaaagacgaaaagtattagtatgcttaaaaataagaatgttattccaagtcttaattctattaaacgaataatttaggagtcaaaggcaagtgaccgataatagtttataatttattggaagaatctatttaaaacaagaactttagttactttaatgttatcctttttcctcaccctgtacttgaaagtacaccttatctccatttagaaaggagtttatgaataaagacagactgtctattatcatagaaataatttttattttactaatcattgtttatgctattcatcagctagactattaaacattcatggagggatatatcatgaaaaaagacgaaatcatcgaactatcagacggacaaactgcaacaattattactggagatgaatctagcattttaaataatagttatattgttaaacttgaaaatggagaggttagagtggttgacagaaaaaccttgactctagcggcaactaaataactcaaaatataagcttaatcgctttttaaaaaaggattaaaagtaaaaaatagattgacaatcactgtaaaaaatgatattatattaaacggtactttttactttggactctcaggagaacttgtataagttgctaaacttcttgtcagaacttggcttaagcgaccatatactgactaaaaaattgataaaagaaattgagttcgatttcccatattctaggaaaatagacaaatgtttccaaggaacttcgttcctctccaacgttttctaattttctacgaatataaacggtcaatctcacatcttaaatcatccaataaaaagaaaggaatgcttttgtatttctcatcgcttcgcagaaatgtggaaaaatataaaaagcagacagtaaaatgcctacaattaaccaattggtacgcaaaccacgtcgtgctcaagtgactaaatctaaatcaccagcaatgaacgttggctacaacagccgtaaaaaagtacaaactaaacttgcaagcccacaaaaacgtggagtagcaactcgtgttggtactatgactcctaaaaaacctaactcagcgcttcgtaaattcgcgcgtgtacgtctttcaaaccttatggaagtaacagcgtacatcccaggtatcggacacaacctccaagaacacagtgttgtacttcttcgtggtggacgtgtaaaagaccttccaggggtacgttaccatatcgttcgtggtgcacttgatacagcaggtgtcgctgaccgtaaacaaagccgttctaaatacggtgctaaaaaaccaaaagcttaagaagggagataagtaagaatgcgtaaaaatcgtgccccaaaacgtgaagttttggcagatccaatgtacaactcaatcgtcgtaactcgtcttatcaaccgcgtaatgcttgatggtaaacgcggtgttgcggctcaaatcgtttacggtgccttcaaacaaattgaagaagctactggaaacaacccactcgaagtcttcgaaactgctatggaaaacatcatgccagttcttgaagttcgcgctcgtcgtgtcggtggttctaactatcaagtcccagttgaagttcgtccagaacgtcgtacaactcttggtcttcgttggttggtaacaatcgctcgtaaccgtggtgaacacactatgcaagaccgtttggctaaagaaatcttggatgcagctaacaacacaggtgcagcagtcaaaaaacgtgaagatactcacaaaatggctgaagctaaccgtgcgtttgctcacttccgctggtaaaatcgtaattgcgtcatggctacttcgtcgaaagaatcctcgtgtacttcggtacgcttcggaacctttgtcctcgtatccatttagcaattccaattttacaatctaaaaaagattgcgaaaacatcgaattgatgtaaaaacgaacattaccgggcttgggctcctcgcctgctcggttttgttttaattttttaacataaatttgatacaataaaactaatgagaaattctcatgactaaaatcaaataggagaacaaaatggctcgcgaattttcacttgctaatacacgtaatatcggtatcatggcccacgtcgatgctggtaaaacaacaacaactgaacgtgttctttactacactggtaaaatccataaaatcggtgaaactcacgaaggtgcatcacaaatggactggatggagcaagaacaagaacgtggtatcactatcacatctgcagcaacaactgcagaatggaaaggtaatcgcgtaaacatcatcgacacaccaggtcacgtggacttcacaatcgaagtacaacgttcactccgtgttcttgatggtgctgttaccgttcttgatgctcaatcaggtgttgaaccacaaacagaaactgtatggcgtcaagcgactgaatacggtgttccacgtatcgtttttgctaacaaaatggacaaaatcggtgctgatttctactactcactttctactttgggagatcgtttgggtgctaatgctcatccaatccaaattccaatcggtgcagaagatgacttcatcggtatcattgacttggtaactatgaaatctgaaatctatactaatgaccttggtacagatattaaagaaactgttgtaggttcagacgaatttaacgctgaattggcatctttggatttcaatgcagaagaatacacagaacttgcaaacgaatggcgtgaaaaactcatcgaagcaattgctgatttcgatgaagatatcatggaaaaatattttgctggtgaagaaattcctgaagcagaactcaaagcagctatccgtaaagcaacaatcaatgttgacttctacccaatgcttgctggttctgccttcaagaacaaaggtgttcaaatgatgcttgatgcagttattgactaccttccaagcccacttgatatccctgccatcaaaggtgttaaccctgatacagacgaagaagacgaacgcccagcttcagatgaagaaccatttgcagctcttgctttcaaaatcatgactgacccattcgttggacgtctttcattcttccgcgtttactcaggtacacttgatgctggttcatacgttttgaatacttcaaaaggtaaacgtgaacgtatcggacgtatccttcaaatgcacgctaacactcgtaaagaaatccaaacagtttacgctggggatatcgctgctgctgttggtttgaaaaatacaacaactggtgactcattgacagatgaaaaagctaaaatcatccttgaatcaattgaagttccagaaccagttatccaattgatggttgaacctaaaactaaagctgaccaagataagatgggtgttgccctccaaaaattggctgaagaagatccaactttccgtgttgaaacaaacccagaaactggtgaaacagttatctctggtatgggtgaacttcacttggacgttcttgttgaccgtatgaaacgtgaattcaaagttgaagcaaacgttggtgcgcctcaagttgcttaccgtgaaacattccgcgctggaacttcagcacgtggattcttcaaacgtcaatcaggtggtaaaggtcaatacggtgacgtatggattgaattcacacctaatgaagaaggtgctggatttgaatttgaaaatgctatcgtcggtggtgtcgttcctcgtgaattcgtaccagccgttgaaaaaggtttggtagaaactatggctaacggtgtccttgctggatacccaatggttgacattaaagctaaactttatgatggttcataccatgatgtcgattcatcagaaactgccttcaaggttgccgcttctcttgcaatgaaagaagctgctaaaactgcgaaaccagcaattcttgaaccaatgatgaaagttacaatcactgttcctgaagaaaaccttggagatatcatgggtcacgtgactgctcgtcgtggtcaagttaactcaatggaagctcacggtaaatcacaaatcgttaatgctttcgttccacttgctgaaatgttcggttacgcaactactctccgttcatctacacaaggacgtggtactttcatgatggtatttgaccactattcagacgtacctaaatcagtacaagaagaaattattgcaaaaaacggccgtaacgctgactaagctttaatttttaaaatatgaaataacctgtcagtaatggtaggttatttttttactaacaagattttctttggtttagtttcactttatcttggcttaatgaactattaagtcaaggaagttataatgtatttattccaaaaaaattttttcataactttactcctaaaagtgagaaagcggtatctaagtgatactgctttttttatttctatcattgaattattacttaaaacacaggattgttaaaattttgacaatctattaatgatagtgtagactctaaattagatactttggaaagtctttagtaccaacttataacagctttgctgtcattttatggagaaaattttatggatatgaatcaagtttcacaagttattttaaccaatctagtattaatcatcgcgttggcaattattgttagtgtgatttgggctcttattaaatattctatcgttgacattgtttgtgagtacgatttagagcatccaattattacattttttatcatttggatcattccattcggtttttggattgagatgtttagaaatacttgggtggataatacaaaacgattagttgtttcaaatgcttacaaaggaaatgaataatgaaagaacacaaaaaaggaataaaattaccgctttatgctgctattttgggacttgttgtgttggcgcttattattattgttgtggtttttcataatttatcctctgatagaagtccaaaaatgacagggagttcctcaaaaaagcttgtgtctattgatgatcaaattggaaaatgggcagaaacttatactgctggaaatacaacatggagtacaaatattgtcatcaaaaaagatggaacatatgttcggcatgataccgcaggtgaagataatcttttggtgaatcaaggattggaactggcagaaacatcgggaaaaattacaaaaggtaaagttgaagtaagtagcaaaccttttgctaatgtaaagtatgtttatgaaattccaaataacggagtttttaatgaaagttccgccactgataaaagtacagctgtgaaacctgtagtttattttaaacttacgaacgcatcagtatcaacgaatcaaggtgatggaagagtgaaagtcgaagaaaatcatgatgtgacatatctttttgggatagaggggacctatgaatactcatatagtattgctcggggaagcacaaatgaacgagctttagtgagtaattcgggggagatggtctttaaccggtataagctttcgcaaaattttgatatgcctgtaaaagagttagtcatgcctgattgtagggatttaacggagagtgaaacgacggataaaattcaaaatgtattaccttatcacagaaactttttattctatgaccaagagggaaagcaatcgaatgcagaaactgcaggagatttaccgctggattacgtttataatttaaccacacaaaagcgagtgaatgcgggagaaagttttttgagtacagatgtcttggctatttatacagctaaaaaaccacttgtgaaaatgaatctgtcagaaattgcgcaaggaaattatgaaagtattcaaggaacttggttaaatgagtctggaaatacaattatcgtcagtggaaatacgatgtctatttcggatttcactgctacaaaaaatgctatgtcagcaaaagttgacggtctcagtattgatattcctagtttgaatgattcggcaactggtgcgcccaaaaagacatcaggtcaaagcacagatgataaagcaaaagattttaatccatttgctgggcaagcagagtatgataaaaatttgaaggtgagtgaatcggttcaaacagcaggagtgttggagtttgggactactttagtcagttcgggaatttactttgggtttgctccagaaaatgtgagtgtaatttctggaggggcagatgtcacagatgatactaaagctaggatttttgtcaatggtggacaaaacggagtggtctttagtaagccttattatttacaaggggagtaaaaatgagagaagataaaaaaggcataaatgtaccactgtatgcctctatattaggatttattgcgttagcctttattattgttttagtgattgttcatagtttgtcagctgttggaagaacaaatgcttcgaaagtaacaaaaaagtctacgcagcattcaatttcgtctaccagacgatcgagtcaaaaagcgaatccttcttcagtagcaccaacagctgatttttcaaaatgggctaaaagttataatttttattatttaaaatcgggcgatgcccaatcaagtttgactattagtcaggatggaaaagtgatacagtcacaaaattcttctgacaagcgtgtttttacaggaaaagcaagtatttcttcggataataaagaggtactgagttatgtgattaatggtcagtctacgtttaaaatgccaaagcagaaaacgataaaagctgatgttaaaattcaggtgacatgggatagtgatggaagcatccaggattattatggttatcaaacctacacaggtcaatatgcactgacagacggaattgcgcgtgcttctggggtggatgaagtatgggtaagcgacgtggacagtggaatgaatttatcagagattatcttaggaaattacgaaagtatccaagggacttgggagaatactaagggagacatactactggtggctgacaatggaagatgctcggtttctgcatggaaatggtcaggaaatttaaggattggtggcacagtaccagagggaatttacgaccatattgcttgggcttctggtagtccagctcctatgccagatggaattgcatttatgttcgctcctgcaggtgtatcgccaactaatgttggtggtccagatttaactgatagttcaaaggataggattgttgtctgtaataatggaggacaaactgtttttggtgagccaggtagtgcctattacaaagtaaaataagtattaatcagtaacttttagtttcattttatcttgacttaatgaaagattaagtgtgagtgactataatgaacttattccaaaaaagtttttttcataaatttactcctaaaactgaacaagtggtatctaaatgatactgcttgtttatttattgaagtcaaaaaaatactaatagaggctcatttatgaatctggaagctgtcagtaaattgtttcatgtgaaacttgaatgttcggaaataccatgctataataagcttatcaaataggagatgagataataaatgaaaagaaacgaacgtttagttgattttacaaattttttaattaatcatcccaatcaaatgctaaatttaaatgaactgagtaaacattatgaggtagccaaatcctctatttcagaagatttagtatttatcaaacgtgtttttgaaaaccaaggagtaggtctggttgaaacatttccaggtagccttggaggagttcggtttacaccttacattactgacgaacgttcgttggaaatgagtcaggaaattgctgaacttttacgtgaagaaaatcgaattttacccggaggatatatttatctgtcagatattttaggtactccatcaaatcttcgtaaaatcggtcaaattattgctcatgagtatcatgaaaagcaagttgatgttgttatgaccattgcaacaaaaggaattccaattgctcagtcagttgctgagattttagatgttcccttcgtaattgttcgtcgtgaccctaaagtgaccgaaggagcaacgctcaatgtaaattatatgtcgggttcaagttctcgtgttgaaaatatgaccttatccaaacggagcctttcaatcggtcaaaatgttttgatcgttgacgacttcatgaaaggtgcaggaacaatcaatggaatgagaagtcttgttcatgaatttgattgtttacttgccggtgttgccgtttttcttgaaggaccatttaaaggtgaacgattgattgatgattataaatcaatcttgaaagttgaccgaattgatattgccaatcgttcaattgatgttcaattgggaaatatatttaatgacaaataaaaaagttactgacagacattctgtcagtaacttttttgcttatttacttaaaagaaagaaattttattgagtggccaaactcgtaatttggcttcaccaataatcgctgaacgtttgaaacttccaactgctcggctatcttgagagacaacacgattatctcccattaagaagtattgtccgtcagggactttgactgtaaaggttggattaccagtactatcagttgtaaaagctttggtgctctgagctaagcttacaaataaactacgattttgatcagttaatgcttttgtcaaaggatagttcccgtaagttttttccaattgaccatcagccaattgtttttgatagtctttgagatagttttctggataaaccttattattgatagtaagttggtcatggtcgaattttatagtgtccccaggcatcccaacgacacgtttgacaatatctttggttgaaccatcagccgcgttttctttagcaactacaatatcaaaacgattaatttttgtcgttctaacaattacaagtctttctttatcggctaaagtagggtccattgaatggccatcaacgacaactagtgaccaaataaagacgcgcgagagaaggacagcggcgattataaagataaataatccccattcttttaaaaatttcatcatattattactttctataattgagcgattttcatcgctttttgtgtattggcaaaatgtaatttagctaagtgattcagagcatcaatcccttgactcttaatgatttgagcagctactttgtcagacaaattttctgcgccactgggtaaagtaaagctagattcttttgataactttttgagattttccaaaaacttataacgagaaataattgaactaactgcaacagctaaaaattgatcttcagcttttgtcagtaaagttacgtttgtcagtgggtgatttttttctgcgctaacatattttttataatttgcttcggttgtgaaagcatcgataacaatactttcaggctggctaccgagttgcttttcaaggagataaattgcttgattatgtaaggcaaccttgatgctgacagcattatagcccgaagcaatcacctcgttatacttctcaggctcaacaaccaaggcaacatgaggaatctcctctatcaatttgggggcaatctgacaaattttttcgtcagttaattttttagaatcagcgacacccatttcttttaaaaatttcaaatgattatcactgacaaaacttgcagtaaccattaagccaccaaaatatgaaccatttcctacctcgtcagtcccaataagattagtttgctttttaggaacaacttgagcaacatgtccaaattcactagcaattttttcagcatcacttccttgaaagactacttttccagatgtataaacagaaatagaagttttcccaactttagcaaaaaagcgaatataaggatttttagaagtctgctcgtaagatttatatttttcagagagttgctgacaggcattagagcttaattttaggacaatattcataagattattctaccataaataagaggttcgcgaataagaatccaactatttgtttaaaatatttcttattaaaacctattataccaaacctctaataaaataaataaaaaaatctccatattttaaaatatagagaaatttaaaagttaatctgttttttcacttaagcttccatcttgcattaagtaaactttatcgcaaaaatccaccaaacgtaaatcatgagtgaccatgattgttgctttatttttttctttcgcttcttttgccaatattttaacgacttcgtaagctttttcagtatctaaacttgcagtcggctcatctgccaagataatggaggggtcattgtaaagcgcgcgcacaattgcaactctttgacgctctccaccagaaagctcatcaggatatttatcaattaatttgtctaaacctaggcgactaagcaagtctagaccagatttattattttttcctttagtgactttatcgaccagttcgagctgttttttgacagtaagaaatggaacaagattagaggcttgcaaaataaaaccaatttcctcaaaacgaactttagcgcgtgctttttctttcttttcgcttaaagtctgaccgttaatccaaatttctccagaagaaggactttgcaatccaccggcaatagtaagaagagtgctcttgccagagccggaaggaccgatgattgcaacaaattctcccttatctactgaaaaattggtttctttcaatgcttcaattgtttcgtcgccatctttaaaattctttttgacattttttaactcaattgctttcattctatttcctcctacctacccgattgcttttaagggatcaatcttgacaattgtccttacagagaacaaagcgccaataattgcgactaaaaccattaagagggcgatgacgccaaagaaaagaaggtttgtttgaaaagggaccccctcaggtaaaatcaaagcagaagcaatcgttgctaataaacctatagtcactccactaacagctaaaataaaagtctgggcaatgactgaattggcaataaaacggctagaaattccttgagctttcattactccgaaaattgctatcttttgcatggtcaaaacataaataaagattccaatgactactgcagcaatcacgactaaaaagccaatcatgaaaccaaaagtcaaaacttgagcactataacctgggagcttatctataaatttactgatggataatttttgaagacctttaggttgctgactcactttcccacgcgtaacaatagcgttataagtagttttaggttgaaaactagaattggcaccgtaacggacagtttggaaagtctccatagaagtataaagcacaggagaaatattaaacttagcgttatctgtaaaacctacaatcagcaaaggttcattgttgcttgccagctttactttatctcctattttataatgatattgttttttcaagctaatatcagcgaccacctcgccactgcttttaaaggattttccttcgataacttttggatttaaaaactcctttgaatttataccaaaaaagctaacgttttgcttcttattttcgtcagtagcatcataaatgataccagcagtttgggcgaggaccgctttttctttagcggtaagttcattggcaagttcagattcaatcattgacatgttgagagaatcatttgctttctcagataaaaaaatatcggaggcattccatttatcaacagccattcgattttcttgagcaagcccgtaggccaagcccgataggaaaaaaacaagataggcaattaaaaacataaccccaatcacaagggcatacctcaattttgaatgtctgatttcattaatcgctaaaaacatactatccacctcttttctaaaataaatatacactttttctaaatcaactgaataaaaaattaaaaaagctctatttaatattgtattttataaatctatctattaaaaaaagtttatcacacttcaaataaaactactattagattgcttaagccttctagtatcaatggaataaatattcaacagcgaaattttaataacaaaaaaattaagagctctaaaagcaattaagatataaagcgttagaagcaaaaaagccttgacaaagcgaggcggaatatgatatgatgataaacggtattgtttaccccatttttgtggccccggaaacccaaaaatactttgcaggactcttacacctgctgtaaacaaattctagtaaaaggaaaataaccaaaatgatgaaaactacattcatggctaacgcgcaaaacgttgaccgtaaatggtacgtcgtcgatgcaactgatgttcctcttggacgtctttctgcagttgtcgcaagcgtactccgcggaaaaaacaaaccaacatacacaccacatactgatacaggagatttcgtaatcgttgttaacgctgaaaaaatcaaattgactggtaaaaaagcaactgataaagtatattactcacactcacttcacccaggtggattgaaatcagttactgctggtgaactccgtgaaaagaatgctgtacgtttgattgaaaaatcagtaaaaggtatgcttccacacaacacacttggacgtgctcaaggcatgaaacttaaagtgtttgttggcgcagaacacacacatacagctcaaaaacctgaagtccttgacatcacaggtttgatctaatcaggaaggaacgaacataatggcacaagtacaatatgccggcacaggccgtcgtaaaaatgcagtagcacgcgtacgtctcgtacctggtactggtaaaatcacagttaacggacgcgaagtagaaagctacatcccacacgcagacatgcgtcttgttatcaaccaaccatttgcagctacacaaacagaaggtagctacgacactctcgtaaacgtaaatggtggtggtgtatctggtcaagcaggagctatccgtcacggtatcgctcgtgcattgctccaagtagacccagacttccgtagtgctttgaaacgcgctggacttcttacacgtgacgcccgtatggttgaacgtaaaaaaccaggtctcaaaaaagcccgcaaagcatcacaattctcaaaacgttaatattattcatatatcaatgtttaaaacactctcaaattgggagtgttttttattatttaatttaaactataatgtagagaaattactatatttcctatttcattaaaaaattataatatagtttccttatatttttctttgactggacaaaatcatttgcttcataaaagagacaaataatactctaattataacatttcctgatattttttggtatcgcttgcctatttttattaattcaaaaaagcatcatattaatgatgtttttttctacaatttattttaaagttttcaatatttctaaaaagtttttttcactttcagaaagaatagctattttttgataagcataattgatatggaagtattgtttgtccgcttcaataagtggaattttgaccagatgtttgaaatcttctgatagtccaatatctgccataagactaattcctaaattttttctcaccagttcttttatcgtatgagcatcatcaagtttcaagacagcattcgccgaatggttatatttctcgtttaataaattaaaagcagtaaaatgaatattatgttcgcccaacaagataaaatcttcattaagtaaatctttaaaggcaagttctttcttgctcgctaatggatggtggtcagacatgataatgaaaaattctttttgaaaaagttcttcaatttctagttctggatgtttaattttctctaaacttcctagtaagcttgaatctatttcaccatttaaaagctgactcagtaattcgtttgaaccgccataaatcatatgtaaggcatttaaaaagtttaaactttcttcttcttttaatatctttgataatagataggaacttattattggaggaaaaccaactttaaagtccttcatactagaacgatggattgcttttttagtatgatttagttctgagagaatttcatttgtcctcatcgccaaaaggtcaccttctggcgtcaagtcaaccacctgatgtgaggaatctttataaaacaagtcacaatcgtaataactttccagccttttaatggcataagaaatggtgggttgacttactctaaaatatttggcgacattagtgaaagatcgtaatttggacaattggtaaaaatactcaagatctcttaaatttaaattcatagttatgctcctaaaaaatattttaacataaatttatcattattcttggcttcataagtaatatttatcaactcttttggatttgaatataagaaaagccatcttaaaggatagtcacctaagtgatgattcttatcaacaaactctttggtataatcgcttttggtggtgaaacagcgaatcttgcgtttttcttcatttctaacctagtggaaataactgctttgctacaaatgtcttaccgaattttgagcatttattttcatcctcggtagagtcctcattcgcttctttgcttaatagataaatctaataagtacaataaaaaaacccgttactctaattgtaacgggttttttctaagctgttttttcaaatttacgatgttttaatgtataaactatatctgaggctttagccacctcattttcgtgagttacaaggatcacaattttattatctgtatgagcaatttctttaaaaagttcaacgatttgtgccgttgtttcttcatcaagattccctgttggttcatcagcaataatgatatcatggtttaaaaccaaagctctagcaatggctaccctttgttgttgtcctcctgataatttactgacaggtttataaatcaaatctggggtcaactccactttattaagggcttcttcaatggccactttctcattctcaaattttactgacgagatttttacggctgttttaacattgtcataagcactcatgtaagtcaataaattataagcttgaaaaacagtacttactgttttcttacgataatttgttaaattacttgatttgattggcttatcattgtaagacattgtcccagatttgagagtatcaagaccggcaagcaaggaaagaaaagttgtctttcccgaacctgattgaccgagaatggcatacattgttcctttttcaaaactttcggttacatctttaaataaataatcatcgggattgctataataataagttaaattctcaacttttagagtcatatttgctcctctcatcttttaaaatttactgacaaaatgtaacaactatttttttgctaaaaatgaaagctgtcagtaaataatttgactgtttcttcttttaaatatcaattcgttaacacttgttttggattcaatcttaaaattccaatacttgccaaaccaacagctatcagtgtaattagaattgcaattgcaacaagcaatagaatttcagtagccgatgtcttaatattcaatttttcaagcgcttttgcttcagaacttgattgtccgaagccgaaggctccgcctgcacgtcccacaaatccacctgcatttcctgatggtctttgaccttgagttctcgtgccattttcacctggtgcccctgcgttggttatcgtcgttgtttgagttgtttcttgtttcaaaagttgttgtccaacgacattgccgacaacatttccggctgctgaagcaattccgacagaaactatcatgaccataaagagttcaaagaaaaattgtccaataatcttaattttagattctccaaggctcatcaacacaccaatttcaaagcgacgttcacgaaccatgagcatgacgatgagtgccaagattatagcaccagcaatagccacaataagaacaatatttctagcaaagcttgccacattattcaatgatgattttacattttggtaagcttgatcgtttttagaaacttggaaattactgtcattaactaatttattagcagcttttacaaaagtatctgcttgtgcgggattttccatgctgtaagttgcattagatactttacctgttgtacctttgattgcatttgccacagaaagtgctgtatacatggtattcatgtattggatagaattttcagtcgaactacttgttgtcgtataaatcccaacaacagtcatcgtataagttttactgttgctatctttaataacgaaagttgagccaacttttaaagaattttgactggccaaagttgattcaatgacaacattatttgttccttcatctgaagctttgattgctcgtcctgaactcattttataagaacttgtaaatgttgtgtttgcggctaaatcatttgtcccactgattgtgaagtcttcttgcgaagcaccacccatgcctccttcacgaccaccaaaaccaccagctgcttgtgtccccgttgaactacttgaggaactactactcgtggaaactttttcaatgccagaacttgcggaagctgaagcttgataagtaaaacttgctgacttaacaccgtcaagtttggcaatcttttgagcagttgattcatcaatagttggcaaatcaatattaaatcgtttcccctcagtagcggtagcgcttgaactagaactgctgcttgaacttgatgtcgcactactttgcgcttctttgataacattttgcatattaacagagagtgacacggttgctccagcagattttttggcattatcaatagaaacataggcagcactattgataattaatcctgaaagaacaaaaattaaaattgctgaaaaagcaacaattaacaatattgtccgtccaattttggctttagtgaaaagacaagcacgtcttataaaatccatattttcctcatttctaagtctagattaaaaatatatattttgatttagactttattattgtaagttgattttaagcacatcagccaattgattaaaaataaagactagtgtaaatgattgactcaaggtccttaaaaactacttaattctttaaacagatgctgtcccactctcatcactattttgggtagttcctgaattattagtattacctgactgaccatttgagccacctgtcgttgctccactattagtgtccggattttctctattttgtccaaagcgattttgcatttgcttttgaaaattggtttgctgtgactgattagtttgacttctaccgatgaaaaaaccaccgactcctccaataatcaatgttaacaatgaaacaaaaataatttctcttccctttaacagcctaaaaacctttttcattttcttatcctttcttttattgataaattgattataattgttaaaacttaatttcaacccaagtcaagcttaagcttttctaaaaggtaaataatattttcttgagtattctgtcagcaaactattagattttttaaataaaaaaagccgctcacaagagcgacttttcactgaccattctgtcagtaaatttattaattaaaaagcgaagtaaatacaaagcgcgattactgacagaacagctgtaaagagccagaaaacaatgtcaattttccattctgaccaaccagcagctttcccagaaaaacctccaagttcaaaatgatgatgaataggtgtcattctaaaaatacgtttaccaccagttttcttgaagtaggccacttgtaacatcactgaaagtgtttcaatcacatagacagcaccaattaaaagtaaggtccattctgcatgaagcaagattgaaacaatagcaagaaatccacctaaggctaacgaacccacatcacccatgaaaatttttgccggtttgtgattgaaaacgaagaatccaagtagaccaccaattactgacagaataatcagtaaaacatcatactgttgatgaacaacagcaataactgcataagctgtcagtgaaatcgtgacagtaattgaagccaatccatcaattccatcagtaagattgaccgcatttgaccagcctactagccaaataataatgaaaatagagaagaaaatcccaatattaacttgccaactcaaaatatgaatgatatgtgatttttcaccatgactgtaaataaaatatgaaacaatcccaattaaaatttgagcgagcattttttgtttagctgtcaaaccttcattaatttgtttgaagactttcaagaagtcatccaagaaaccaatgacagcatacatggcaaaaacccaccaagcggtaataaaagctggactaaattttccaaaaaccaaagccgcaaccaatgaaacaactaagctgacaaccacaaagacaaatccacccatcgtgggagttccggctttactagcatgttgcttcacatcttcaagtgttggctgtccacccaattttttcttgtggaagaacataatgaaacgaggaataccaatgattgttataatcattgtaattaccgccgccactattccattcaataacattttcttctcctaatttttgaagctccacaaagaccaactttgtggagccccaaattgataaatttaaattctacttaattacccatttttacagtgagcatttgaccttttttgacattagttgaagtttcaatactttgggtcaagactttatttcctgaaccttcgtaagtcactttaattccaaaccaatttgctaactgttcaacttcttttttagaccaatcatacatatcaggcatcacctgatctttatcgttcgtaaaaagtaaaattcgtgtattcgccgcaaccttttcaccctcagcaattgattgagctgttactttagcacctgttccaatgataactggactgatgaccgtacgacgcaagttatccgccgtatcacctgaatcgttacctttgtaattctcaatcgtcacttttcctgctttaatatcagaatcagtactagaagtagccgttaaatcacccttcattgcttctgcacttgttaacaaaggatttgctacccgagcaatatatttaagcgtccagggttctgaaggaattttgacattcatataaaagataaaatcaggattcttagcaggatacatcactacagctgaataaagataatcctgagaaccagtcatatatccaccagtagttgctgcgatttgggcagtccctgttttcactgcagctggttctccatttaccataaacaatggtcccgccgcaagatcttgctcaggatctcctgctgttgaataagaagttccgtaaactgggtcagtatttacagtgagcatcaagtctcgtaccccacttgcagcttcattggaaacagggtgtccaactacttctgctttagaagttaagcttgttttggtgttcgtatcgactactttgctgacaatatgcggttcaagcattgttccgtttccagcaatggcagtccagcctcttatcaattgaagcggcgtgactgcaaccccttgaccaaatgaagattgaatttgtgaaactgcatttgatgaaggaagcgcccctggattttcaccatctaaaccagcccgtacttttagaccgaatttaaatttattaaggtaacttccccataaagcatcacccatattcatttcaatcttactcatcccaatatttgaagataaaacaaaaccttgagcataagttacggtttctggcaaagtataacttttattttccgtgacgtcccagtcattaatcgttgtatcataaacttgaagtttccgttgataagtttcgttaagattaactttaccactatctaatgcgccggccattaagaaagtcttaaatgttgaacccggttcaaaagctgattgtgaaagcaaactattccatgtgaaatatttttgtttttctgcactattgattgtggttgccgtataagttggacgttgacttgtggctaaaatctcaccggtatgggcatcaaccaaggttcctgaaagctgttgagctccagtatccgtagcggatttgtccatataaccttcaaggtttctttgaagttgagcatcaagagttgtataaacatcttgaccatttttaacagctttatctactttcgttgttcccggaatcggacgaccgtaaatatctttttggtatgtttcttgaccattttcaccactcaaaacgttatcaaaggctttttctaagcccatgtccccttttaaggtttgaaaaccattttcatctttaggacgagcaattccaataaattgagaagcaaaatttccaaatggataagaacgagacacattagacgtaaaaccaagcccaactattttttcattctctgctgccttttgaatctcttgcatctgttgcaaggaaatattacttccttctgcaccaaattgaacttgttttaacttagaattaagttgtttttcaattaagctacggtcaatcttaagtttactacttaaaaatgtagcgactttatcaaaatcctctttcttaacatagagagggtttccatttgaatcaacctgcgttttatcaatgacggcataaattgtataagtactagagtcgaccgcaatgggtgttcctgtccgatcataaatcgttccacgctttgcttgaacgggtaccgtactctgataattactcttagccatctctttaagattggtatcaccgacatggttgacggtaattaaccagacaaaacgaaatataaaaaccgtaaacagcgcaatagctaggaaaaacaggctcttacctactcgtttacgatttctttctggactccaattcgtttttctggcatttcgtgatacttttctaaaaggaaaaaaaattagttttcttaaaaattttatcatttcgttgctttcaatacattagatggatttgcttttaaacttgctttgtttgctgcatctaacactctattaccagatgttagatctaaaatgtgttggtcatattcggatttacgtgtggtttcttgagaaatttttgttctcaaatccattgtattcccttggacttcaagcgttttggtttttacataaagtagtccaacagccaacactaaagcagcaactaccatcgtcaagtagaatactttttccacaccactaaattttttaaacttacttgctagaacttctggcgctaaagtctcagtatcaataagatagctatctttttttgccgcagtttctatatcgaagtattcttttggctgtgctgccatttgttgcctccactcgtttatcttactaaaggaattcagcattctctcaacctttaaaattggagaaactgaacaatattattcacttatataagacatccaaaatcaatcctcaagtgggaaaaacccgtttattagaccaacatatttcttaattaatctctttgcttttgtgcgactcgtaattttgcactatgagctcgattattaaattccagttcttcttcactagcgagcactggctttcgattaatcaattttagttttgcttccatttctttaggaagcatcggtaatcctttaggaacattgactgtactatattctttgaatatagattttgtcagacgatcttctaaagaatgaaaagtgattaccgaaattcgtccatcaacttttaataggtcaatggcctgttcaattgattcttctgccgccccaagctcgtcatttacttctatacgaatagcttggaatatacgtttggctggatgcccttttttcttgagttctttttgaggtagtgccgatttaatcaaatctgcaagctcaattgttgtctcaattggtttaatttttctactttgttcaatcttacgagcaatctgtttagaaaatttatcttcgccatagcggaaaaaaattcgaaccaatgcttcataaggataatcatttacaacttcataggcagaaagtgtttgactttgatccattcgcatatctaatcgagcttcttttttatatgagaaaccacgctgactatcatcgaattgggggctagaaacacctaaatcataaagaattccgtcgattttcgttatgtctaattcagctaacgccgattttagattacgaaaattactttttatcaatgttactttatcttctgcaagttgctcactcaaacgtacttttgcgtttgcatgagcggtctcatcttggtcaaatgaataaagatgaccagtagttagtttactaagaagatactcactatgtcctgcgccacctagtgtcgcatcaacataaattccatttggcttgacttcaagcatgtccacggtctcatgtaataggactgtatcgtgcttaaatgctattgtttttggcaagagcgccgtcctccttgtatacttacgatttattatatcacttttttcccatttttgtagtagtttacatgattatgtaaagattttttgtaagaagtcgcttacattgagattgattaggtctatctctacctttttcaatgtcaatttaatttacaagtggtgtaaacgaagcctttttatagtttagcaatgaatactaaaaatagactgaaatgaatcagtctatttttataaataatgaattttttcacttttttttaattcgccactagccattagctcaataataatgaggctaatccaacaaatcattactaatagaaacatcagatattgaaataattgatagtgacttgtgctataagtcattttaatcatatttgcaaagatacgataaagtatagtcattcctgccgtaactcccaaaagaatagaaagacctaaatcacttaaacctacatcccttaagcgacgtacgtgtatggtcagtttaggcataaagctaccgataaggaaaaggataaatactagttttaataaaactgttccgataaaatcacggccaaacattacttggtcaaattgtccactggcataaatcagaataataaaaattaaagtaagggctccccagccaatttgaacccaccaaaaatttcttctgctagcatttcctcgaaattcaaaataatttttaaaataatctttaaacatttccgaaaaattttcaggttcttttgaagcaataaaattagaactattttttaattcaaactctttaaacttgtctcttttaggagaacttggaaataaattgagaaccaatagtacaagagttcctaagccaaaaacaagatttagaaatactaatccccaaggcaaatcagtatcatttaatcgtcgaactgttatggccaagaaggctagtaaacttcctaaaaaatatatccacaaaagccaaagtaaaaatgaagcgattgattgccataaaactgacagttggaaataacccaatccgttaaaaaaattatagccctttagtaaaaccacaaaaataatcagatgggtgaataaagccatccaaaaatccttacgacttgttctttcattgaaaacaaaagtcccttgccaaaattttttataagcttgtatcatattttacctttcttttttgtactattcataagatcttgagtcatcttcttcctcaactccatattttgttgggaaaagacagaggatatagacaatgaaagtgattaagttaaaaatgaatcctaactgttgaagcatttcttgatgaataaacattgtaagtaaaccataaatggctgctaaaccaaagataagagaaatccaccaaggaagacgtgcatctcgcaaacgacgggctgtcagactaacgcttggaataagaatagccaaaccagcaatagctgtaatgataataatcactaatgctccacctgtaggatttgtgtataaatccgtgacttgtcgaatgatttctgtttgagatgagtcacctgcttgattcatgattttggcagctcttggtatcataatcataaaattaaaaaagcttagaatagcaaagataatgaaattcgccaagaaaacccaccagtaatctgaacgacttgaatatgttttgaaatcgcctgcttttttccaatatttaatgtatgctttaatcattattttctcctcaatttatatttaatttactgacagacaatttagtcagtttttccaaatttttcttgatacaaattctatttttataaaatacttatttaaacattttttcaatgttcttatctggaatgaaccacattgaaaaaatcaacgccgaagcaatgagcataatcaccggtgcaataaaatatccaagaataatgctaatgacattaagtccaacactgatgatattttttcttacagttgattcagaagttttacggtgaccattaatttttaataattcccttgttaatagaaggtagatgaagtttccacagaaaaagataatgacataacctagttctggaataaatgaattgggatatattgatacccagtttgaaaaaataggaattagtgataatacgaaaagaaaactgatattaatccataaaacttttccattgattttttttatactttgaaataattgatgatgattgacccagtaaattgctaaaataaaaaaacttacaagataaactccaagatgcggaagtaaatcaataaaactttgtaaactatccgaatcaggacgtactaactccaagaccaaaacagtcatgatgatagcaataatggcatctgtaaatgcctctaaacgcgttttactcatttctgactcctaaattataaaataaagatactcaaattgtctatgaaattgtaataaagctcctctcctccttttcgatattgttgatatcttattataacatattgattttgattcataaaaaaactttaacaggaattcttactggtaaaaaatctgattttactccaaaataactactttttaaaggaaaaattttcattatcatcattttcataaaaaaaaacgccattaacttatataggagaaggcgttttaactatggcatttgacttggaagttggcgcatagaatagagttattataggccaattagccaaatttgtcagtaacatttgttaacgaaatactttttgttatcatttttttattctttgatttcttaatatttggataatgacctcgcataatatgcaaagaagtcccgcagagacccctacaaaaccaacaaaaagtgaaaaataagttttatagtattcaccatgaatgagaaaagccaaacaaatcaatattatataaatccacgctttatttactttcacatttcctccgataaccttttattaataatgtaaccataatttaattttatcattttttgttttggtatatacacatttgtggttacaatatttctttttttatgcatatcattaaaattgtaaaaataaaaaaaccttgaccaaggccaagattatctttaattagttaacaaacgttttgcttgagcaagtgcttcttcagttaaatcttcaccagcaagcatttttgcaatctcttttactcgttcgtcaaaattcaattttcgcacagtcgaggttgtaatatcatcagtcgaagctttttcaatataaaattgtctgtcagcaattgccactacttgggggagatgagaaatcgcaagaacttgtccatgactggcaattttatgtattttattggcaattgcttgagccacacgcccagaaactcctgtatcaacttcatcaaaaacaatggctgttttattttcacgtcttgaaaagcttgattttattgcaagcattaaacgtgaaagttcaccaccagaagcggtttttgccaatggtttgaaaccctcacctggattagtttgaatgaaaaattcgacatgctcattaccatttgctgaaaatttcgcactatcaaaactgactttaaaatcagccttttccatataaagttctgaaagttcatgcttgatatctttttcaatttctttggcgatttgatgacgggctttattgagttcttggctcgcttcaaggagttcaacttgggcatttttaactgatttttccagactgacggaatcattttctgagcctgtgagttctgaaagttcaagttgaactttttccaaataattgatgacatcagaaagtgtagggccatatttttttctcaaagttgtcagtgtcataatacgctcttcaatctgcaagagttccgctgggttgaattccaaatcactcatgatgctttgaatttgattggcaacttcttctaatatataataactttcagcagttttgtcagcaagttcttgataatccttatcaaaattgccaattctatccaattcggtcattgtcgtccgaatattattcaggcttgaatagtcgttgtcttcatcttctagtgctaaatatgccgtacttagagaatccgcaatattttttatattatttaatttttcacggcgattaactaaaagctcatcttcttcaagattaatttctgctgcttcaatttcttcagcctgaaattggagaatttcaattctttgggcaaattcttgttcatttttttgacgaagattcaattgttgccgaagatttttaaagttttcaaatttatttttgtaattatttttaatgacttcaaaattttcatctccaaactcatccaataaacgaagatgacttttgggattcatcagttcttgactgtcatgttgaccatgaatgtctactaaaaattctccaatttgacgaagtcttgttaaattgaccatttgtccattaattcgacagacagagcgaccattcgcaaaaatttcacgtcgcaaaataatttcagaatctaattcttcaaagcccaattctaataaagcagaatttaattctggtgttttttcaaagaaaaagagcccctcaatttcggctttactagcgccatgacgcacgaaatcacttgatgcacgtccacctaataataaggacatggcatcaataataattgattttccagcccctgtttccccagttaaaatagtcattccactttcaaatgaaagatgaatttcttcaataattgcaaaatttttgattgaaatctcttgtaacatcaaatttcctttctcaaaaataattaacaaggctgtcagtactccaacagccttgacttgtccttttgggcatctctatcattatattttttactgacagctatgaacaattggcccacaatgaataagctgcctcaactcttttttctgacgacttatcaaatatttaatcagtaaatttaaaactctgtcagtaaattataaagtgttttagcttcttcttcgatttcaaaaataaccaaggcactatcgtcatcaatgataattgaaaaaatatcgtctccatattcttccagaagataatttttcacaagactggttgttccaggatttgcaaggatccaaagcatgttatctttcatctttacacctgtaattgcatcaaaagctaaagatttgtgaagacttgattgtaaaacttccttatttttaggtaagtcatatcggtaaccacccgactcagccggaactttaattaaagccagtgattttatatcacgcgaaacggttgcttgagtgacatcaattccatgagttaaaagggtattcacaagttcttcttgagttttaatttcattttctcggataaattgagcaataaagtttaatcgttcttctcttttcatagttcttcgctttcttcttgtaaaactgattcaatattaatctgctgagatatttcggctttttcatctttaagtaaatggacaagaaattcgacgtttccagctcctcccttgattggtgaaaaggtcaagccttttattgagaatccaaggcgagtcgctgctgctaaaactttttcaatggtcattttgtgaacttttgggtcgcggataattccgttttttccgacttgctcacgtccggcttcaaattgcggcttaataagtgcagctacttctccaccttcttctaaaatttcataaaggggtgggagaattaactccagtgagataaaactgacatcaatgcttgtaaaggccggtcttccttgctcaaaatcgcttagaagggcattacgaaaattaaattgttccatcacaacgactcgttcatcagagcgaattttccaagccaactgattggttccaacatctaaagcatacactaattttgctccattttggagcatcacatcagtaaatcctcccgttgatgatccaatatcaagacacgtttttccttcaatttttatattaaattctttgagcgctttttctaattttaaccctcctcgactaacatatcgtaatttttcacctttaagtcggagttccgttccatcatcaattttttgaccaggtttatcataacgttccccagacttactatcaacaactaaacccgccattactcctcttttagcttgttcccgtgtttcaaaaagtccttgatttgtggcaagtacgtcaattctttctttcatttgtatctttctttattatacgtattttttctaaaaatgtaaccaataatcatctatttttatataaaaattggttcagtcccttagatttaatctcatcacatctattttttgctttttacttccaaattctagttctgtttctttaaattttatgtatcctaatgatttccaaaatttcaaagcagcaatattgacttctaatacacctattctcaaactattagcacctaaatgacgagctttttcgaccaaaatttcatgaaccgctttacctaagccttgatgccgaacttctggaacaaactcaagcaaccctagcataaattcaccttttgttggaaaatctttcaataaatccacaagaccaatcaaaatactcttatcgttaaaaatgccatagacaaacttgtcggatttagttttttcaggcggtaattcattcaaaaagctctcacattcaagctgaggatttgactctccgctctcaagaatagcataatcactggcttcttcaaaaaaatgctcaatgatgtttttatcattctctgtgagaattctaagttcaaaatacatttattccacttccagttgttcaattattttgaaaatctcggagctgtcagtaacattcaactctgtcagtaatttttttacttctgacaacttatctgtcagtgatgttttagctccttcaagtcctaaatgcgcaacataagtcgacttttcttctaaaacatcctttccaggcgtcttacccagttcagcaaaagtggccgtcacatctaaaatgtcatcacgaatttgaaaagctaatcctaaaatttgtccgactacacgaagtttttcgatttcttgatttgttttttgggctacgattccagcagccacaaaaggaaaagttaaaagtcgacccgtttttaatcgatgaatttgctcaatctgagtcaaagttaaatctttaccttcaccagccatatccaaaatttgaccagcaaccattccatacgagcccgaggcataagccaattcgcgggtcaatgatacaattgtttgcgccgacaaatcgctacttgaaagaacataaaaagggtcgaaaaataaagtatctccagccagaattgctgtcgcttcatcaaattttttatggttcgttaactttccacgacgataatcatcattgtccatcgcaggcaagtcatcatgaattaacgagcccgtatgaatcatttcaagcgctgcggccacttgataatgggccgttgtaacttccaaatcaaaagcttccaaaagattcaaaaaaaggagaggacgaattcgtttaccgcccgccattaaggaatattttgctggctcagctaatccttttggaaattcagcgctttcataaaattcagttaaaaaatgttctagctttaatatcttcgtatccattaccctaattataccaaaaattttgtgttctttgctgataagactcattggctcttgaaagactttgctttcaaactttagagctttatatgataactggcatcaatcaaatgttaaataaaagaagactttttgattctatttgaataaaataaaaaaacaactcaaaatgagctgtttacacttttttaacttattaaggattccactctttctaaaaattatcaatactcggttatcgacaaaattcttgcaatattttcactggttctttcaatattttttgtcccacttttcaaagcttctggtaaagtctgagctgttccctgaatcccaaaaatagccgtcatcccttcttcatataaaacctcaatcccctcaccaatgtgacccgccaaagcaaagcaaggttttttatattttttcgccagtttagaaacaccgaatggagccttgccaaacttagtttgatagtccattccaccttctcccgtaaaaatataatcggcttcttttattttatcttctaaatgaatattgttggccaccaattcaattcctaacttcatctcggcatcagtaaaagcaagcaatcccgctcctaaaccaccagctgcacctgctcccgctttattttttatatctttccctaaatctctatatataatatttgcataatggttcatgttttcgtccaattcttcaaccattttagctaaagctcccttttgtggcccaaaaacataagaggcgccattttttcccactaaaggattcgtaacatcactggcaataaaaatctcgacttcctgtaaacgtttatcaaagttgctcatgtcaatctggttgagcttttttagaaatccgcccccactaggaatttcttgtcctttctcgtccagaaattttgcccccagagctctggccattccagagccaccgtcattagttgcacttcccccaattccaataataatcttgtgcataccttcatcaatggctgctttaataagttgccctgttccgtaagtagaagttatcaatggatttctatctttcaaggccaataattctaaaccactcgccttggccatttcaattactgccgtatctgaatttcctaagataccaaaatatgcttctacttcgctattttcaagaggtcctcttacatttttaaatactcggcgcccctccgttgcatcaatcaaagcttctattgttccttctcctccgtcagccattggtgctaatataatttcagcttctggaaatacctttttaattcccctttccatggcctgacaaacttcttttgcgcttagactttctttaaaagaatctggtgctaatacaaatttcttattcatttttcctcactttcttaaaaatactttgctttattctatctcttctgtttcgtcaattgaaagattttcagtatcaaaatacttatctagtaaagcacccttttgtattaattttcgagttctttcttttcttttttttgtactttcaaggtattttgatttttttaaaattgaattttcacgttcaatttttttctgaatttcttcttttttagaaattaaattttcaagttgattactcataagcaatcaaccttaaaaattgttttcagttttttcatgaactgaattaatgttttcatcagaaacagaatcattagatttttcagtttcatcagaaccattttttccttttaaaaattctgaaaattctttagttaattctttgattttatcagtagtcaattttgaataatcaagattagacaatttgatgatttcatgacctactttgttatcaatttttttcttctcgtttttaattttttcgtttagcttatttaatttttcttgttgtttttctaaactagataatgtcataagtacacctcacttgatttttattgaccgtaacaagataatatcataatcaaaattatatgtcaacagattagttgctaaaaaccaaaaaaaatagtaaaatggaattaagatttagaagcgtcagcagaccgagcgaagcgaggacaatgcgcacttacacaccactccaaaattgggtggtgtaattgctcaaaaaaatggtatcagaagttgcctttggcaacaacaaaaaaacaaaaaaacaagggaaaggagaaactaaggtatggcaatatttcacatgaattttagtaatattagtgctggtaagggaagaagtgcagtagctagtgcaagttatagaagtggcgaaaaactttatagcgaaatggaaaataaaacttatttttataatcgtagtgtcatgcctgaaagttttatccttttacctgaaaatgcacctgaatgggctaaagatagacaaaaattatggaacgaagttgaagcagttgaccgtaaagtaaattcaagatatgcaaaagaatttaacgttgctttgcctattgaattatcagaagatgaacaaaaagaactattgaccgaatatgttcaaaaaatatttgttgataaaggtatggttgcagatgttgcaattcatagagatcatgatgaaaaccctcatgctcatgtcatgcttacaaatagaccgtttaatgatgacggaagctggggacaaaaagctaaaaaagaatatattttagatgaaaatggaaacaaaacttatacagctaatggtcatgcaagaagtagaaaaatttggcttgttgactgggataaagtaggtaaagttgaagaatggagaaaagcatgggcagaccatgttaattctgtttttcaagaaaaaaatattgatgaaagaattagtgaaaaaacactagaagcacaaggtataaatgatattgcaacgcaacacgtaggagtgactggaaatcgtgatgaacgtgctgaatttaataaacttgttttagaaaatagacaacataaagcagaactagaaaaccttgacgaaaaaatcaataatgaacttaaagttaagcaactaaaaaacttctattctttcaacgaaaagaaagttattgctgaattgagtaaagagttgcatacctttattgatttagaacaccttgaagaaaaaaataaaatgcttttcaactggaaaaatagtgttttaattaagcaaattgttggtaaagatgtttcagaagaattaaacaaagtcagtcgacaagaattttcacttgataatgcaaatcgtttgattgataaagttgtagatagaagtataaaagctatgtatccgaccgtagatagcaatgctttttctatgcctgaaaagcgtcaattaatcagagaaacagagagcgaaaataaagtatttactggtgcagagctagacgatagattatcaatgattagagcagatagtttaaataggcaaatagttgctttaactaagcgaccatttacaagtttaactatgctttcaaaacaagaaaaatatcatattgataacatcaataatgttttagcttatcaaggatataactatgaaaatattgaaatgtcacatggtaaaattttacgaaattatgaatcagaagaattttcaaaagaactcgatattattcaacgtagtcttaaacaaattaattctattgaagaagtaagaaaaattgtagaacaacaatattctgttgttcttggaacaattttccctgatagtgaattaaataaactaagtttagttgaaaaagaaaaaacatataatgcagtaatctatttcaacccaacgatcaaaaaacttactcaaagtgaattagaaaatattgttaaagaaccgccaattctattttctacaaaagaacataatcaaggactttcttatcttgctggaagaataagattagaggatataaacaataaacatctgacaagagttttgaaatttgagggaacaaaaaaactctttattggagaagctaaagcagataaaaatattgatcctgaattgctaaaagaagcaacaaacaggaatgataaacagtcctataaaaatgaattttatagagataaaaatatggaaaactaccaatcagttgcctattcagatacaagcccagcagaatatatgaatcgtttatttagtggagttttgattagtgttttatataataatgaaaaccaacataaaaaagggttagaagaagttgaatgggacatggaaagaaaacaccgtgaacataccaaaacaggtggtttaagcaggtaaaaatagcaaaaaaaaatagtaagcaaaaaaatgagcataatatgctcatttttgttatacttaatttataaatcaaagaaaggagatgcatttgaaaagttcagagtggcacagcctatcaaaagcaagtgagattctaggaaacggaacatcttatgttagcttgtggttacgtcggcatgaaaaagacatgccagagggaatggttattgcgtcaggaaagagcaagttaatatcagatcaagggatcgaatggataaaaaagaacacaaaaaaagagggcgtcctcgtaagcaataaacgtgcttttgaggataaatatctaatacttccactattagataaagccctaaataactattttaccttttttaaaaatttaagtctattgttgatatattcaagagttactttgaaagtaggtagataaatgaaaagtgaaaagtggcaagggataagcggaactttaattcatgatgaaactaaaggaattattattgataaaaatgaaaaaagtgatagcttagattatttttctgaaaaattaaaaacagacggaaaaccacttaaagaagtaagagaaaaaatgataaaggatagtattaagagagatctcaaaactaatcctttgcatttgaaagcatggtttgataaaaagtatgacagtgataattctgaaaaatctaaagaaattaattctgacaaacctactttacaatataaacaaataaaaagtgatatttcattttttggagaaagttttttagagggtttcttaggtttttatggttttgaactagataatgcagtttcaagatatgaatcaaatcttcaaatcatagaaacaaaggagctgggaatagatgatgaagctaaatattttttaggtacaagtcaaaaaggagaatttaaaaaagcaacatctgaattgccaagcaaaagtattgcggaggaagaactacaaaaattcttttcaaaagaaaagaaacaagttcaaactcaaagtatcgaacttacaaaagatactgatgaatgaaaggagaagttcatgaataaattaggaaaagggaaagtcgctaaattagcaacaagtaccctaactgctggttatcttatggtaatgacagcacaaacagcgttcgctgcggacggtacagatatacaaggtaagctgacgaccgctgcaaacactattaaaggtattttaacaggaattgtcgttttagtaggtgtctgtgtagctttgtttattattataaaacggttgcctgacgcagatgatccgagagagaaatctgaagtttttaaaagcgtcggacgggtagcggggcttgtagccctcgcagccgccattgtatggctattgccttgggtttacagtcttttaacttaatataaaaaggagtaagtcaaatgaaaaaaggtaaagaatttatttttcctgaaaatgtcgataaagattatggaatttggaaagattataccttaaaagattttggctatggaattttaactttattatgtggtttagtattcattgtactgccaccatatcccttattttttgtattaggcaagattataattgtcgtaatagccatgacagttgtcatggctattttaacaataaaacctatttcttcaagaaaaaatataaaggttagagatcatctaaggttaaaacgaaaatattctcatagtcagaaattatattatttaaaaccgcaaaaaaggggtattaaagatgaatttgaaaaataaaaaatctaaaaaatcagcattggactgggaatatataccacctaaaattaatggcggtaaagaaactattgatgatatgagtttaattgtcggaatgtacgataactatcaagtaactaaaacaggaaatttagtaggaatacttgaagtaagtggtattaatcttgatttattaaatgataacgaacaacaagatgtctttaatgattacggagctttccttatgagtacattaggagagggagtagatgatactttacaattcatagaacctaccataccagttaatatgacagcatatattaatggactaaaacgtaagtatttagatttaaaattaaaccaccctgaacaagaatttaaaataaacttgctggcaagttatttagatcatttcacaacagttcaaaattcaaaaaatatgacaataaaacagcatttattgattgtaaaagtgaaaataaaagataagtcagttgagagtttagatttagcagtaaataatcttgatgaaaaaattaatcaagtgaagcgtgatttagaaaatgcactagctgattttgacttaacagctaagattttaccaagtcaagaagtgctggaagtgctgaaaaaccttattaattttaaaggataggaggtaaggatatgaatttaagtgataaagttatggacttaattatgcctaactcaaaaaagaaaaatgaaattattgtagatgaagaacaagagcaaaagaaaagtaagcaagataattttatggaatcaatcgaccgtgacagtctacactcactttttccttttagctgggaacaatacccaacttatgttcaatcaggcgaaaatttcatgagaacaattgcaattgctgattatccgaagcgtgtttatggaaattggttatcagaattaaaaagaaaaaaaggctcaattgatattgttcagtacattgatagtgcaagtaacaattcaatgattacttactacaaaaaaacaattcaaaataaagaagctcaattgttaaatacctttgatccatataaacaaaaggtattaaaaaattacattgatagtgccaatatgcaattagacaagtatttagataattctactacctttgtttatcaacacatgcttgtatatttaagagcagattctctagctgaattagatgatttaacagaaaatgttagaaatacacttatcaaattacagatgaagcctttgataccagtaaaagcaacttttcaagggttttggtctacaatgccaattaatgagaacttattaggagattatacctacaaagaaagcaacacagaagttgccagtagtatgtttccctttgatgacgcagaaattcttgatttaaagcctagaagcgatattgagggaataaacaaagatacaaactcaataattgctattgatatgttggatagaaacactacccttaatcaaaacatggtagttattggaacatctggagttggtaaaacaacctatatgatccaaaaaatattacgttacgcaattcaagattatcaaatttatatcattgatcctgaaaatgaatatacaagaatagttgaatcattaggcggttcagttctacatttaacatcaaatgcaaaatataaaataaaccctttacaaatattttcagaagaaatattgagtgcagatgaagcagtcactaaccttgatgaattagtaaaagataaaattcaacgattaaaaggtttttttgaagttttaaaagatgatatgacacaagttgagaaagcggttatggataatatagtaaaaaacgcatatatcaatagtggaattttaaaatataaccgtctaaacgaaattaagaatgagcaatggcccactcttagcaacgtttatgacgaactaacaaaattatcagaaaaagatcctgaaaaatttaaaacaattaaagatttttactttattttaggtagttatacgcatggatcaaacactttgtttgacggagcaaccaacattaatttagatacaaaaattgtatcttttgacttaaaaccattgcaaagcgaacaagaggtacaagctggtgcatacttaaatacgtttcaatatttatgggacgaaatcacaaaagaccgcaaaaaaagaaaaaaattgtttgttgatgaatttcactttctaactttgcacaaatcagcgtctactttcttccaccaagcctataaacgttttagaaaatataacgctggggcgattgctggaacacaacaaattcaagatgttattgaggggcaaacagatagcggacaaaatattggagaagccattattggtaacagctttacaaaagttttctttggacttgacggtaaaggggtagatgatattacctcaaaattaagaatgaacttttctgaaaaagaaaagaaattgttagaacgtagacgacaaggggacgctttaataatctatggaagccaacgtgcatttatgaacgtagagcttacagaggaagaattaagactgattgatccagaagcatataaagaaaaatatgatagagaaacagcagaacaacctagttatcaaaaaagagttgttctaacaccaactgaaatagaaatgttgactactaccgaagaaaaagggggagtagataatggttaagaaaaaatatgacctgttaaatattgaaattggtacttttaagcggtctaatgataaactttcaatcaaaattgataaatcacaatttagatatgatagtttatctgaattaaatgaattaaaaaaacatcaagaaaactttattgacttagatagtattgttgagcaagaaaatcaagtcatattgacttataaactttcaaaaaatgctaaatctttgaaagaattaatcaaagaaaaaaaagcaattaggacatcaattgctaaacgtattatgaaccaagatatattgaaagatgatacttatcgtatttctttaaacccagcgaatatatggtattatcctatgaaccatgtttggtatgtttataaagccaatgaagctatgccctttgatgataattttagtccattaatgaagtacaaagccttagttctttactgtcttactggaatagcttacgaaagattattgaacgagccgaaagaagctcttataaataatcaagatccaatagttttacaagttctaaattctgaaaatatcgaagatctaaaacttgcgattaatagtattgacgattctatttcttatcaagaatggcaaaaaatagatacaaaagaaaaaaagactaaaagaaaatttattatcacagcaagctcaattgcaattgtcggtttattattggttggaatggtacataaaaatgaccaaaaaaaattgatagcattggaagataagcaaaaaatagaactcacaaaattaaaatattctagcgtggttcaaagttcactagacaataaaaactggaaagaagctagtgaagctatgaaaaaagctggatatagcaaagaaaagcaaactcaaacctttttatctttaaaagagtatcaagaagccattaatgcagatccaaaagaattaaatacagtagttaatgaaatttataaaaacaatgataaaaaggttgttttagacctagaattgcctactggaactaaagaaaaaattgatgatgaactgaaaatagagaaagctattgttagttatgatagtgaaacactagcaagtcaattatcctttgaagaaaacaaagatgttctgttaagaatgggacaagcatttttagaaaataatgatatgcaagacgcacaaaatgttcaaacaaaactttttggtttagatgaaactaaaggcgattatcttaaatctatgattgatctaaaaacagcaacagataaagttaaagacagtcagaaaaaacttgatgaagctaataagattgataataaagataaaagcaaaggcgacaaagttaaagttgctaaatctaatttagatagtgcgaaaaaagatgaaacattggcgaaagataaggtggatagtttaaagaataaaataggtgcttaatatgaagatattttcattaaaatacaaagcaaaaaaatataagctcattatatatatagctttaggctttcttttattcataataatagcagtttcctcacttactggcggtctttcagaaaatgattgtgacaataatacagtttctatcacagccaatagtgcttcacaaaaagaaaatgctaaagttatctatgattttttagtaaaaaattatggagcaacgccacaaggagcaagtggagttttaggaaacttacaacaagaaagtcaacttgatccgaagtctattgaaagaccagaagatacattatcaggacatgggcttgcacaatggactgctggaagaactacaaatttaatggactttgcaaaaagtaagaataaagagtgggacaatttaggtttacagcttgaatttttagatagtgaattaaaagggtcagaaaaatcagcaattaaagcgttaaagtctaatagtgtagaagaagcaaccagtttgtggcaaacgttgtttgaacgtgcaggaaaaccagttatgggaaatagactaaattatgctagtaaatggtttgcacagtttggtacaagcgatccaatttcagcaaatgcacaagataatgcttcaaatggagctattgaaaatgtagcactcaattgtggtagtttaaacgatacaggaagttcaagtgacttagtaaaatcagccaaaacaatgaaaggttacttctactatgttcaagcccacccaagttcagacttaggaactgattttaaaaaccctaacaaatcaggggggactgactgttcaggttttatatggcttgctatgaataaatcaggttataaagtaccagcgaacatggggtggtttactggatcaatggcaagtgacgctagaggttcacatcaatatttaaaagaaattacaccaagccaagctaaagctggcgatattgtaattgtgaatcaaggtataggagctggaaacaacggacataccgctatattacttgaaaattggcatggaaaagaaacaaaaatcattcaagagggcggagatcaaacaggtcacgttaacgagggacagtttggaacatcattttcaattttgctagacggtggagatgtagttttagcaagaccagtcgctaaataaggaggaaaacagatgaagcgatcacacataatttcattatctgtactaggtatattattagttggttcattatcagtaaacgtaattcaaaattctacaaacaatcatgtaaaaactcaattaaaacaacaagaaaatcaaaataaagatattaatcaaaaattatctacaaaatcacgagaaaataaagttttaaaaagtgaggtagacggttttaaaaagtttgataacaacaaagataaaagtcagtctgaattaaattttaacaatatcactaataagtttttaactacaatgtttacctttgagcctgatacttataataatcggaaagataatattaaagggttaatttcagatgatttatataataaatatttccctaaaaatactaattatggggacgcaaacaacgtttcatctaaacttgataaagctacaatttatacgcaagcaaaacaaggaaatgaacttaaaggacttgcagtagttacttttgaaagtaagagtggcgataacgaatggaaaaaagaaactgatttatatcaaataaagtttgataccactaataatcagattacagatgttcaaaatttaggtagtagttttaaggcaagtgatgttgaataaatggatcaaaggtattatttcagtagtagtggctactggcttaatatcctatgtagttcataactacattaattttgtagaaaaaaaacaaaatgtagtcacaatagataaaaaaataataaaactttattcttttatcgtgacgattgcaaagactgtcaaaaagtatttcatcatgtttattggaaaaatgtattcaataaaaatatagaatttgtaaatatgaatcaaaaaatgaacagaaaatacattaaagaatatgatttaaaatcagtacctagctttgtaaataaaaatgaaatttattcaggtacaaaaatttcagatatagatcatattatggagaataacaaatgaaagataacataataaaaatcattaaaagtgttgttccatatctcttatctttattagctggactttacttaatagtaatttttacaggttcatttatggggttagctcaatataaaattgcttttactgaaaaattttcagatgttttaaaagaattagctttacaccctttgtcacattatttagcctatattcacgaaaaaaacccccttgctattattttaagcattgcacttattttgtacctcatctattttgctttaagaagaaaaaaagcgaaaggttcatgggaaaccgcagatacagaaacacacggtagtgctgactggggaaattctaaagaactattttcaaaatattttggagtaggtcaaaagaaattaaaggaagattttgacaacagtatagatcaagaaattattgataaattgaataaagagagggtggaagaatgaacggtacaattttaggtgttttagataataaaattatttatcaagataatacaactaaacccaatcgcaatgtcatggttattggtggttcaggatcatacaaaacacaatcagtagttattactaatttattcaatgaaacaaaaaattcaattgtggttacagatccaaaaggtgagctttacgaaaaaaccgctggaattaaacttgcacaaggttatgaagtccatgtagtcaattttgcaaatatggctcatagtgaccgatacaacccttttgattatattgaaagagatattcaagcggaaagcgtagctacaaaaattgttcaatcagagaatgcagagggtaaaaaagatgtttggtttagtacccaaagacagcttttaaaagctctcatattatttgtaatgaaagaacgaagtcctgaacagagaaaccttgctggagttattaatgttttacaaacttttgatagtgaacctatcaataaagatgaaaatagtgacctcgataatttatttttagctttaaaaataacccacccagcaagaatagcttatgaactaggctttaaaaaagctaaaggggatatgaaagcaagtatcatttcaagcttattagcaacaattagtaagtttactgatgaagaagtatctaattttacaagcatttcagattttcatttacaagatataggtagaaaaaaaattgttctttatgtaatcataccagttatggataatacctatgaaagttttatcaatttgtttttctcacaaatgtttgatgaactatacaagctggcttcaagcaacggagcaaaactaccacacgaagttgattttattcttgatgaatttgtcaatttaggtaaatttccaaagtacgaagaatttttagcaacttgtcgtggatatggaattggagttacaacgatctgtcaaacaattactcaattacaagcactttatggaaaagaaaaagctgaaagtattttaggaaaccatgcggttaaaatatgtttaaatgcgtcaaacgaagcaacagcaaaatattttagtgagttactcggaaaatcaacggttaaagttgaaactggaagtgaaagcactagtcacagcaaagaaacaagcactagtaaaagtgatagttacagttatacaagcagacagttaatgacacctgatgaaattataagaatgcctgatacacaaagtttattaatatttaccaatcaaaaacctattaaagcaacaaaagcatttcaatttaaactttttcctgacgcagatagtaaagtcaaattagaacaaaataaatatgtcggcataactagtaaaagccaacttgaaaaatacaatgatctatctgttaaatgggaaaaaaaattacaaagtctaaaaaatataacagttacagaagaagaagaaaaagaccttcaagataatatagattcagatttagaagcaatgaataacgaaaatagcgaagtagataattctactaccgaaactgataaaatagctgaaacagaaactaaagaagcacaagccgaagaaaaaaactttgatcaagtagttctataaaaggagaatataaaatgaaaaaaaagatattaattgcagttgcggtagcactacttataattgctggtgtcgttggttttaaacttactcaaaaatctacacaagaaattttacaatctaaatcatggagttgggttgacgaagctggggacggaatgaccgttcaatttcaagaaaagaatattcaaatgggggaattaggtagcttgccttattctatcaatgaaaagaaacacacaataacattgctagataaaagtgttttaggagaaaaacaaactaaaatatattcttatgaaaaaaacaaagacggttatactttaaaaccaacaaataatgacgcaaaagaatggggaactatcacattagcaacaaagaaaggggagtaacttatgaataatttccaacctatacttttaacctcatggttaggtaaaaaagtgacagaagcaataaatgattttttacaaggtacaataaatggaattttaaattggatatttaaaataatgtccagtacggttgatttattaaacactaacttaccagaggttgccaaatattatgctatttttctagcattttcaggtgcattagttgttgcagttattttagcaagaattataacaacaatgttaaaagaagctgatgatacaacagatgtaacatgggctaatattgttatggacagtttgaaatcggcagtatcaataccaataatggtatttattcaaggttttttagtaacagcaataacactacctttgctgaaatatatttttaatgatgcaaaaggactttcagtttcaacgttaagtcatgcagtagatgtgggtcaaggtaaagaacaagggtatggaatgggaataccaatattaatttccttattctttacggtagttatggttgcattttttataaaaatgggagtatttttagctgatcttgcatttttcaatctagcaatacctattgtagcagtatcaatcggtagtgaaaattttgaatatgcctcaacatggtggaaaaaattagtttatctcaatgtatcaatcataacgcaaactctagcattagctttaatggtggctagcttaggactactggataaaggctggggttatcttgcttttacaataggttttggagttttagttattaaagcaccaacaattgttcaagacttttggcaatcaactggtttaggaaaaggaacagttaacacatctatgagaacactatcaatgatgatgagaaaaggatagaaaggttagtttgttatgaaaacagtagttttagcagagaaaccaagccaagcgtcagactatgccaacgcttttcaaaagcatacaaaaaaacagggttactttgaagtgagtgatcctgttttagcaaatgaaacttttatcacatacggttttggtcatttagtagaattagctggtcctgaacaatatgatacaaaatataaaaaatgggacttgaaaaatttacctatatttcctgaaaaatataaattcattgtacctaaagataaaaaaggtcaattctcaattgtatctgacttaataaaagacgcagatcaaattattatagcaaccgatagcgatagagagggcgaaaatattgcgtggtctatcttgaataaagcaaaaattgatttaaaaagtaaagatattaaaagactttggatcaattcacttgaaaaagaatctattttaaatggttttaaaaatttaaaagacggttgggacttttacaacttcttcaaagaagctcaaacaagacaaataagcgattggttaatcggtatgaacgcaagccctttatttactattgaattgcagagaaagggtattaatggggtttattcaataggacgagtacaaacaccgacattataccttgtatataaaagatatttagagattaaaaattttaaaccaacaccctattttgaaattaatgcagaggtacaagctggtgcagataaatttaatggaaaactagatccatatatccgtttttcagataaaaataaattaaatgattttgctaaagaaaaaaatattaaaagtggagttcaagagggaataattagtgatgttaaaaagaacctaaaaaaatcacaaagccctagactattttcgctttcagatttacaaacagaagttaataaacggtaccatgcaagtgcaagcgatactttaaaagcagtacaaaaattatatgaacaaaagattttaacttatcctagaactgattgtaactttataactgataatgaatttaattatttaaaagaaaatttatcaaaatatatttcctttttaaataaagacataaatttaaacaatacaaacccaaataagagatatgttgatagtagtaaagttcaagaacaccacgctattatcttgactaaaacagtacctagcaaagataattttaataaattatctgacttagaaaagaaaatatatcaacttgttttaaaaacaactttagcaatgtttgctgatccttttgaatatgaagaaacagttattttaactaaagtaaatttagctattttcaaaacaattggtaaaacacctaaaaatattggttggaaagaattgtttagcgaagaatcaaaagaatcaaaagatgatgaaaatcttttaccagcagtaactattggagatattgttaaagtagatttaagtgtagatcaaaaggaaactaaacccccaataccatatacagagggtactttaattaaagctatgaaaaccgctggtaaagatcttgatgatgaagaagatcaagagattttaaaagatattgagggaataggaacggaagcaacaagagcaaatatccttgaaactttaaaaaacaaacaatacttacttactgaaaaaaataaacttaccgttagtcaacaagggataaccttatgtaaagcagttgaattagaacccttacttgctagtgctgaaatgaccgccaaatgggaaaaagcattaaaacaaatcggtcaaaagcaaagaacacaagataattttttagaacaaataaaaaaatttattactaaaattataaatgacttaccaaataaaatgaatgatagctcaattttgaatagtcaaattgaagaacaaataaccacccaaaaagaaattgaaacagaaagtgaaatttcaaattgtccgatatgtaagactggaaaaattttagataaaggcaaattttatggttgctcaaattataatgctgatgaaccttgcaaattctcactacctaaaaaatggagtgaaaaaacattaagcaaaacaattgtgaaagaattaattgaaaaaggcgaaacaaaaattattaaaggttttaaaagtaaaaaaactgggaaaaagtttgacgcaaaactaaaactttcagacggtaaactatcatttaattttaataaaggagaataaatatgaaaaatgaactagatgtattagcaagcgaatttcctgttttatcagaaaaaggaagttataaatatttaaaagaagtagctggaaaaggagagtattttcaagttgcatggcagaagttagaagatgaatttgtcgctttatatggaaagcaagagatccctattatttctttaaataatgatattctttttgaggaggaagtttaagtatgccaagtaaagaagaagcagaactttggaaaaaacaattagttgaaaatgcagaaaagaaaataattgaattgactgatagtgatcaatttaaaaattatcttactacattatctaaatttcactcatacagcataaataatattaatctaatctattctcaaaaccctgacgcaacacatgttgctggctttaaacaatgggggactgattttaaccgtaaagttaataaaggcgaaaaagctattagaattgcagcaccaatcattaaaaagttgtcagaagaagaaaagataaaactcaaaacaactgatgaacgtgctattgttggttatcgttatatacctgtttttgatgtttcacaaacaagtggagatcccttaccgtcagctcgtgattttgtaaaagaaaatctttcagaagttgaaaatgttgatgttttatataaatcgttgaaaaactatataaatcaaaatacagatattaaagtgagtgaagaagtccttagtgattttgaagtaaaaggttttttccgaccgtctactaatcaaattattatgaatgaatcagttgataatataactttcaaactcaaaactttatatcatgaatttgctcatagtcaattgcacggtttaaattcagaatttatagatcgtccaactggatataaagaaacacaagcggaagcagtagcctatattgctatgcaaaacgttggaattgatactagtgaatattcactaggatatgttgcaacatgggctaaagataaaactgtaattcaagaagcacttagtgaaattcataaagtaagtaataaaacaattgatatgactaatcacttaattcaagaactaggtttagatcaaaacttagcaactaaatacaagtcattacaaaaagaagcaactaaaaataatagtcctgaattaaataaaaaaattaaagatactagagaaaaaattagtcaaaatacacaaaaagaattaaatgatttttctaaagaaaacccaactttaaaacagcctaaaattgaaaatgatgaacaagaattatcaagataacaaaaccagctcacaacgataaagttatgagctgtttctatgttatagtataaattaatttcaacttaaaacttactcataatttcactgctagttttatgttatttatttcttcagcacaatttataagaagttgaaatatatctcttatatacccgaattgctagttaatttcattggaaaataaataagtcgtgctatcctaatcttaaaccactaagcattagaaagcgcacgacttatatgacttatcatagattatattaacaacgaaaatataatgggacacatcttaagaagagtaactactaaagcaacgatgatgacaaatttagtagcaaaggattttcttaaagcaaaaatttatgtccctagcatagatgaacaaaagcgtattggtttatttttaaagcagattgatagcattatcactcttcgtcatcaagaaatagagcaattaaaagaatcaaaaaagactttgctttcgaaaatgttcccgaaagaaggggccgttcgtcccgaaattcgtttcgctggtttcactgacccttgggaactgcgtaagttaacaaatataacttccagttattcaggattaacatatagtccaactgacatacaagataaaggcacatttgttttacggtcatcgaatgtaaaaaacgatcaacttattgatgctgacaatgtctatgtcaatcctgatgtcgtcaattcaaataatgtaaaagttggtgatgttattgtagttgtacgaaatggaagtagatctctaattgggaaacacgctattgttaccaaagaaatgcctcatacggtaatcggagcatttatgtccgcttttcgaggagaaaatggggattatattaatgcattattgagtactaataattttcaaaaagaagttcataaaagtttgggagccactatcaatcaaattacaggaaaagacttttctatgatgaattttctaactcctaaacttgaagaacagaataaaatcggttcatttttcaagcagctggataacactatcgctcttcatcagaaagagctagaaaatctcaaagcactcaagaaaacactgcttaacttaatgtttgtataagcgacaaggagaaaatatgacaacagcaaatgaaattacaaataaactctgggcaatggccaacaagttgcgagggacgatggatgcgagcgaatataaaaactatatcctccctttcttgttctatcgttatttatcagaaaaccaagatcactacttagaagccaaccatctggaagatttctatgaagttacagatcgtgaagaacaagaagaatatttagaagaaatcagtaaaggtttgggttatgcgattgcgccagactatacttgggaaaaattagtcaaaaaaatcgaaacgcataaaatcaaagccagcgattttcaagatatgtttgatgcttttaacacgaatgctaaaagaaatccaaccgaagaagatgactttgccaacgttttttctgacgtcaatctgggagatacacgtctaggaacgagtactaatgaacgcgccaaagcactcaatgatattgttttaatgatcaatgattttgccttcaaagatgacaatggtcatgatgttttaggggatgtctatgagtatctgattggtcagttcgccgctaatgcggggaaaaaagggggcgagttctatacgcctcatgaagtcagtcaaattttggcaaaaattgtgacggctgacgctcatcgttcacaagagcagtttcgtgtgtatgacccagcgatgggatcaggttcactcttattaaccgttcaaaaagaactcccagggggagagcgtgaaggctctgtagaattctttggacaagaggtgaacacaacaacttataacttggcaagaatgaatctgatgatgcacgatgtcaattaccgaaacatgaatttacgtcgggcggataccttagatgccgactggccttatgatgaaaaagagggaactcaaatcccacgtaaatttgatgcagtagtggcaaatcctccttattctcaaaaatgggaaacaaaaacgatagatcgtgaaaaagatgtgcgttttaaaggttacggagtagcccctgcctcaaaagcggactacgcctttgtccttcatggcttatatcacttggataataagggaacaatggcaattgtcttgccacacggtgtgcttttccgtggagcttcagaaggaaaaatccgtaaaaacattattgataataacttgctggatgccgtcattggtttacctgccaatctcttttatggaacaagtattcctacttgtatccttgtctttaaagggatagaagctcgtcagaaacgagatgttttatttatcgatgcatcgaatgattttgtaaaaggtaaaaatcaaaataagctttcagaagataacctgcgtacaatcattgaaacttatacttctagaaaagacgtagaaaaatacgctcatgtcgcaagtttggatgagattaaagaaaatgattacaatctcaatattcctcgttatgttgatacttttgaagaagaagaggtaacgccgttacctgtgttggctaaagaattaaaagaaacacgggcagagattgagaaatctacagcagcattgtttgagatgtttggagaacttcgtggaaatagtcctgaaatcaacgaggaattagcacaatttagagatttactcaaataaagatgagtttaaaatgaggataaaacctcatttttttgtagcttttagaataattttaaaaatgagctctaaaatcctctaatctatgagaaaagctgactttttgtgcgaattttggtataatatagataatctgtttgtcaattggggcaaactcttccgaaagcaagaaaggaaagtaaaatttcattttaatgagattttacaaggcaaacatgcaagacaaaaatgttatcaatgtcaatttagttgaggagatgaagacgtcatttcgtgactatgcaatgtcagttatcgttgcacgggcacttcctgatgtacgtgatggattaaaacccgttcaccgtcgtattctctacggaatgaatgaactggggaatactccagataaacctcataaaaaatcggctcgtattgtcggtgaagttatgggtaaatatcacccacatggagacagttcaatctatgaagcaatggtacgtatggctcaatggtggtcttatcgtcatatgcttgctgacggacacggtaactttggttcaatggacggcgacggtgccgcagcaatgcgttataccgaagctcgtttaagtaaaattgcaatggaaatgttgcgtgatatcaacaaaaataccgttgatttcatggacaatttcgatggaactgaacgtgaaccactcgttttacctgctcgtttcccaaatcttttagttaatggaaccacagggattgccgttgggatggcaacaaacattccaccgcataaccttggtgaaacgattgatgcagtagatatgcttatggaaaacccagaagcttccgttactgatttgatgtctgtcattcctggtcctgacttcccaacaggggctttggttatggggaaatccggcattcgtcgtgcttatgaaactggtaaaggttcaattacattacgtgcaaaaacccacattgaagaaatggctggtggaaaagaacgcatcgttgtgactgaattaccatacatggttaacaaggcgcgcttggttgaacatattgttcgtttgaaccatgaaaaacgtattgaaggattgactgcagttcgtgatgaatcaaaccgtgaaggaattcgagtggttattgaagtgcgtcgtgatttatcagcacacgttatcctaaataatcttttcaaactgacaagtttgcaaacttcatttggtttcaacatgttggctatcgaaaaaggaattcctaaaattctttctttgaaagaaattttagttgattatattgaacatcaaatagaagttgtcgaacgtcgtacagcctttgataaagcacgtgcagaagcacgtgcacatatcttagaaggtttacgtatcgctcttgataatattgaccgtatcatcacaattatccgtgaatcacaaacggatgctattgctcaaaaaacaatgatggatgaattcctcttgtctgagaaacaatcacaagccattcttgatatgcgtttgcgtcgtttgacaggtttggaacgtgacaaaattgaagctgaatatcaagatttagttgctttgattgctgacttgacggatattttagcaaaacctgaacgagttaagaaaattattcgtgaagaattagaagaagttaaacgtaaatttgctgacaaacgtcgaacagaattgttagttggtgaggttcttactcttgaagatgaagatttgattgaggaagaagatgtattgattactttatcaaataaaggatatatcaaacgtttggctaacgatgaattccgtgctcaaaatcgcggcggacgtggtgttcaaggaatgggtatgtctgatgatgacttcgttcaacatttggtatctacatcaacacatgatcatttactcttctttacaaatcttggacgtgtctaccgaatgaaaggatatgaaattcctgaatatggtcggacagctaagggcttaccaattgtcaatctcttaaaacttgatgatggtgaaaaaattgcaacaatcatcaatgttgatcgtgaccaagcggcgaaatatctcttcttcacaacacgcaacgggattgttaaacgaacttcaacgagtcaatttagcaatattcggacaaatggtttgaaggctttgaaacttcgtgatggcgatgagttgattaatgtgcttagaacttcgggtgaagatgaggttattatcgggactcacttaggttactctgttcgtttcaaaggtgcaattgttcgcgatatgggacgtgccgcagctggggtcaaaggggttaaccttcgagaaggggactttgttgttggaacttcaagaattgatgacagtcaagaagtccttgttatctcagaaaatggtcttggtaaacgaactcaagcttcggaatatccaacaaaaggccgtggtggtaaagggatgaaagtcatgaatgtcacagaaagaactggtaaattagctggtttaactgcagtcaatggtgacgaagacttgatggtcattacagatacaggggttattatccgtacaaatgtggctaatatttctcaaactggtcgtgcagcccaaggggttaaagtaatgcgacttgatgatgaagcacaaattgtaacttttgcacttgtagatccagtaatcgaagaggaagaaactgactcgccagaagttactgacgaagctctttctactgacacaaatgaagaataaataaaatgaaagtctgccagttactgacagactttctgattaaataaatggtgctgactagtctgtcagtaaaaattgaacatgaaaaaaataataatttgggttgcagctgcaatgagtttactaagtctaagcgcttgtagcaatggaaaatcgagtcaaaaagataatcgtgatttattaaaaacaccaatcaataaagatgtgacaaccatgggaacttacatcaaagtcactgtttatgacaaggataaagaagcagcagttgataaagccttaaaacttcctgtcgaatataataaattaactactgttaatcaatcgggttcacaaattgatgatattaatcaaaatgcgggaatcaaacctgtcaaagtagacgcaagtgtctatgaattggttaaagctggttacaattattcagctaaagatttaggttatgatattaccattggttctctgacaagtctatggaatattgggatggataatgctagaaaacctgctcaatcagaaattgaccaagttttgcccttgattaattatcatgatataaaatttaatgataaaaatcagacgatttatctgactaaaaaaggtgttcgcttagacttaggctcaattgttaaaggttttgttgctatgaaaatggtggattcactcaaaaaagatggggtgaccacaggaatcgtgaatcttggctctagttcaatttatgtcattggtcattcaccgcgtggggccgacagtccttggacgattggtatcaagaatccaaatgacccgactggaacgcaaatggggattattgaagcttcaaatgaacatgtcaatacctcaggaatctatgagcgttatttagaagttgatggtcataaatatagtcacattttaaatcctaaaacaggttacccatttgaaaatgatattgcaagcattaccttattaatttctggcaaagataagacaaatggtgatggtttatcaaccatgatttatgctatggggactaaaaaaggctatgaatatgttgaaaaactaaaaaatgtagaggccgtatttgttgataaaaacaacaaagtttatatcactccgggattaaaagataaatttcaactttcagaaaagacttcttttaaaatcggaaatattacaaaattaaaataaatgtttaaattttgctatatgcaagatttttttgtaaaagaattaaaactttttactcggaacttaaatcgtgatacaataagtggaaagagtacattaaataaaaaggtggtcatatatagatggaagagcgcacaaaaaataaaaataaaaaaagaaagtacaactggcttttaaatacattcattgtcctattatttattgtgggcttagtattaatttttaataaacctattcgaaatatgatgattgccacaaagagtaatcattatcaacttcaaaatgtttcaaaagaaaaaattgaaaaaaataaaaaagctgatgtgagttttgatttcgcagcagtaaaatcagttgatttccaatccgtgctttccaatcagtttgatagccaacctttaccagtaattggggggattgcaatccccgaattgaatattaatcttcctatttttaaaggagttggaaatacttcacttttatatggggccggaaccatgaaaggtgatcaagtgatgggtgaaggaaattatactcttgcgggtcacaatatgactggtttcacttcagacttatcaatattatttactcctttagaaaaagcaaaagcgggaatgtccatttatgttactgacaaaaataatgtttatcagtataaaattgataaaattgatgtggtaacgccagaacatgttgaagttttaaatgatactccgggtaaaaaagaaatcactttggtaacttgtgctgatgccgaagccacacatcggattattgttcatggaacatttgttgatgagaaggcatatgataaagtgacagattctgtgaaaaatgcttttgagaaaaaatataatcaaatcaataatttctaatttaaaaaatttcgtgtaaatcacgaaatttttttgtctttatttttgtctttatatagaagagcaaactgaaaataataagaaataaagaaatctatgaagtactgtaaatagggcgttgtagcttataagtttcaaaaaaaaaatgagtgaaaatttaataaaaaaatgttatgataaccacatatatcaattatcgttaaataataactaagatagaaggaagttatgaaaaacaaaaaaactaaaagctctaaggctaaaaaaataaaaacagttaaagcttggcaagaaaatgccgccaagcttttgggtattttattacaattcgcctcaatttatgctctaattgtcggattagtaggttggctaatgccccctgttcaaaaatttatttcaggatttttatatctctttggccttccaactgatttcagtatttttaatgccattgttctttttattcttgccagttcaattcgccatcgtagaagattggctctttggatagaggtaatttattttcagtttgcctttgttattttaggaataattttcttggcatcttacttttcaggacttgttagcaaagagactttagaggcagctaatttttcaatcttgtccctctcatttgtcatcctaggggttcttatttctttagcaacagtaatagtaatgattctttctagaaatgcttttcctacaaaaattgttaatggaacatggtggaaagcactgattatcgcaacgggaggatttgtcagctcaatcattggtggagtggtggcttcatacttgacctatcatggttcagtcacactaggccaaataattttttatgtatttaaagaatcggtcagtgattttcgttaccttcttccatttggacaaaacatttttaattacagctcaggtaataatatttgggtgagtagcacaatctcagtcattatgttacttggtttcataagcgcttttttgatgtttactcgctctactcaaagagaactttcaggaaatgctaaacaagaattagcagttcgtcagttaattttagactatggagatgaagattctcttgcttattttgcgactcgcagagataaaaaagcgatattttcaaaaaataaaaaggcaaccattacttatcatctttttggtgatgtcttgcttgcaagcggtgatcctatcggagatgaaaaatcttggaagagtgcaggagaagccttcttaagtcttgcacgggcgcatggatggactccgggcgtcgttggttcatcggaaaaaggaagcaagatttattatcaattaggcttaaatgcaacagtttttggtgatgaggctgtggttcttgtgccagagttttctattgaaaatgcggcgatgcacgatgttgctcaagtcatgcgtcgggcagaacgagaaaattatcaagtgaagattcgacgtcaagctgacatcccttctgaggagttaattgaacttactagattgacagaagaatggagaaatggagatgagcgaggttactcaatgacttcaagtcgatttggggacccaactgaccaacaaatgatgattgtgaccgcaaatgattctgagggaaattatcaaggaattctctcatttgctccggtaggctcagacaaactttcactggataccatgcgtcgctcgccgaatgcaatgaatggtgtagtaacttttatgattacaagcctgattgaggctggaaaagaagaaggactaactgaaattagtttgaactttgctgctgcccgtcaatttttcataaatggggaaactttacaagctaatgccttggataaagctgctcgaaaagtaatgaaatttttctcacgctggtatcaactagagtctctttatcgttcaaatgatatctatctgccagaatggcgcacacgatatatctgttatgataatggtggctcgttaacctcagttctttttgcgattggacaagcagaagggttcgttccgacaaatatttcatcaaaaattaaaggatttttcttccatgattatgagaatagcattgaaaatcattggtgggaaaagtcatcttttatcaaaaatgttcatcagattgaagagaaaaaaaggttggaattgtcaaatgaaaataatcatgatgatacttatctacaaaaacttaatgatttaaaacaactcgggattgcaccatacagccttccagaagcagattttgagtcagttaaaaatctccgaatgaattatgaaaacactgacgagtttgatgaagaggaacattcgatacaaggaagacttgtcagctcgcgtggacgtggcgcaatattctttgctgatttatcagataaccaatcaaagattcaattggtcataaaacgtgacgtcatcaatgaatattctgaatcagaaaatcgtttggaaaattttgcaacctggaaaaaagatgtgactgtcggtgacagagtactagttaaaggagttctcatgcggacacagattggagaattgagtttgcgggtaaattcatggaagatgctttctaaaactctagtagagctgacagaagagagaaaagtaagtcaaactacctttattgaacagacagagaaattttctaagataagagaatcattgatattaaatggtttcatcgaagtcgcaaaacaggagtatttagctctgtcagtgggctatgataaagttttttctatacataatttgaaaattaatcttctttgggcttaccgatcagcggacgatgtcagagaatttctcagtaaagtgatagatgaggactcctcagtaaacttatcagagatttttccagatccagaaatgaataaagaaggaactccagaacttaaaagagcactctcctttgggttacctgcatttacaatggcagaaatctttataagtgaagaaacaagtaacttaggagtaaataataaaaatgagaaaaagtaattatttagtagcattagcaacctgtgcagccttactatacaatgcttggattcttgctttttggttaaatccaagtgttgtcaattcaagcctcttaagtgggctttcagcgcttaatcaaccttatcatcaactttttacattgacagatatactctcaggcagtttttgttttttacttgctttgggaatttttatgacaaataaaaaagaagacaagcgtcttcttatgattcttacttcgattgctggctttggcataacaaccgccttggcagcactttttccatacgcagatcttactcacagtgaaggaattcctaacccattgagggaacctaaattatttatccatgatggtttgagcgttctagccttgcttttcattcttttgggggtagtaatctcccttttggtttatcgtaatttctttttattaattctagtcattacttttgtaataaccactttactatctttcgttgcaggagctattccacaattggtgggaccgcttggtcagcaaatcaatgctctgcttggtgggatttggcttgtttttataagttggcgagttctgaacgacagttctcaagcaactcatgtggagaactgacccttctaatggaagataatttaagtaaaaggcttgccgaaataaaaccaattaaagtggcaaacaaatgtcccatatcccaaatgctatgttcgaagaggacaggcaataagataaataagcctaaagcaataatactaatcgtgaaaaaccactttttcattaaaaggattgctgcagcacaacctgcaaccattatataagaaacaccaacatcagttgccttggctaaggaacttggagcatgtccactattgatagcccaaagttcaataaaaattgtcgcgatacttgccaatatatgaccggataaagtaataacaataatccgaggtgaaccgtatttacgctctgcccaagcaataattgtccaaaaaatagcgacataaatgataagaccagcaccattatcagccacccaaaaggcactgtcaaaaaatacagagattggacggtcggagactcgagcaatacttgtagaagcatgattagttaaaatattaatcaaatgttggggtgtcgtcccttgtatgagagtaaaagcacaaaaaatagcggtgtaggtaaaagttgcaggagctgattgtagccattttgaaagaaaaagcgtgtaaggagataatttacgaacaatgtcgtgaattttacaagaaaaatgagcaaaaaatttcaaaacataccaaatgcagcagataattagtacagtcgataaaaatatcatttatttttttccttttccttttattatatcactaaagcttagagagtgggtcacaagcttatttgtgaaataaaggagtgccaaaagaactgcatgatgtgtttgacttatgctataattaatagtgattgtgacagctaggagaataaaatgaatccattattacagggaatgaacgaaaaacaagcacaagcggtccaaacgacagaaggacctttattaattatggctggagctggttcagggaagactcgtgtcttaactcaccggattgcttatttaattgatgaaaaaatggttaatccttggaacatactagcgattacctttacaaataaagcagcaaaagaaatgcgggagcgtgccttagcacttactcctagagcacaagatacattaattgccacttttcactcaatgtgtgtccgaattttaaggcgtgatgctgaccatattggctataatcgtaattttacaattattgacccaggtgatcaaaaatcattgatgaaacggattttgaaagaagctaatttggatcctaaaaaatgggaacctaaaggtcttttaaatacaatttcaaatgctaaaaatgacttaatagatgaaacagcttatgaagcacaaattactgctagacacccttatgaaatggttgttgcgcgtgtttataagatttaccaaaaggaattgcgcaaagcagaatcaatggattttgatgatttaatcatgcaaaccttacgtctttttgatgaaaatcctgatgttttagcctattatcaagggaaatttcaatatatccatgttgatgaatatcaagacaccaaccatgctcaatatcaattagtcaaactattggctagtcgttttcaaaatatttgtgttgttggtgacgctgaccaatcgatttatggttggcgtggagctgatatgcaaaatattttagattttgagaaagattatccaaaagctaaagtcgtcctattggaagaaaactatcgttcgactaaaaccatacttgatgcagctaataatgttatcaaaaataacttgaaaagacgtcctaaagaactatggactcagaatgatgaaggagataagattgtttatttccgagcaggaaatgagcaagaagaagcaaataaagtttctgaaattattagttcaggagttcgttcaggtcgttcatatgctgattatgcggttctctatcgaaccaatgctcaatctcggactattgaagattcgtttgtgaaatcaaatattccttatacgatggttgcaggaacaaaattttattctcgtaaagaaattcgagatgtgattgcttatttaaatgtagtagccaatccagcggataatatgagttttgaacggattgtcaatgaacctaaaagaggagttggtccgggggctttagaaaaattacgtcgctttgcagaaagtcgtaatctttatttagcagattcaagctttgatattatgctttctgatattcgaggaaaagcggctggcgagatttataatttagcaatggcctttgatttgttgagaacacatagcgaaagttcaacaatcacagagttggttgaagaaatgttagagcgtacgggttatcttaaggccttgcagctaattccaagtattgaaaatcaggctcggattgaaaatattgaagaattcttatctgtaaccaagggttttgatgagaaatcagaagttcctttggatgaagaaactggtgagccaatcattgaaacaggtttggacaaattgagccgtttccttaatgaagtcagcttgctttctgaaacagatgcctacgaggaagaatctgaccaagtcacaatgatgactttgcatgccgcaaaaggtttagagtttcctattgttttcttaatcgggatggaagaaaatatttttccattgtcacgtgtgaatgaagatatcgatgagttggaagaagaacggcgactagcctatgttggtattacaagagcagaagaaacgctttatctaatgaatgccaatcaacgggttctttatgggaaaactagctataatcgccctagtcgttttatttctgaaattgatgatgaacttcttgattatgctgggattgctcgtaaagtaaattcaacatataatgcttcttataaatcaggtggttttgcaagtggaatctcaatgtcagatgtacttcatcagcgtaaggcagtgattaatccaactgttggtcaatcaatcattgacaactcagaaaccgaagattggcaaatcggggacaccgccattcatcgtaaatggggagaaggaatggtcttagggatttcaggttctggtaaaaacatggaacttaagattaatttcccagaggtaggaatgaagcgactgttagcagcaatggcgcctattgagaaaaaataagtaacaaaattattggagaaactaatggcttatcatgagttagaaaaagtcgaattgacaaatatgtgtgccattattgacgaaaaaaatcaaaaagttctagttcaagaacgaaaaaaatcgtggacagggattggatttccaggaggacatgtcgaaaaaggagaagcccttatcccctcaacaattcgtgaaattaaagaagaaactggtctggacattagcaatttaaaaccttgtggcattaaagattggtttgagcccaaaaagaatcgacgatatatggtttttctatattcaacaacaactttttcaggataattgattaatgaaactgatgaggggaaagttttctggcaaaacataaatcaattgaccgatttaaaattggcaagtggttttgctgaaatggcagagatgatgcttcgttcatcttattcagaatttatctatgagattgacggagacacttggaagaagaaattttactgatttttgcataacattaattatgtaaaaatgcagatggaggcttgctatgactgaaaaaacaagatgtaattggtgcttatcaacggacaaaatgattcattatcatgatacctattggggagcgcctttacataatgatcaagaacttttcgcaaagttagtgcttgatttgaatcaagcaggtttatcatgggcaacaatcttaaataaacaagaaaatttttatgaggcttttgataattttgaaattgaaaaagtggcgctctatgatgaagttaaggaagaagaacttttacaaaatgcagggataatcagaaataagttaaaagttaaagctgcgattgtcaatgctcaaaaagttttagaaattcaaaaagaatttggctcatttgataagtacatctggtcatttacagatggaaaagttttacaacatcaagttagtgatgaatcggaaattccggcaacaaatgaactttcggatgcgatgagtaaagatataaaaaaacgcggttttaaattcactggttcaactgtgatttatgcttttttacaagcggtgggtgtaattaatgatcatgctgattactgttttagacaagtagaattaatggattgaaagcgtttcttatgatagaatgaagagagttttaaagttgttaagttacataaattttcttttttgaaaaggtgcttattatggcaaaaattcacccttatcttacttttaataacactaaagaagctttagattattataaagctgttcttggggcaactcatatttcacgaatgcctgtcgcagcagaacaagccgaacaattcggagttccactagaaaaagcagctgatttaaccatgcattcccagtttgatattttgggttcgacaattatggcagctgataactttatgaaagttgacccacttgtttatgatgctgtatctattttgattgatttggattctgaggatgaaaaagctctagcagaagccgatgctttttgggacaaggccgttgaatcaggaacagttacagtaaatttgccttttgagacacaattttggggtggaaaaatgggagattttactgacaaatatggtgtgcgttggatgttgcatgctcaaccctattcaaaattgccataaaattcataattagtaaaattaaaaataaaagtactgacagccaagactggtcagtacttttttatatgaaaatcaattttttatttaatgatacctaaaaattttatagatatttggatagttgccaaaaatttgttataatcgatatgtgaattttaacacaaaaggagtaactatgaaaatttggacaaaactgggcttgctctcgcttgtaggcctcactttaacagcttgtggaagcaacacaaagacagctaaagaacaatcgagttcgtctcaaaaagttgaaacttctgctggtgcaagtaaatcaaacacttatgcagatccttcaacattaagtgataaatatgatgttattattgttggttcaggcggagctggaatgacagcagcaatcgaagcgaaagatgctggaatgaatccagtgattttggaaaaaatgccgatagctggaggaaatacttcaaaagcctcagctggtttgaacgcatcagaatcatcagtcgaaaaagcacagggtgttgccgattcaaatgataaattttatgaagaaacgctcaaaggtggtggtggaaccaatgataaagcccttcttcgctattttgttgaccattcagctggagctgtcgattggttaaataccaatggaattgtattagataatttaacaactacaggtgggatgtcagtctctagaactcaccgtccacatgatagttctgcagtagggggctatctggtaaaaggactcgaagaaaacatttcgaaacgaaatattccattatttgtaaatagtgatgtaactaaaattactgaaaaagatggaaaagtatctggagtaaaggttaaaatcgaaggggaaacaaaaaatatttcttctaaggcagtagtagtcacaactggaggctttggtgcaaacaaaaaaatgattgccaaatatcgtccagatttaaaagattatgtaacaacaaatgctgctggttcaactggtgacggaatcactatgatttcagaacttggtggtcaattagttgatatggataaaatccaaattcacccaactgtattccaaaaaacaggttatctggtttcagaatctatccgtggtgagggagcaattcttgtaaatcaaaaagggaaacgtttctttaatgaaatggatacccgtgataaagtatctgctgccgaactcaaacaacctgggaaatattcttatgttattttcggtgaaggaacaaaagctaatgtaaaagctgttgaacaatatatgtctaaagacatggttgtagaagaaaatagtgtaaaagatcttgctgacaagcttgatattgaccaaaaaacactcacttcaacaattgatggctggaacaaagcagtttcaactaaaaaagatgaagaatttggtcgtacaacaggaatgaccaatgatatttctggtaagttttatgcgataaaagtagcgccgggtatccaccatacaatggcaggggttaaaattaatacaaatactcaagttctgaaaaaagatggaagtccaatccaaggcttatatgctgcaggagaagttactggtggcctccatggtggaaatcgaattggtggaaatgcagtcgctgatattgtaatatttggacgtcaagcagggcttcaatcatctgcttacgcgaaaacaattgactaatattaaagaaagttaaaattaaactggaatgaagtgctgacaagtctgtcagtacttttttctaaaataatgctaatttgattggcaaacataacgtatattcatatatccaagttggtaagtacccttttgattacagaaaaacaagaaaacatgcgattttaaacgaagcagaaactagaaaaagatttccattgctttcagtctcatcagaagaagaacttattgaaacaaaagaaaaagaacgaagaaagcacgaaacaaaagaagaacgtagattgcgaagaaatatcagagcgcaaatggcaatcgaaaactcaagaaaagaagaattaggattataggagcagataaatgaagtggacagaaaaatataaatgtggattttcaaatggactaggatatgcaactgtagaatttttatttgatgaaaaagaatctgatgaacttaaattggcttttcaagcttatgacgcaaatctatgtcctttgccagatgcatcaacttggaataaaaaatggctgaaaaaacaaactgattttcttaatagtgcaatctcaaaggactttatcggagaagtttggctagatgatgtactggttaggagtgtataaatgacagttgaaagtttactaaaagttattgaagaaggaatgacagttattttaaaaactgaaaaaaatcgaatcatagtccaatttgaatgtggtaatgatattgaagctttcagttgcggtttcctttacagaaaaataaaaattatcaaaataaaaaatggtagcgaactaatcgcaatcttggaggacacgaaaaatgactaagtttgaagaagaattaagtagtttaccagtttcgaaaagtacaaattatgcaaaatactggaataaagctcaactactaaaggtattcaaggattggcaaccacagcaagccctgccagtcgtgcctgagttcgtagcggaatacatcgaaagatgtaaaaggtctgactgcggtcttatatgggctattagaccggatagagatgctaatgataattcagaagaagtttatgattggctttttccaaatggagtcaaattaccaaacggtatgtacccaaatccatatgaaccagataatcttgtccgaccagataaagaaaatcagataaaatttgttcgtgcatggctagacggctacacagtcgaaaaaccgcagctgttctatattgatttaccaaaagtttttggattaagcgattcaaccagcgattcaaccttcgtatcaaaagcggaaagtggaataatctcagaatttacaaaaggaaaagattatgcattaaaattaacagaacaagaaatcaagtcaattgatgagcgttactggcagtttgctgtgcctgtggaggacggagaatgacaagaaaatttaaaaaactagacggaaatgcgactattccagaacgagcgacagaacatagcgcaggatatgacatttcagcaagtgaaacagttacgattcaacctgatgaaattaaaatggtaagcactggtctagctgttcaacttggtgatgatgaagtattgaaattatacgaccgttcaagtaatccagttaagcgtggcattgcattgattaattcagtaggaattatcgattcagattactatccgcaagaatttaaaggcttatttatgaacatctcaaaagagcctgtaaccatttctaaaggtcaaagaataatgcaaggggtatttgtcaaataccttacaacagacgatgacaacgcaaatggaaagcgtacaggcggatttggtagcactggggaggtgtgaaaaaatgagtgaattagaacacgaagttggaattttaagggctgaaaacttgaaattaagaaacgaggtagcacgattatctcaacaaacgcaacatagccaaccccagctcaacgctgcgaaaaagtatatcgagcatgttattggaacgattaaacatgatgggcatttaggaactattcaaacagactggattttgccttatttagaaaaaacactcgcagcgattggaggggatagatgacaacaacagaaaaaatagtacaaaactatcaagtgaaattattaaagattatattcaaagaaattgatagcctgatgaagaaaaaagaaaaggctgatatcaacgcaagtaaacttgctgaaaatgggaatacagttagaacatcagcatattggaaatcagtaggaaatgcagagttttatattaaagaaatgtatgaaaagttgagtgctttagctgaaattgatagactttttcattggtcaagccgtttacatcaagaacaattaaaatttgttggcaaatatccaaatgttatggaaaaatacagacaaactaatatcgctggtcataaaactgtgtgactgggtagcgaatttaaaggagaacaaaaaaatgacagaagctgataaatggcttgataaacatatggattgaacgcaaaaaaagcccaagctgacctagcttgagcggttgttgtaaaaattattagttactattgaatggtcacattcattatactactgattaattgatgactataaaatttgatttattaaaaaatctttaactataacaaaaaaagcccgagttgaccaaattcgagcttaatagaacaaagttttacggataatttttatggtcatacgtattatatcatactgagctaggaactcgctaaactcaactggagggaaaatgaaaatctatttcaaaactgaagagaacactggtctcttttcgactaatagaaagcaaatagttgaacttcgagggttaactttagatgaagtcgaaaaaataataaagttctacaatgatttaaaagctgcaaaacaatagaaaaaaagcccactgcaatgggctttaaaaacagatttcttaactactattatatcataaatataaggagttaagacactatgagtagaagatataaccttactgacagcgacttgaaagctatagagaagaagctctttatgtgtcaacgaattgaccacgctattcagtatcgcaagtatgagttagaagttaagcaatcacatgataataatgtaggtggcggtaggtcaagtatagtctcaaatccagtagaagatatggttatgaaatgggatgctgacagtaaactccaaagcctatatgagtttaagaatcgaatcaatgagttacaagattggtttggagatgatgaagatatgcaattggtattccactaccgttggttatctggtaaacgttatacagtaccagagatagctgataagtgtcacataactgagcgccaatactttagaaagagaagagcaatacttgagaagtatgatgagatatgcgacggcttctggtaatttgtcaccttttgggcgaaaactgacaagataaatgttgtattatagtatcatcaaataaaacaaataaagccagcggatatattctgttggctttttgtgtggcgaaagtgaggtgacctcccatggtattacgtgctgaccgtactggtgcgcatcgtgtagcctttgataagaatagaaagattcttttaaagacacagaacacttgtggaatatgtggcaagccaatcgataagagattgaaagctcctgatccattgagtccagttgttgaccacatcattccaattaataaaggtggtcatccttcagcgatggataacttacagcttgctcattggacctgcaaccgccagaagtctgacaagctattcaatgtgaagcaagaagaaccaaaggtattaggtaatcgtaacttaccacaaagccgtgattggtcttcttatgtatcttaatttattgatgataaatattattaaaaataatttaaagagcttaggagagaaactatgggggcatatccccctccctctgggtcagctcgtacttcacgccgtcactgtacattttttctcacgcgactttagaaaggagcaaaaaattgactgaaaaaggtattggatacctgagatttaagctatctgttcataaacgaagagcagaaatgcgctatgatcaatatgcgatgaagtatgttgatagattcaaagggattacaattccacaagcattaagccaacaatatcgttcaatattaggctggtgtgcaaaaggagttgatagtcttgcagaccgtcttgtttttcgagaatttgaaaatgatgactttacagtaaatgaaatttttgaggaaaataatcctgatatattttttgatagtgctgttttgtcatcacttattgcatcatgtagctttacttatatttctaaaggtgaaaatgatgcagtacgacttcaagttattgaagcggtcaatgcaacaggaatcattgacccaattactggattactgacagagggatatgcagttttagaacgagatgaaaacaataacgttgttcttgaagctcatttcttgcctgatagaacagattattattatcgtgattcacgtaataatatttcgattgctaatccaacaggtcatccactgttagtgcctatcattcaccgtcctgatgcagttcgtccatttgggcgttctcgtatcacacgttcaggaatgtattggcaaagcaatgcaaaacgaacccttgaaagagctgatgtaacagctgagttttattctttccctcaaaaatatgtaactggattgagtgatgatgcggagccaatggaaacttggaaagcaacagtttcaagcatgttgcaatttacaaaagacgaggatggcgataaaccaactcttggacaatttactcaaccaagcatgtcgccatttactgaacaacttagaactgcagctgctggtttcgctggtgaaactgggttaactcttgatgatttaggattcgtatctgataatccatcatcggttgaagcaattaaggcaagtcatgaaaatttaagattggctggtagaaaagctcaacgaagtttgggagcaggattactaaatgtagcttatcttgcagcatgtttgcgtgatgatgctccatatttgcgagaacagttcagaaaaacaaaaccgaaatgggaaccattatttgaagctgatgcaagtatgttaagtttaattggagatggtgctattaaactcaatcaagcaattcctgagttcatcaataaagataccattcgtgatttaactggaatagagggtggcgaatgatgaaaaagaaagtaattagattatatcggaagattatccataaattgattgttaaatatctcatttcttgtggttgtgcattccatcatggcaaatacggtgaaagcggtcgttatgtagttttattaaatgagcaacaataccacaatttataggcggtgagtaataatggaagatattttaccacctcttttagaaaaaattaatcaagattttgatgaaagagcagcaaatagtaaaaagttgaagcgatcgatggaattgttaaaaaataaaaaagcaacttatattcaagcaaatgaatttggtattgaagttggtcaaattttatctgatgttttgggaactcatgtaacagtagatgttttacctgacggaaaaatgtatttcaacattgcagatagattgttcaattccatattgaagaaaaattttgatttaatttcagggtattcaacggatgttcaaagtgaacttaatcaattagctggatttaaattaaaatcacaagtaccagaattaaaccaagatagaattgatggcattgttaaccgtatttctagtgaagatgattttgaaaaaatactttggcttttgaaagagccaatagtaacatttagccagagtgttgttgatgatacgcttaagaaaaatattgattttcaagcaaaagcaggtttaaaacccaaaattgtacgaaagttagtaggtaaagcatgcgattggtgtagaaatttggcaggttcatacgattatcctaatgttccaagcgatgtgtatcatcgccatgagcgttgccgttgcacagtagaatacgaccctagagatattgataaaaagcgtcaagatgtttggtctaaaaactgggttgacccagataaagatgcaaagattgctgaacgtaagaatttgaatctaaaaagtaaaaaataactcatcccagcgatagggttatcatgcatttagattgaaggaggagtaacatgactgctgaaaaaagatttggcaatcagtatcctactcaatcggtaatacttccatttactgaaacaaaatatcaagaagctattgagatttacgaaaaatctaaacatgagtgttatccatggcagaagaaccttttgaaagagattatggccattgatgaagatggtttatggacacaccaaaagtttggatattcaatcccacggcggaatggtaaaacagaaattgtatatatccttgaattatgggcgcttgaacaaggcttaagcattcttcatacagcacaccgaattagtacgtcccactcatcttatgagaaattaaaaaaatatcttgaagatagcggttatgttgaaggagaagatttcaaatctatcaaagctaaagggcaagaaagattggaattaattgagtctggtggagtaattcagttcagaacaagaacatcaagtggtggtcttggagaaggatttgatattttattcattgatgaagctcaggaatatactaccgagcaagaatcagcattgaaatatactgttactgacagtgataatccaatgactataatgtgtggaacacctccaacaccagtatcaagtggaactgtttttacaaattatcgagataataccttagctgggaaagcaaagtattcaggttgggcggagtggtcggttgaagatgtcaaggacattcatgatgtcgaagcctggtacaattctaatccatctatgggctatcacttaaacgaacgtaaaatcgaagccgaacttggtgaagataagttggaccataatgttcaacgtcttggttattggccaaaatataaccagaaatcagtcatttcagaacaagaatggaatgcgctcaaggttaatcgtttgccagttatcaaagggaagctctttgttggtattaagtatgggaatgatggtgcaaatgttgcaatgagtattgcggttaaaacactatcaggaaaggtatttgttgaaacaatcgattgtcagtccataaggaatggcaaccaatggattattaatttcttaaagaaagcagatgttgaaaaagttgttattgatggtcaaagtggtcaaagtatcttaacgagtgaaatgaaagatttcaaattgaaagaaccgatactaccaactgtaaaagaaattatcaatgctaattccctatgggaacaagggatttttcaaaaaaacttttgccattctggacaaccttcactttctactgtagtcactaactgtgacaagagaaatatcggtactagtggtggatttggatataaatcacaatttgatgatatggatatcagtttaatggacagtgcgttgttggcgcattgggcttgtagcaataacaagctgaagaaaaaacaacaaatacggtattagacgactttttaagtcgtttttttgtaccaaaaattaccgaactgccgggcaagcaggagaaaggatttgactatgtcagaaaacaatttaccaaaaacgcaagaagagttaaaccaaatcattgaaacaagattggcacgtcaaaaagaaacaattgaagctaattttgctgattatgatgaactcaaaactaaaattgctgcacttgaagcagataacactgcatatcaagcgactattgaagaatcaaaatcttgggaacaagaaaaagctgattatgaaaaacaaatcagtggttacaaaacaactcaactcaaacaatctattgctattaaagctggtttgccattagatttggctgaccgactttcaggcgatgatgaagaatcacttaaagctgatgctgaacgtttcagcggattcattaaaccacaaactccacctgccccacttaaagatgttgaaccaaatttgggtgacggaaaagatggagcttatcgtaaattagtcgatggactaaaaacagaaggagaataaaacatggtattaaacaaaggaacattatttgacccagaattggtcacagacctaatcagcaaagtagctggaaaaagctcaatcgcacgcttgtcagctcaaaaacctattccgttcaacggtgaaaaagttttcacatttacgatggattcagaaattgatgtcgtagcagaaagcggtaagaaaactcacggcggagtaacacttgcaccacaaacaatggtaccaatcaaagttgaatacggtgcacgtatttcagacgaatttatgtacgcatcagatgaagaaaaaattaacatcttgcaggcgtttaatgacggttttgctaaaaaagttgctcgtggtattgacttaatggcatttcacggtgtaaatccgcggttggggacagcatcggctgttattgggacaaaccactttgactctaaagttacgcaaaaagttgaagctccaagaggcattgcagaccctaacggcgctattgaaaatgcggtagagttgttaactggtgttgatgctgatgtaactggtattgcaatcaatccatcattccgttcagccctcgctaagcaaaaagacttgcaaggaaatgcacttttccctgaattgaaatggggtgcaacacctgacactatcaacggcttgccagtagatgtcaataaaacagtatctgatatgtcgttgacgcaaagagaccgcgccatcatcggagattttgctaacggctttaaatggggttacgcgaaagaagtaccactcgaagttatccaatacggtgacccagacaactcaggtcttgaccttaaaggatataaccaagtttacatccgtgctgaattattccttggttggggtatccttgatgctactaaatttgctcgggtaactgaagctaattaataaggaggtattaaatgagatactttaatacattaactaaagctacaatcgacacagatttcaaaatttctggcggagattgggtacttgaaaatgaatcgaaagaagctgttgtagatatccaagctaatgatgcagactccaaaaaagctgaacaagagcaagttgtggaagaatcaaatgtagatgggaactatgactggattactaaagatcaaatcatgcaagaacttgatgctttcggtattagatatgataaacgtgcaaacaaacaagtgctttatgatttgatgatggagcaaggaaaggagtaatatgaatccttttgctacagttgatgatttaacgatgctatggcgcccattaaagggagatgaaaaagaacgagctgaaaagttgcttgaaattgtctcggataccttacgtgaagaagctgataaagtggggagggatttagatgtaatgatttctgaaaaaccttcttatttttcaagtgttgtaaagtcagttacggtagatattgttgctagaacgcttatgacatcaactgatcaagaacccatgactcagacaacagagagtgcacttggttactctgtttctggctcatatcttgttcctggaggtggtttattcataaaaaattctgaattaagccgtttaggactaaaaaaacaaagatttggggtgattgatttttatgggaatgattaagggaattgctgtgactttgattgacaaagtagaaacaggaaaagacccttttggaaacccaatttatgaagataaggaaatcgtggtcaataacgtcttggtttccccaacctcatcggatgatattgttaatcagcttactttgacaggaaaaaaagcaatctatactctagctattccaaaaaaggatactcatgattgggaaaataaaaaagttagattctttggtaaaacgtggcggacttttggagaaccacttgaaggaatcgaggaacttattccattagattggaacaagaaagtgacggtggaacattatggctaaaaatctattcaaattaaatcgtagtggagttgctagtatgatgaaatcaccggaaatgcaagcaattcttaaagaaaaagcatctgctgttaaacagcgttgtggaccaggttatggtcaagatatgcatgttggtaaaaatcgtgctaatgcgatggtatttgccgaaacttatcaagcaaagcgtgacaacatgaaaaacaatacaattttaaaggcggtgcgttaaatgattgagattattattaaaaattttcttgatactcatttatcggtatcgtcttttttggagaaaaaaggagagatgccattaagctatgttttgtttgaaaaaacaggtagtagcaagagtaatcatcttttatcttcaacatttgcttttcagagctatgctccttctatgtatgaagcagcaaagctaaatgaacaattgaaagaagttgtagaacggctaatcgaactaaatgaaattagtaatgtatcactgaacagtgattacaactttactgacacagaaactaaagaataccgctatcaagcggtatttgatattaatcattattaggaggattaaaatggcacaagtagaaaatgtaactactgcaaagcccaaaattgatggtgctatttactcagcgccaaaaggtacagctttaccaactgatgcaagaacaacactaaatgttgcttttaaaccgttgggatatatttcagaagatggattaaaaaataaaaattcaccaaaatctgatagtatcaaagcttggggtggcgatacggttgctacagtacagacagaaaaagaagatacatttagctatacgctgattgaagctttgaatgttgaagtacttaaagaagtatatggggctgacaatgtaaccggaacccttaaaactggaattacggttaaggctaattcaaaagaacttattgagcatccggttgtcattgatatgacagtacgtaatggagtatttaagcgaattgtaattccacaggggaaagtatctgaaattggagatatttcttataacgactctgatgctgttggatttgagattactcttactggtttaccagataaagctggcaactctcactacgactacatactcgatacaactgtttaacactaatgaccccgtagtcggtcaagccaccgtaggggacgcaaaactctaaatattaaataaagaaagcgagaaatatgttaaaaggaacaacaaaatccggatttcgttatgaaattacaactgaacgtttaaataatttcgagttggtagaaattttgtcagaagttgatgaaaatcctcttctgttaccaaaaatgttaaatctcttattgggagaacatcaatctaaaaatttaaaaaactatcttcgagatgaagaaggtcttgtttcgactgacaaaatcagagaagcgcttgaagatatttttgcagctcaaaataaaataaaaaactaattctccttgccagaatgataaagtttgatgaagaagcactaatgtgcgaccttgcagaaatttatcatatttacgattacaaacagctatctcctctaaagatagctgttttttctataggtttgaatgaagaatctaggataaaaatgaagatgagtggacaaaagtttccaattaatacacttcttttagctgggattcaagaccgtttaagtatgtctttatggtttaaaacagaagatggtcagaaaggtaagaacaggccaaaacttgttaccgatatcatcaataaaccaaaagaaaaaactgatagaaaaatccgatttcattctggtgaggattttgaaaaatatcgtcagcaactatttcaaaaaggaggaggaagttaatggcaacagaattaggacaagcttatgtgcaaattatgccatctgccaaaggaatatcaggttcaatgtctgggatattagacccagaagctgagtcggcaggaaatagcgcaggtctaaaaattggttctgccttaaaggtcgccgcaatagctggtgtggtagcaacaggagcagcacttggtaaattaatttcttcatcactttctgaaggagctgatttacaacaatcattaggtggggtcgaaactctatttaaagataatgcagataaagtaaaaaaatatgcaacagaaggttataaaacggctggtatgtctgcgaatgcatatatggaaactgtaacaggtttttctgcatcaatgattaaatcattgaacggagatacagctaaggctgcagatttatcaaaccaagcaattgttgatatgtctgataatgccaataaaatgggtacaaatgttggtgatattcaaaatgcttatcaaggttttgccaagcagaactataccatgctggataacttgaaactgggatatggtggtacgaaagaagaaatgcaacgactcttgactgatgctcaaaagcttactggtcaaaagtatgatatttcaaacttctcagatatcacgcaagcgattcatgcaatccaaacagaaatggacattacaggcacaactgcgaaagaagcatcaacaacatttagtgggtcatttaattcaatgaaagctgcaatgtctaatgttttggggaacttatcactaggccgtgatttgcaaggaccattgaatgcgttggcgtcaacaacatcaacattcttattcaagaactttattccaatggtaggaaatatttttaaggctttaccaggagcaatttcgacgtttgtgagtgcagccggaaaagaactttcttcacaattaggaaatgggattggaagtgggttctctgactttactgcaaagttcagctcgatattatcacccctacaaggaagttttcaaactattgtctcaggcttaaaaccagtttttgatagtttactatcttcaattggaccaatcagtactcaaattatgggagtatttagcaaattaccacaattattttctaatgtcatttctgctgtaatgccggtaatttcaactttaagcgttgctttcggacagctaccatcgctttttgaagcaatatcagttgccgtgcaaccgatgattgacactatctcttctggaatttcaagacttgattttagcggaattcaagctattatatctgcattagtacctgcaattacaactggtattactacaatgatgggtattataggaccatcaatagatactttagtaaattcattcgtaaaaatgtggaattcaattcaacctttagcaacagttattgcaggggcattaatgccagcttttcaagtattaggcgcatttatcggtggagtattaaaaggagcaatgctcgcactatcagcaacttttgacactattcgtgttgtagtcggatttcttactccaataattgctgccgttttagctaaatttcaagaatttgcgcctgtactagcaactgtggctcaatgggttggtacggcaattggtttctttgcaaactttggggcagctggtacatcactcaaagggttaatcactagtgcatggaatggcataaaatcaataatatctagtgttgtaagtggtattggcggtatcattaataccgctaaagctatctttacaggcttgggttcagctggtggagcattaagaagtgtgatatcaggagcttggagtggtattcgctccatcatctcatctgtaggtggttctattagtggcacaattaatggaatcaaatcattttttagtagcttaggaggctctggtaatggtttacgatcagtaatgtctggagtgtggaacggaataacagggattatttcaggcgcctcttcaacaatttctggaatcattaatggaataaaaggtattttcaatagtttaagaaatattgatttagctggtgctggtcgtgcgattattgatggatttgtcggtgggcttaaaagcacatgggaagccggaaagaaatttgtaggtggaattgctgattggattaaagaacataaaggaccaattagttatgatagaaaactactaattccagctggtgaagctattatgggtggatttaatgacagtttgatggaaaactttaaagctgttcaaaaaaatgtttctgggatagcaaaacaaattcaatcagcaattactgatgaaattgatactaatatcttaaataacgattcatgggattctgcattgaacattggcagcaactcaaatattatcgctgctcaaaaaatagctggaaacattccagtcgatgctttaaatcaagaacaatcaaaaacggagatacacgctccaatgactgttgttgtgaaagaaaacccttctgaacgtgaaattgcacgacaacaacaactacaatggcaaaaagccgcttatgacttttagaaaggagaaataatgacgacacttccaaatgtggaaatttcttataaaaatacgttgggagttgaattaaaattggaccgctttggccctttttatttaactagctatgaaggttttggttcgccagaaaatgaaattagttctcaaaagatttttggaaaatctggacagcgtaaaacttccagttcgctgtcatacagggatatgacagtaggaattgcaattaaagaagaaacgtacgaggctttgaaagataaagaacatcaagtgatggccattatcaacccagaacttgcaggaactttatatattcgtattggtgaaaatctttatagtattgatgtagaaccattaaaaggttatgagggaagtaaagatagtagcgcatcaacgtctgaatcgtcaattcaatttagagcattagatcctgaatggcgagatgaaaacgttcgaaataaatccattcctttatcatcaaatgataataaattaaaatttccattatcaataaaaactgattttgcttttgcgacaattgctccaggacagattgtaaaaatattaaacaaaggagattttgaagttggctttgaacttaatattttgtgtaatgcagtagtaaaaaatccaagaatttataacgtagtcactcaagagtattttggatggacaggaacttttgatgcaggaaccactgttttcctttctacagttaatggggaaaagaaatcatggcatcaagatgatactgacccgaaatcaacgaatgctatgggtattcgtacacctggttctacttttttcacattagataatattgaatcgaataatttagttgtgcaggcagataaaggacacgaaagcattcttgcaaccatttcatttacacctttaattataggagtgtaagagtatggatattgaagtatttaagcgagtaggaactagtggttttaattttaaatctgctggtatcttagatgtttttgagtcattaacagttaactggagatactatacttattcccagttttcactaaaaatattactcgaagatgttcaaaaaataatttttaataatagtgaggaaatacagcgtagaaaagatattcttttctcgctttttatttcagataatattctaaatataaatgatgtttatttttatattgatagagtagtatgcgatgattcaacaaagggtgaagttattatatctggtaaatccttacgtgcaaaatcactgaagagaattgtttatagaatttatcatcagaccaaaaagccagaacaaattatctatgatcatattaacaatgaggttgtcaatccaagtcaagccagccgaaaaatccaatatttgtctattacttctcctggtacgttgtcaacgtcaactgttgattatcaaaattcttatggtgttgtttgcgatgaagtagatgccctttgctcaacttatgatattggtattagagagacagctacaaatttacaaaatcctcataacaaactagaaatagtaaaaggaaaagatttatcagatgttgtagaattcaacgttgattttgataatttactatcagagagctatgaatcatcaaactttgatgaagcgactatggcttgggtttttggtgagggagatggttctgcacgactaaatgtgaaactaaatgataacctggcaggcttagaacgtgaagaaatttatgttgatgcacgagatattcaaaagcaaacacaggatggaagtggaaaagatatcacattgacagattcacaatataaagcaactttaacaagtcgtggaattgaaaaacttgcagaacaagaagaagtgctcacgctaaatggagatatcgatttagaaagtgatttatttgtatatggcaaagattacgaactaggtgacagagtacggtttacaagtaaactattcaatttgacaaaaacttcagtgttagcaggtatagatgaaacttgggacaatacaggtcatcacatgtcaccgctatgggacaaagaaagtccaactgtgtttgacattattaaaaggagaataaaatgacacaatatagttttccgtggaacgacgtacacggagatcggctttatgacgcagatgattttatgcgattttttgcagcgttcctgaaaacaggcgttgtaatgtcttataaaggtggattgcgtgtacgctctgctcaggacggaatgaatattcaagtaggaagcggttcagccgtaattgaaggaagttcgtatttaaatgatgcggatattggcattcaagtaaatgttgcctcatcaatacaagatcgtgttgattctattgttttacgaatggataaaaatgcaagaactacacaattgttctataaaccaggcgatacgactgttgctagaaatgatacaacatacgaattacaattggcaaaaatttccgtaaaaactaatgccacccaaatcactgatgcggatatcacagatatgcgtagtgattttacggtatgtgggtggtctactccgtttgataatatcaatgttgatggaattgtagaccaatacaaggagatatttgaacaaaaagacttggaatttcaagcaaactggtttatataatggcatgattgcacctttgcaaaagttaaagtttgtagcgattctctggtatcaaggtgaaagtgatgctggtcagccaaagacttatgggactcgttttcgtgaattaatcgaaagttggcgaatactctttaagcaaccaaatttaccttttctctatgttcaattgccaaactgtgagactgaaaaagaggcagattgggcgggacttcgtgaggaacaaaaagaaggtctcaagatatcacgaacagcgatggtcgtgacaatcggagatggagaagatgatgacctacatccactaaataaaaaagatgtcgctcataagctattagacgcttatgacaatgttgaattattcccaaatggttattgtacagggccgcttgccaagggcgctgtacaaactcagaagaatgctattatccttttatttgacacttttggaaaagaatttagtattgagaagaataaggattttgaactttttcaaggaggatatagttataaattgaaaaactgtcgtcaggttggggaacaaatcattttagaagtccctgaaaacctatcgcttaatgctgatgcaaaaatcaggtataactggagcaatgctccgcaagcttttatttggaatgaggagggatatccatcctccccctttgaattaaaaattgaacaaaataataataggagaaaataaaatgaatctcgcaaaaaattggaaaagcttcgctttggttgccgcaggcgctcttgccgttgtatcattagcggcatgtggaaaatctgcaagtggaactaaatcaagtgatgcaagtgctaatttgaacaaaaagcaaacaatcacactttggacattcacgaccgaacaaccacagattgatgagttgaaaaaacttaaaccaaatctgacgatcaagcaagttgtcattccttatgccgactttcaaactaaacttgaccaagtcatcggaacaagtaaaggaccagacatggttgcacttgattcaggtttcgttgaaaaatatgtagagtctggcaaattaactgacctcgcatcttacggtgtatcatcagctgccaaagacaactataaatatacattggatatgggtaaaaacgccaagggccaacaagtagctatttcttatcaagctgctccaggtgcttattattacaacaccaatgttttccaaaaatatctaggaattgcaccaagcgatacaaaagcagctcaaacggcactttcaagttggtcacaaatcgaaaaaactgctcaaacaatcaaggataaatcaggtgggaaagcttatctctttagctcacttgaagaaatttacaatccagttattggagcacgtaaaacgggttgggtcaaagacaataaactgaaaattgatagtacaatgacggattcactggacctgatgaaagattttgtttctaaaggtttgactcaaaatacaactgctcaatctgctgattggttcgcaggaatgtcaaataacacaatcggaacttacgctttgccatcttgggtacttttttattggttgaaagattactctaaaggtactgcgggagattggcgcgtgactgctggaccagtttcttactcttggggtggaacttggttagctggtgttaagggtgcaaaaaattctgatgcagcctctgccctctcagtttatttgagcacagataaaacattccaaacatgggaagcaaaaacgcaaaatgattttgtttctgtcaaaactgtaaatgatacagtgggtaaagacgcttctgtttcactacttgggggccaaaatccctccccaatcttctctaacgttgctaaaaatattaacggtaaaaatcaaacgcaatatgaccaaaacatccaatctctatggattaatgatgttgttaacccttatgccaatggtaagattacaaaggataaggctttgaaaaacttcaaaaacgatgtgaagtcagcttatccagctttgagcgttgactaattataaaacataagggaaataaataaagatattcgctttaagttgaagctattaccagtttttattggaaataagttgctgatgagtgaataacattattcaatttcccttttattttttagaggagggtgatatggaaaacaccaaaaagaagtcatccaagaaaaaactttttgaaatgtacaaccgttttggttattactttttaattccctttttcgttggatttatcgtctttcaactttatccaattatttattcgattgcgattagctttacgagtatgaatggttttcaaactttttccgaggccacaaatgttggtttaggaaacttttctacacttttaaagaatactcctttatttatcacgagtattcaaaacactttacttttgtggggaatgaattttgtaccacaaattttaatggctctgattcttgctgcttggtggactaatcggaagctcaatctaaaaggtaatagcttttggaaaacagttttttatctgccaaatatgattatggtagcttctattgcggcgctctttttggggatttttggttatccaaatggtccagccaatcttttgctcacaaatctgcatattatcagtcatccattcaatttcttccagtctatttgggggacaagaagtattatcatcttcttacaattttggatgtggtaaggttcaacggcgatagtacttgtcgctgggatttcctcgattgatgatgctttgtttgaagcggcacggatagatggagcttctgacggacagatttttagaaagattactttacctttattgcgtccgattgtcatgtacacatttgtaaccagctttgttggtggcttacaagtgtttgatattccttatcttttgtcttcgggttcaggtggtccacaaaattcaacttatacgcttgctatgtttatctacaatcaagcctttcaataccgaaattatggaattgcggctgcagcatcagtgattctgttgattatcgcggcgattgtttctattgctcttttccgtttcttccgtgaacggacaagcaataaggatttggtaggaggtaaagattgatgaataaaagctatacaggttcactaagagccagacgtactttgatttatatctgttttggtattttgacgcttttgagtcttttgccatttgcaatcatgctggcagattcaacacgttcggtagttcagcttaataccggagtttctctcttgccggggagttcgctaggacataatatcaaagttttgttaagttatgattttaacttaggacatggaatgtttaacttggcgtttatcgctgtggtttcaacggctttgtctgtttattgttcggcactggcggcttatgctttggtcgcttatgattttaaagcgaaacgcttggtttatgcttttgtaattgctttgattatgattcctggtcaagtttcaatggtcggtttctatcaatttatgattcagcttaatcttttggataattatattcccttgattttaccgggaatgtgtgcgcctgcttcgatatttttcttagtagagtatatgggaacagtttacaataaggattatgcagattcggctcgacttgatggggcgagtgagcttaagatttttcattctgtaatgttgccaatgatgaaaccaggtctagcaacaatggcaatttttggttttgtctttagttggaacaactttttaatgcctttgatgctgatttctgacaaaaatctctataccttaccaatgatggtacaaacaatgacagctttaggagctggaggtcatacggttgagtggggagcagtgtattctggtctttcgattacgattgcacccattattattgtttatctgattctctctcgttttattgtcggtggaggaacagcaggaggcgtcaaaggttaagatgaaaaacttattattaaaagtcgcttcaaaagaagccattgacaagaaagtagagaaagtctttgaaattctctttggacaagattctcctgaacgtctctattttgaagaagaagacaaggcttatattgtcgatacaggcaatgatgatgtcagaaccgaaggaatgtcttatggaatgatgattgctttgcaattggacaagccagaaatcttttctcgtttatggaagtgggtgaaaagctatatgacgcttcccacgggacatgaaaatgaaggatattttatctggtcttgtggactagatggtcatcccaatagtgacggtccagcaccagatggtgaagaatattttgcagcagcattattgctggccgaaaaaagatggaaaatcaaaggatatggggacgaggcgagaactttacttcatgcaatagttcataaaggggagaatcaggatgggtttcccatgtttgaaccaaaaaacacctatattaagtttgttgctaatcgccagatgactgatccatcatatcatttaccacatttttatcagctttatgccaaatatggaaatccagaagattcagctttttttctgaaggctgaggaagaagcacgaaagtattggctcaaatcagcaaatgctaaaactggacttacgccagaatatgcggattatgatggaaaaccctatgatattgatggtcactggactttctttagcgatgcttatcggacggttgctaatattggtttagattggctttgggagcacgaagagcttggacaaagtcagattgccgtaaatattcaaaaattctttgagccttatcttgaaaatgatgaagaaattcctgtttttaaaattgatggtcagcctttaaggaaagaagaacagaccgcggaaggatttccacctctaaaagtccatcatccgattggtctatggtcaactttagctcaagcttcacttgtcaccaatgattttgactccattttgtctttgaaatatctcaactatttttggaatttgaatcttagaacaggcaagtatcgttattatgataatcttctttacttttttgctctccttgctttgtcaggaaattatcaaaaagattggttataaaaaatggagaaaataatgacaaaagaaattgccttaacttttgatgacggaccttggggaataaaaacagttcgggtgcttgatgaactgactaatcgaaaaattccagcaactttcatgatatggggtgtgcatatggcagaatatcctgaaattctaaaagtagcggcagaaaatgaacttttcgctttcgggaatcatacttatcatcatcgtcatttgaccgacttatcagataaagaaatcttgtcagaactcaacaaaacagatgaccttttttatgaactgacaggggagaagcttgactttgttcgtccaccttttggggattgtgagtatcataccttagacatcattcgtcgtccgcttatctgttggtctttggatacgatgagttgggaccatggaaatccagcaaaatgtgttgaaactatccataaagctaaagatggggatatcgtcttgatgcatgattttcaagaagcagatgttttggctttaccagaaattttagattatcttgaggaagaaaattttacttttaagaccattcccgaattattgggtgctcaacttaatgatgaagcttatatttattattcacgtgataagcgagtgaaaacaggttttggtggaagttgaacttattgtcaaaatggaaagggataagaaatggcgatagatgaaatgtggttgcagtcttcaatactgaaaaaacgactgaccaatgagattttctatgtgaatctggagtatgaggataaaattacgattcgcttgcgctcagaaatctgtgaatggttaggttgtcagctgacaggagaaaggtcagaagcaacagtggtcttgtcagtagattgtaagctagatgttaacttggaagcctatgaggtcaaagaaaatgagataattggaacttcatcagttggtttgctttatggattttatgcttatttgcgcttaaagctgtcaggagccaacttatctgaaaaatcagcacctgctcaatctttgcgaatgattaatcattgggatcaagtggatggaactattgagcgtggctatgctggtgagtctattttctttgggcgctttggttcaaatgacaatacagacacaggttcttttgctgtaaaagatattggaacagacatctttcgcaatgatttcacgcgcttgaaaatgtatgctcgctttcttgcttcaattggaattaatgcgatttcgcttaataatgtaaatgttcgaggattaggaacaagtttgattgtctcaccttacatcgagaaagtaggggagattgctaaactttttgctacttttggtctaaagactttcttagccattaattgggcagcaccaaaattgattggtgagctaaaaacgtcagaccccttggatgaaaatgtatatacatggtggcaacaaaccattgaccatatctatgaagttattcctgatttttgtggttttgtcgttaaggcagattctgagggcgaacctggtccttatcaatatggtcgaaatcatgctgacggggccaatatgctagcgaaagcttttgaaaaatataatggacttgtcatttggcgaacttttgtatataattctcagactgattggcggaatcgtaaaaatgaccgagctaaggcagcttatgaaaacttcatgcctcttgatggtgatttttctgacaatgtgattttacagattaagtttggtcctattgattttggagtgcgagaacccttgatgcccctgtttggtgcgttaaaaaagactaatcaactgatggaatttcaaatcacagccgagtatttagggcatcaaattgacctgaactatgttctttctcaatggttggaaatgattcattttgataactatggtcagccaaaagacacgataagcgctaattctccagtcgcgactcattcaggttttgttgccattggcaatgtgggaatggacgaaaattggtgcggcaataaactagcccaagctaatttttatggttttggccgcatgtgttggaacaatgatttgtctgccgctgagattttgcaagaatggcttgcattgacttttccagaggtaaaagcagaggtccaaaaagagatttatgaactcttgattgattctaatcaaacatatgaactctacaacgccccgcttgctgtgggctcaatgatggttcctcattatcattatgggccttcaatcaaatggttatgagtatgatcgttggggcgcttatcattttgctgaccgcaatggtttgggtattgaccgaacgactgcgacaggaactggctatgctagtctttatgctccagaagttgctgagatttttgaagataaaagcaaaactccggatgaaattctactctttttccattatgttgaatatggtcatcttttgcataatggaaagacattgattcaaactatttatgatcaacattttgaaggttttgaacgcgttaaatcttatatcaaaagctggaaatctttaaaggggcaagttgatgaagcaacttatgacaatgttgccgagcgtttagagcgtcagctggaaaatgccagaaattggcgagaccaagttaatacttatttttatcgaatgtctggtatcccagatgataaaggtcgggagatttatcggtgattttagaaaaatagctaatatgatgatattagctatttttgcttaagtgatttattttagaagtattattaaaatgtttatctgatataatagatttagaataaaacaggatataatcgttaatttaagtctatcaaagctctgatgatatcaaagagttaaatttattaagattataaaaaatatagaagggacttgatgacttgaagactaaaaatgaaatttttaaagacatgctaaatgagcaaaaagaaaatttggaaactgcgattgaaattaaacaaaataattttgaaatcagtcaaaatttattagaaagccgttttgaactttatccagaaaatcgacgtcgttctgtcaataaagttatttatcataatcagtattttcaattggtttataatttaaactcccaatcactgacgattgagagcaaaggcgatttaatttactctgcaattccttatgatacaggtaggaattacatacaaaaagcactgattcaatcaattttgcatccgacaaagacaagaaaatatattgaaagtcatgaaaataatctaaaaaaatatctggctttatccatttttcaaataagcggaagaaaagttatgcttgattccaatgaagttgagcgggcttatcaacaaatttttgaggacgctttatttgaaatgcaagtcttaggaagattaatgcaacatgatgaaacgggacctctttcggctaatttggcaggtaagtttttatatagtgagaatataaaaaccggaatttctccttatttagcagagtatttgaaatttgtagtagaagtgactcagacattaccgatttcgaccgatggaaaaaatgtccaattgcttgattctgcttatgaacaaactagcgaaaaaggttatcttgaccaacccaagtctttagcactgacaagtcaatcagatttgaatgttggcttagaaaatcttccagcaactcttaaagtagaaattgaaaatcttaaagtttctgagccaattagtcaagtgatgaccaaaccattactgaaatcaaatgcgggtaatcaattgaaagctctaagaaaaaattatgttgcacacagtcaagctccgaaagaactcgagcaatattttgaaaatgttcattccactcataatgacaataaaattaatgtcatttcagatattgatagtcagaacggaaaactcccgttttctaatcttaacttcaatattttggtaggaaatgtttccaattctgtagtttcagatacagaaatgcaaggcatttatgttattggaaatcatgagctttcagaccttctttcagacaatataatttttaagaagagtaaatgggatgcttttagagaaaaagagtggtttaaagaactagttgttgacccagatcaggcatgggcaaaattaccagtggggaacaattctttttatgagctcataaaagatgagctagcccaaaattatcccaaaatgaagatattaaataatgaatctgtgatttatgagggaatacgttatattggattaaccataccagtggccttttcaaagagaaagaaagaactacaaaattttatcgctattgaaatggaaagactacttgctcaagatagagacattccaactgtaattatttctcatgcgccattatttaatgaattaagtatgctttcaccaagaagtaaatcctataataaatcttataaatgtgctcatagaggaatattgaatttatttgataaatttaatattattggagcaattcatggtcatcatcatatccctgcatcattaggacaatcaaagatggtcagcttttcaaataaaaagctctttgtggtttgttctatttattcaaaaattaatacaggctttgaactttcaaatttattgtctgatttaattccttaagaaattaactttaataatgaaaaaaagagctctagcaactaggtctcttttttgataaggatataactttattttactttcaaagctttatttttttctagtagaaagggccgtaagtatccgactgtatttgataaaggaagaacatcaggacttaagtctatttttaattcattgataatgtagtttcttctgcttgtaattcgttcccaaagttcaggatattttactttcaattcattttgaagagactgatcagctatggctacacattcttcagcgcttacaccagtataaccagcaacagatgggataatatcaatctgaaagatcatgccactagctatctgtctttgagaatttttagataaagatgaggacatccattcttcatcggccacaaagtgaccaggatttaagtgccaatgataagaagcttttggtaaggttttatcaatgatttcatagagttctccgcctaacattcctagcgaaatattttctaaccatgccacaatagctttataatagggaataactacacgctcaagatagtctttttgattttcaggcaattctctttcttcattgattaaaaatccagtccgactagataatcctcctttgaaacctgtcgtcatagagattgcttctccaaattttatttttttataggttggatagaagttggcattttcaaatctttctcctgcagctgcaattgtaatcacagaatgagcttggccttcatcagagaggagtgctccaatttctgtttctcgcattcctatttttagctgattcatggcatttagaatgcaccgagaggctagatttgctccatattcataatgtgcgagttcatttgcattgtttattgttcgaattccttttggaccgatgagaaggtgggcagcgttagtgacaattgtatctgttgagagtgaattctttagtgcatctacaataaaatagggaagatcaaataattctgaaggttcttcattttgcgttgtaaacatcttccaaccaatcaatccgatttttttgtttttataaagttttaactctttaaaaatttgagttaaatttttttcgttatccatgggctgatttggcaaagaaaattgagggtaatgaataaggttagctccaattcttgagtgtttagacatttttaaattctcattacccaaaacaagcgtggccttaccatttttatcaataatgagcaatccttcttcaaagcgcggaataaagccagtaaagtattcaaaattactgccatgttctttgtccgcatagatgattagtgcatcatattgttctttagccattattgataaaagtttttcttttcgctcctctaatgttttgtccgttagtgtaactggtggaacattattaaagagctttggttcgtttattctttcgtaaacaatttctttatttatttatagtcactactttcacattattatcatttaaatttttcatcaattcaccttcaattttttcatcagtaatgaggtagtctatttcttttaaatcacaaattttaaagaatccttctttattaagtttagtatgatctgctagtgctatgacttgcttaccttgttgaatcatttttcttttgacaataccttcctcttgcgtatgaataaataagccatcattagaaagagcaaaaacaactaagattgtaaaatccacttggtattgagagagtttttcaacagtctccgcgccatacaagaatagttgattcttgtttaattttcctggaagaagttgtacggttgccttctcatactttgaaagtaatattgcattggtaagggagtttgtgatggttgagatagagaggttatcaagttgtttaatagcagcttcgacggttgttgatgaatcaaaaataagagtgctatgatctttaatgagattttttattttacttgctatttttttctttagattactggaaatatttgagcgttcttcataatttaaaatttcagcctctttaccgattggaattgctccaccatgaactcgatgcaatttttttctggattctaatttcattaaatctcttctaattgtatcttttgaaacttcaagtttttgagctaaaaagtcaattgtggcactgccttgttcatcaacgatttggctaatttgtgatagtctttcttctaataacatttgctctcctttcttaacttatcatcatatcatagactatttgattgtgcaacataatgcatttatttaattataaataaatgcaacttgcaaaataatgcaaatggcttgcttttattttactaatgattgaaggatatagaaattaaaaaagcataattattaattatgttttaattataaattagaatattcataaatttttgcaatttaagaaaaaagcatataatatcgacagtgttattgtacacaataacgtaaagtgtccgaaaaatatatgattatttattacaaaaattgaatcttataaaaactgaacacaaaaagacattttgggagagagctatgaatagcaaaaaaatgaaaaaatgggtaatttatggagtcattgcattgacaattttagggccacaaactcttattcacgagaacatccatgctgatgagagtacaactaccatcgaaaatggaaacgaacaagctaaaaaaggaacaattgaaataagtattattgactcatcttcaggtcaagtgcttaaaagttttgatattacagatttttcaaatgttcaactgcaagtgcatgagtcagaaattgaatcccagattgcttcattaaaaggttacattctagatccgagtcaaggttcatatgcaccaaatttcgttggcggggaaacggctgaagctaagttttatgtcaagagggcaactagtggaacgattaatgtcaatataatcgattcctcaagcggtcaggtgcttaaaagctttgatatcacagatgttccgggtcatttgttagaatcacatgaatcagaaattgaaacccagattgcttcactcaaaggttatgttttagacaagagtcaaggttcatatgctccaacatttattggtggagagacaggtgaagctaagttttatgtcaagagggcaactagtggaacgattaatgtcaatataatcgattcctcaagcggtcaggtgcttaaaagctttgatatcacagatgttccgggtcatttgctaaaatcacatgaatcagaaattgaaacccagattgcctcactaaaaggttatgttttagacaagagtcaaggttcttatgctccaacatttattggtggagagacacgtgaagccaaattttatgttaagaaagatacagatgggataagcaagattaatacaactgacgcatcaaacgctcaggtgcctaagaatagtgatgcaaaagttttgaatcacagtagtgaattaactgaaagccaagcccaaaagaagtcatcaatagataaagatatcaagagtcaaaaaataatagctattgaaaaaaaatcgaaaagtttaccacatattggggaaagcactagtattttatcttatagtttaggttcgttagctctcttaggcgcttcatttttcttcatgattaaacgctttaagaatttatgatggcttgggaagatttacttttttgacaggacttcattatgacctctaaatcttttttgatataatcaatttattacccttaaagtagaggagaagtgatgaatttagaaataaaaaatgtatctaaaactttaccggaatatcgtcaagtcatagatttagtaaaaaattcctttcctaaagaagaacaatatccaatttggctgttaaaactttgggctttaaagaaaaatgtgtattttggggcttactatcaaaatgatgagttttgtggtatttcttatcttgtcagtcatgaagagatgatttttgttttatatttagcagttaataatcaagttcagtctaaaggttatggttcagcgattttagaaacgttaaaagaaaaatttcaagataaaaatattacgttgaatattgaaagacttgatccagaagcggataattatgaacagagagtaaaacgcctaaaattctatcaaaagaatggtttttatgatacagactacacgattactgatcggggagaaactttcttaactttgacaacatcacaatctttctctgtagaggcttttaaaaaggtcttaagagaattaactttgggtcttgatttattaaaaattggaaaatctgaatcctgaaaattgaggattacaaaaaaagttgaaaaatgataaaatggataaggtaatctttgtccattttttatattcttttggctaggttgttaaaaagaggacgaaattagaattcaaacttgtattcttttaatagaatgaaaactcagctaagtcttgattcttatctgaatgtgaaattaaaaatatataaaagctgtagtgatgtacagataatttgaggagtattaatatggttatacaatggtttccaggacatatgtccaaagcccgtcgtcaggttcaggaaaatttaaaatatgttgattttgtgattgaattggttgatgcgcgtttgccaatgtcttcacgtaatcctatgttggggcaaattattggggataagccaagaattattgctttaaataaggctgatctggctgattcaagcaaggtagctgagtggattgaatattttgacgggcaaggatttgtaactttggctatcaattccaaggaagaatatacggctaagcgattgaccgtcgcagctaaaaaattaatggctgacaaagttgctcatgataaggagcgtggaattgctcatactactttacgtactatgattattggaataccaaatgctggtaaatcaacattgatgaaccgtttagcaggtaaaaaagttgcggtgacaggaaatcgtccaggggtcactaaaggtcagcaatggattcgaacaaataaagaattagaattattggatacaccggggattttgtggccgaaatttgaggaccaacttgtcggattaaaattggccttgactggtgcaatcaaagatgacttattgccaatggatgaagtgactatttttggtttaaatcattttttgaaaaattatcgttctatgataatgaaacgttatcgaatgacggaagaagatttggaacttgaaattccagatttgataatggaattgactgctagatttggattccgtgatgattatgaccgtttctacaatatgtttgtcaaagatgtccgagatggtaaactaggactattttgcttggatgaagttgggactgacgaactttaattaaaaaaatagttaattgctgctggttctctcagtagtaattgacataaattatattatgtaaaattactgacaagaaagttgttagtaattttgagagttggtgaataaagtgggacagactattaaagaaattaaggcacggttagctgaactgacagacttgtcagcaaaagaatttttagaatttgaaacagacgaacgtgcaggagttcaagcagctctgaaaagtagaaaaaaacaaattttagcagaatgcgcagaagatgaacgtttggaacaaatgttagaatttgagaaagaactttatagtcaagaaattgaactaattgcagggattgatgaagttggacgtggcgcccttgctggtcctgtggtcacagctgcagtaattttgccaaagaattgtaaaattcgtggtttgaatgatagtaaaaaagtgccaaaatcaaagcatcatgctattctatctgaaattcaagaaaaagcgctagcgattggaattggtattgttgatgccgaaaaaattgatgaagtaaatatttatgaggcgacaaaaattgcaatgattcaagcagtatcaaaattatctcttaaacctgaacatctcttaatagatgcgatggttttagatttgcccattgctcagacgaaaatcattcatggagatgctcgttcagcttcaattgcggccgcatcaattgtagctaaagtgactcgtgatgaaatgatgaaggatttcgctttagaatttctagaatatgattttgaacataatgcaggctatggaacagcaaaacatcttgcagctctgacaaaatatggtatcacaagaattcatcggaaatcctatgaaccaattaaatcgatggtcaacttcaaatattagattctgtaagtaaaaaatgtaaaacgtgaacgatatttgttcacgtttttttgctgacaagtctgtcagtaattattttcaaaggtttcaaaaatctagtctaataattaatttgctagactaatcttctgtcttttaataataccacaaaaggagaatttgattaatggcagataagttagatagaattattggagattacgttaatggcagacttgaagccagaataaaatcaattgaaagcagatatctttataaacaaaaagtagataacttaggcattcgtacagcttattctggcggttcggagcctgaaagtcatgttttaaataaagaagcgcttgaaaatgatgaggaattaatcagattaagagaattgataagacaaatcgacatctggtatctacctttgattcaagttgaaaaggaggtaataagactaaaatgtgaaggatataatggcagatactggtatcaagtaatgcaagaattggatgttcaaggatttgaagttccacagaagaaagctaaagctgcttattataaatttaggaatgacatctattcttttgttattcacttaatttgagagggacaaaataggcaaaaaaagaatcgaaattgcctgaaattggcccctcaatccttgtttttgctgatatacttgtattatgaagtaaaaggcaaaagcaaaaatttcagaaaaataaggttgaatttgcttcataagcttgttagggttcgactccctgacttgctattatattttattacaggttgtccaatgggcagccttttattgttgatgaaaggagatgccctatgaggttacaccgctgtgcaaatgtagggtgtcgtgaattgataccccttaaacataattactgccagaagcattacgatgagcgcctaggcaattacatcaatcaacgggcagaaagtaaagctaaggcatctctaactttaagagggcaacgtaaccaagctgaacagaacagagagtatgaccagacaaggcgaaaggaattacacaatggattctaccaagacaaacgttggtctaaagtatctgagtacgtcaaggcaagagatggttatgttgatgcgattgaaggtaaggcatgggataagggcgacctgatagccgagcacatcataccaagacgattgctttcaggaatggaacaatataataccgacaatctatggcttctaactaaatcgcagcacaataaaaaaactgcaatagaaaataagttatccgaccagcaattaaaaaatgttgggcgagattggtggaaaaaagttttaaaaaataaaaaatagcccccccgtcattgcttttaggaataccgtataccaatggtggcttcctttcgaaaaaagtgattttttaaaatttttgcatagggggggtcaagacaaataagaaaggagaaaaaatgacagctaagaagtttaaagacagtaatgacgggaagttgtcctatcgtgcacctaagcacctttctcctctcgcaagtgcttgttggcgtaaaactgtcccctttcttgaggaacaaaagccagttgataagattgattcgtttttagttgaaatgtactgtactcagtatgaaatttatagaaattcatacgaacatcttaaaaaacatggtgaggttcaagaaatttataaaccagttcaagatatgactggtgaaattattgacagacaatttcaaggttttaaacgtaatccaatgactcaaatttactcggatgcaataaaaaatcttacaaagattggttctgagttaggtttatctccaaaatcacgttcagagttaatgggattgaatatgcaggaagatgaagaagaaattgattggacttctaagtttggtggtggttaatggataactataaagatttaacagaacgttatccagatgatccagctttatcttatgcaattggtgtacttgacggcactataatatcaggggaaaaaataaagcaagcctgtaaacgccacattaatgatttaaggagaattgataaagatgatgcattcatttatatctatgattcagaacaagctaagaaaattgtagaattttcaacactcctgaaagatgtaacgagtggcgaaccatttgaagcatcaccttatcaaaagtttattctagcttctgttcaagggtggcgtaatccagagacaaaaggaatgagatttaaaacaatctttatttcaatggctcggacaaacggtaagactcaagtacttgcaacttatgcactttataatttcttatttggttctcctaaaataaatagacagcttgcagtaagttcaatagatattgctcacactcataacttatttaattatatgaggttcaattggattcaattgaaagatggtgtgtttaaaaagcttgctaaagctttagatatcaacgataattctcaagttatggagataaaaaagcagtctgcggtaatgaaaaaactttctgctcaaggaagcccagcggattctgaccattatactactggtatcgttgatgaatatcatttatttggtcaaaagcaacgtgattttattagctcaatgacatctggtatggttaataatccattagctcagatgttttttatttcaacagctggagttgacccgactgttccgatgtttgaagattataagcggtattctaaaatgcttgaatctggtgattggagtagttctgaaaaagatttagttcttatatgggaacaagatagcgaagatgaagcttatctaattgaaacatggcctaagtcaaatccattaatggaaatagagtatatgcgtaagaatcttacagaggggatgattaccgaacgtgattcattaaactctcaagggcgcatacgtgacttttacgttaagaatatgaacttatggcagaacgcaaaaaagaacgcttatttgccattagatttggttcaagatgccattgtagatgagtttgattacttcggccgtgatgtctttattggttttgactactcgcaaacaaacgatgatacctcattggcttttgtatttcctcatagtggaagtaaatttcatttgcatcaacatagctggatacctattgcgaaagctggttctattgaagccaaggaacaaagagataacattgattatcgtgcggttcaagaaaaagggttcgcaactataactagagaccgttttggactgattgatgaagatgaagtttttaattggatgcttaatttcatagaaaaaaacgagttaaaagtaaaagctattttgtatgaccagtggggaacgggaaatttcattagacgactggatgaagtcaaagtagaatatcttctgattccagtaagacaagggataaagtcgcttaatgagcctactaaattcttacagtcttcgtttattaagcataatattacaatgcttgatgaccaagcgttaattcaaggcctagtcaatgcagttactgtttctgataataatgggattaagcttgataaaaatgtcaattctcaaaaaatagatgctgctgatgctattgtcaatgcactttatgaaggacaattttactttaatgattttacaaatgtagaagaaaagaaaacaaattctccttttggaaatatgaatgacgaagaaatcagcgactactttattaatggatttagtttttaaggaggaaaatgaaaaatttaattacatacttaccagcgctacttgttttcgttggttttttatttgtatcggttggtatattcattattaatgttccgatagggctaattatttcagggatattgttatttgccctagcttatatgtattcaaataaaggaggacatacatgagtattttaaacccttttgaacgcagaagctcaattacatctaataattattacccttttatggttcaaaatggttcgattgttcctaattcgcttgtcgatgcaacagaagcactaaaaaatagcgatttatatgcagtgactagtttaattagctcggatatcgcaggtaccagatttactggtaatcaagtgttcacgagcgttctaaacaatccaagccacttaacaaatgcttttagtttctggcaaacagctatattaaatcttttgcttaacgggaatgtatttctagccattttaaaaggtgataatagcttgatgaaagagttgaggttaattcctagtaacgctataacaatagatttgaccgataatacattgacttacgaagttaatcaatttgatgattatccaagtgctaaatataacgctagtgaaatgatacatgtaaaaatcatggcttatggtgtcgatacactccataacttggttggtcattctccactagaatctcttacaagcgaaatagggcaacagaaagaagcaaatagactttctctatcaactttaaaaggagcgcttaatcctacaagtgttgtcaaagttccgcaaggcaccttatcttcagaagctaaagactctataagaaatgagttcgaaaaagcaaacggaggaaataactcaggacgtgtcatggttctggatcaatcagatgacttttctacagtatccataaatgccgatgttgctaattaccttaattcaatgaattggggaagaactcaaattgccaaagctttcggagtatctgacagttatttaaacggaacgggagaccaacagtcgagtcttgaccaaattaaggacctttatgttaatgctttaaaccgattcattgagcctttaatttcagaactgagaatcaaatgcgattcatcgattggcgttgatatgtctcccattaccgactattcaaattctgtgtttaaagcagatatattgaactgggtaaaagaaggaattattgagccaacagaagcaaagaatttattagaaagcaaggggattatttagtggaaaacatcgaatatcgttattttgattcaacagagttagagacgaggagccctacaaatactggttttattggacaaattgcagggtatgccattaaattcaatactcctagtactgcaatggctccatttattgaatatgttgctccgacggcacttgataatgtcgatttaagtgatgtattagctttatacaatcatgattacgctaatgtgctaggcagagttgatgcaggaactttaaagttaagcattgataaagtcggcttgcattttgttttggatatgccagatacaacagttggccatgacgtttataacaatattaaggctgggaaccttaaaggtatgagttttggattctatgttgcggacggtggtgattcatggcaacaaggagcagatagtccaataagaattattaatcaacttcaaacgttgagtgaaataagtgttgtaagcagaccagcttatgatgatacaagcgtccaagttactcgttcaatggacgcttttttatcggaacgaacgagaaaatataaagaaaaggtaaaaatctacctaggaggactcaatgaaaattgaaaaattaaaaaaagatttagcaactaaaactgctgaacttaatgccaaaaaagctgaaattcgtagctttactgattcagaagacaaaacaattgatgaagtcaaagctggaatggcagaaatcaaagaaaaagaagatgaaatcaaagaaattcgctctaatattgaagttttggagcaagcttcagcattaaaagttgaagaaaaaagagatgattctgatttggttgctcctgaattagaagaaaattcagcagataacaaagaagttaatccagaaaaaactaaaactgaaacaaaatcagaagcagaaaaagataaaaatactgtcaaagatgacgaaaaaagagatgcaggaggattgcaagatatgaaattaaaagttggtggcgaaatcgcagataaaaaagtgactgcttttgctgattatttaaaaactggtgaagttcgtaatgttacaggtattgctttgaatgatgggaaagtaattattcctcaaacaattctcactccagaaaaagaagtgcatcaattcccacggcttggctcattggttcgtaccgaatcagtaactacaacaactggtaagcttccaatttttaataactctactgacctattgactgctcacacagagtatggtcaaacaactaaaaatacaactccagttattacacctattctttgggacttgaaaacatatacaggaagctatgtattctctcaagaattgatttctgattcgtcttatgattggcaagctgaacttcaatcacgattgactgagcttcgtgataatactgatgattctcttatcattacagctttgactgatggagttaaaaaaacttcctctactgacttaattggagatattaagaaagttctgaacgttactttaaaacctcaagattctgcagctgcttcgattgttatgtcacaatctgcctataacctctttgatatggctactgatgcaatgggtcgtcctttgttgcaaccaaacgttaccgcagcaactggttatactttgcttgggaaaacagttgttatcgttgatgataaattgtttcctagtgctaatgcaggggatgtaaatatcgttgttgctccgctcaaaaaagcagtaatcaactttaaacttactgaaattactggtcaattccaagatacttatgatgtctggtataaacaattaggtatcttcttgcatcaaaacgttgtacaagctcgtaaagacttaattgttaacttgacaggtaagctaaaagaagtaaaagttattcaatctacagcagtataaggagtgaattatggcactaattacagcgcaagaattacttgatgaaaatcatattgattcaaactatgatgaaattgcaactatgaatagacttattcatgatgcaagtgccttaattcgtggttctatttctgattcagttactgatgagcaaatcatggataatttacccgaccagtacaatagagctatttcagctcttgcaacccgtctatatttcagtagagatttatctgatggttacggtatgggtattcagattatgattaatcaaataagagctagaatgtgggaggtgctgaatggcacaacttaatctagctgactttaacaaaaaagttcaactaggagatgttaaaactttaactaatgaatatacaggagctggttatgacggttttgttccagcattaacggtttggtttgcatctaaaacaagaacgttgagtcaatcataccaactccaaggaactgctcttgaaaactcacgtacgattatcatacgacacaattcatcagcagaaaaattaaaggttgctgagattgataatgtccaatatgatatcgtcaattattcgcctgatgaaacaagcaacattatcaggtacgactatttgacgttgaaaaggagttcatgatggaagaaaagcaactatttgaagacattatgaatgggataatttttcaagcagaatctgtcagtacatctctaacggttgaagataaagcgaaaataaccaaggctggtgcaaatgcattcgctagaggacttgaaaaagtcactaaagataagcattatcgtattcgtaaaactggggaaaatccacatctagccgatagtattttggttcagaacactaatattgatggtattaaagacggaaattctaccgttggttgggattacaccaaatcaagggtaggtcatctgattgaaaacggcacacgttttccgatgtattccaaaaaaggaacgaaatatagaaaagggggtcaagttgcaattacatctgacccttttgtttctacttatcgtgacggcatggaagctcaagttgccatattttcagcggaagcagaagttttttcagaaatactcaaaaagaaaggggcagaatgagaccaacacaagaagtttcgcaaatagtaggtgctttccgtccctcttggttagtatttgaaaattttattcccaaagaacatgttaatgatttagacaatactcaagttttactgacagagtttaaatcagatattactaactatggggacggaacctttaatagcgttgttctggcagttactatccaaattttctacggatttaatctctctgaaagtatgcttcttgcagaaatagaattgatggagaaactaaaagatagcgggtggttaacaatttcaagtgaaccacattacctagacgttagtaccaatacaacaaaacaacaaactaaaaaaaatatcacagttgaaaaaattgtggaaattaatgaattaaaaggagaataaaatggcaattgtaggtttaaaaaaatcttatcttggattaattgataaaaaaacaggcaaaattattgcagggcctgaagggctaacaacagatggactttatatatcaaatccgaaagattatggtacagcttctgaaaatatcactaatattgcagctgctggtactcaaaaatttggagacaacggtcttgttgatgtagtgagtgcaaaatcatttccgcaagtcgctgcagtttggaacaatcttccttttgctattaaagctaaaattaaaggagaagtaagcgacaaaaaaggcggatacgttcaatcacaagatttgccacaagttgctttgattattgagtcagagttaattgatcgttcacattcaattttttacgcattcggtaatgggcaaatgactgaaactgcattgaacattcaaactgaccatacagcgcaaaaccgagttgaagatgcattgacttatcaatcactggcttttgcggcatggaataatcaaggaatgaaaactttcaattctgcagatcctggattcgataaagtggcaatgttaaaagaagttatgggaggatatgctgctagtggactcggagtttaattaaacagtgcgggatgattacatcccgcttttttatttataaaatattggagaaaaacatggaaattaaaatcaaacaacttaaaaaaaccgttgaagtcaaagcttcaattaaaaatctcaagaagagttataaatttgccaaaaacatggccgaagcagaagaaaaaattagtgaaggaaacgatgaactagtcttagattatcttgattcaattatcgaatttgtctctgatatcgctaaactcagcaaaaaagaaaaagaagaacttgaagaacttgaaatggaagagttgatggaagttgtttcttatattgttgcaaaattgcaaggcgcttctgactcggatatcaaaaaagccaaagaaaatggcgaagtgggtttagcccaagagagcgaataatcagcaatcataatcacttgttagaattacagctattcgaaaaagatgtgattcaaaatcttcattgggatttaagcacaattggagaacaggaatatgaggaattgcttgatgtcatgagcgcaaatcctgataacaaaatgatgtcagctgaggatttagctgctcaatggaattcgttaatttaaaaagaaaggaggaatatatggcaaaagaaaaagtagctgggactttggccactaatatcggagttaatactactaatgcagtaaccagtattgaaagccttaaaaattcagttaaagatagcaccaatgcttggaaacagatggaatctcaaatgaagctgtcaggagatactctaggtgcttctaaagctaagtatgagggtttgtctgattctttaagtaaacaaaaatcagtgcttgagcggctaaaacaagagcaatcagaagttaaccgttctacttctgatggagagaaagcttatcaaaaatatgcttcacaaattactcaagcagaagttaagttaaccgccctaaacggtcaacaagataaagcaaaacaagcttatgagtaccaaaaatcaggacttgcaaaacttaacgaggaagttcaacattctaacaagcttacggaagaacgggtaaagcaactcgaagcggaaggaaaaactgaagaagccaacaaagccaaaattgatggattaaagtcagctcaagaaaaatattctcaaattttaaagattcaaaaaaccgaattggaaaaactaggggaatcaggcgataagaactctaaggcttataaacttcaagaagttcgtgtggcgcaaatgtccacaaaggtttcagaagctactcgagatataaaaaggctcaacggcactgaaataaaacctcgtacagaaggtataggtaaagtaaagagtcagcttagaagccttaatgatctattaggtcgtacacatagccgttttaaagatgtgtttttagggaacatcttagctagtggcgtaatcggtgcgattggtgatattaagagcaaatttactggcgctttagaagctggcgtagagtataacaaagaaatgcagaatttatcggtttctttgaataattttacaaatggtaatcaaaaactgaatgattctttagttgataatatcaaaaatttgcgagaagaatcaggatattccattgatacattaagtcttttaactaaaaaaaattatggattagaaggttcggctgatggcgctaaaaaattatctgacgcttttgttaatttaggtcgtgcaactggtaaatctgatgatgcaatgcaaaacattatcactaagtttactcaaatgaatgcaagtggtgaaattacttctggttcaattaccaaaatgggaaaaacgctacctgggttcgctaaaacattatccacgacaatgggtgtctctcgcgataaactcaacgaattagcaaaagacggtaaaatttcaatgtctgatttatcaaagacaattgaaaacatgagtgccgctaaacctaaagggcttgaaaactacctcacttcatttgacggattttctgctcacttgcaagaaaaataccaaagtttatctggaaaaatcacagaaggtttctttaaaacaaataataatttcttaaaaaacatgtctaaatctcttgacggagaggaaacggaaaaggcgtttactcatatcggagatagtgcaaataaagctgtcacaactatttctacagcttttagctccgtttttaaaggaactaaaaatccattagcagactttgcgaatggactggctaatgaaattgaaaaattagggaactttatttctaaacatgccaatgatatcaaaaacttttttggtatggtaaaagatttaggcggtgctgcatttaagttaatcggcgacactctaaaaacagttctaccttggcttgagaagtttgggacttgggcatcaaaacatccggaagacgttaagaaaattgctcttgcaattataggacttaacattgcattaaaaggtactttaggtacggcagttagtggtatcgttactcttcttgattacacagacccattaacttgtacgattgatagcacagcaggcagtatttttaaaaatggttctggtacaacaacacttacttgccgagtatttcaatctggtgctgaaattgatacagctggaacaacctatacttataaatggtctcaacgtgaccaaaatggcgtattaaatgctaattttggcggtacagtcaatcaatataaaactggtaaaacaattagtgttgcggcgactgatatcaatgtcaaagctcaatatacatgcgaggtgaatcaataatgaaaagtacattttatgccaatatcgaacttgggggagaaatcacacaagttagctttgaagcaacaagcgcaagtgatgtgattgaacaaatctggtggacttttggtatctccaccccaattattgaaatttgggcggaggtgactgatgacgatagtagcaagcaatagcctcaccataagtaacgttaatgatgggacaataactcacgtagcctacgcttacagcgcagacggcactgacggtttcacaactgtttatccaattttgaatttgttggatggtacctcatcgactttaaaaaccgtatctgctaaaggttggggcactccttcgttagctaccaatactgtaaattttgaaaaaggaaaagtatatacttactcggcttgggttcaagattgtgatgtagactcacgtgcaatactctatctttatgactctgctaacgtcagctacaataatgctggaaatacgataaaagctggaacttctggtttttcaactatcacttttactgtctctattgatgttgctaggtataaagcttctattggatttgtagcaaatcaatccaatctccataatttaagctattcaaaattaaaattagaaccaggctcaaccgccaccccttggatgccatcagctagcgaagtaacaactgctgactggccaagctacatcggtcagtacacagactttacgcaagctgacagcactaatccatccgattacacttggagtctgatgcgagggaatgacgggtttggaataaaagccactgttatcacttacgctatttcaacaagcggaacaacggcaccatctagcggttggacaagttctgttcccagtcttgtaaaaggtcagtatctctggacgaaaacagtatggacatacacggacaactcatttgaaacaggttactcagtaacttatatttctaaagacggaaataacggtaatgacggaattgctggtaaagatggcgttggaataaaaactacgaccattgcgtatgcaggctcaacaagtggaacaacggcaccgactagcggttggacttccacagttccgacagttgcagcaggtagttatctgtggactaagactgtttgggcttatacggataataccagtgaaacagggtattcagtagctaaaatgggaaacaatggagcaacagggccgcaaggacctcagggtaatactggcccacaaggaccaactggtcctgctggaagtaatggtgatccaggtaaaattgtttctgatgaagaacctaccacaaaatttaaaggtttaacttggaaatatataggaattacagcagttgatgcttctgacggaactaacatccaaccaaatactgagtattattggaatggcaaaaattgggttattaatcttattaaggctcaaaatattgatgtcgatactttgtctgcgattacagctattttaggggatatgcttgggggttcgctgactatctcaaaaagtgacactcagggaatagctgttaaagatggtgtggttaagtcttgggatatttctaaaatgatagaccctaattatccagacggatattcatatacaagcatgggggtggctttgaattcaggcggcttaaccatttacagtgctggttatggaataacccttgataaaggtggagtcattgatccaaaatacaaagtcgcttcattacaagcgattgccagtaatgggagaaatagtattggtacagggcttgttttaaatgcgactaattccaatttcccatttacaattaatgggaatattgatgtgattggtggaattagacaaacttctaagactacctctgtaactattggagctggtttaatctttagcttagaacgacgtggtgaaactgtgattgcaattttgttaggtacaattaattcatcgcttacttctggtcaacaattcggtgtgggtaaaattccattaggctatcgacctaatacaacagccaacataccagcgcatatgacctcaagttataatggtgcacatattgatgcggggattgacggagtctgtacttggtgggggccttcgactaataccgggtacccacgaggttcacaaatgtggtttactaatgattcgttaccaaactagaaacaaggagaaaaaatgaaaaagaacaaacagactcaagaaactaccgacattattatcggtgaaaacattgttgccaatcttagtattaccgcttatgagacgggggctttagaagcacagctaacaattaataaccctcaagattttcataattcagaagaagctaaaaatgagctaaacgaattaatatcagaagcttttgaggcttcgaaaaataaactggccacttatgaagtgccagaaaaatagaaagcaggggttatggaggaacaagcatggcgagaagtcctcgaacgtttagctcgaattgaaacaaagttagataactatgaaacagttcgagataaagcagaacgagcgctcctaatagctcaatcaaatgcgaaacttatagaaaaaatggaagctaataataagtgggcttggggctttatgcttactttagcggtaacagttattggctatatattaactagatttggaatttaaaggagaaagaacatgaaaacaattgataaaggaacactcacacgtacaatcttactttggttggcaattttaaaccaagtattgacagcgcttggtaagaatccacttccattagatgataatactgtcagtacattaattactgctgtatttgctcttttggcttggtggaggaacaatgactttactcatgcagcaaaaaaaggaactgaacttacaaaaagtttgaaaaatggtgatagcgttcaagtggttaaagcttctgacgctgaccacgaattcacagaaggggggcgaatgatgtcaagtattgaaaatatgattgcttggatgcaagcacgaaaaggcaaagttacttactcaatgacttcacgaatgggtccaacaagttatgattgcagctcgtcagtattctttgccatgattgctggtggttttctgtcagtaggttcaatgggaaatactgaaactttatttggaatgtctggcacaaaactcaaagaaatcagccgtggagaagtgcaacgtggggacatttttatctcgggcactccaggaggttctgctggatctgatggacacacaggtattttcctaagcaatggttcattcattcactgttcttacactcacaatggaattgcgattgatacgaacgatgcatacatgagtacacgcttaccacatcacttttatcgaattgttggttcaggttcagcaaatactgatgacaagccacaaatggttactctaaatcttgatggtcaatttggaaatgcgaccgctaaacgattgcaagaatactttgatactgctggtaaagacggagtaatcagtcaccagtacaaacaaacctttaatcaaaatatttatgctgctcagtttgattcatcactgactggttcaaacgtggttaaagcattgcaaagatttttaggaattggacaagacggactgtttgggcaagctacgattaaagcactacaaaaacatcttggaacaacacaagacggaataattagcccagtatctgattctgtcagagaattacaacgtcgattaaatgcgaataaactataaaaataacccctgacttcggttaggggtatttttatttataaaatacatattaataaagtctttaacccgtatagttatttgacttttaatagttcttaaagtaaacttaaatatgtataaaaaatgaggagtatctatattgaataaatatataaataatttaataaatagtgctgggatagtgctaatttttgtatcgttaatcggcgcgatgcaatcaagaatcttatggttagataaactatcaaatggtcttatcgtaacaattacaatcagtcttatattactttttttatttattacatttgcgaaaaagagtttatttcagaaagttttttcttttatcagattgtacgaaaaacggatattttggatttttttatattttgtataatatatcaaatagtattagtaataacactaaatggaacacctaagtttgattcttatcgtttaatacatgttgaagatatcaaggctattagtgatgtttgacgttaagtcaagttatcttctaagtaaaatctatttagctaagatcttacctgcaacatatttctatttttctttttatcattacctccaaatataataaaaaaagacgtccccagaggacgtcttctttatcccctagatgattaacgaacatcaaagaggacccacattttattagccaaaactaatgtggatcatttataaagaaaaaataaaattttttactgttgttaatcatcttggaacctcaatattttatattaatagctagtataattaaaattttttgatttgtcaattatttatctactttttctaaatttttctccaatttcaattgatacataacaataattatgtatttattttaaataaagatgagattgaagaatgaatggaacgtgcggtttccgaattattcattgtatatagatgaattccggcaacatcttcagttactaaatctactatttgatctattgcataagctattcctgcatctcttagcgcaacaggattatgttcatacttttccagtattctgataaattttgctggtagaggcgtattgcaattttttaataaacgcagaatctgattacggtttatgacgggcataatcccagcaagaatggggacatttatttccgcaatggcacaacgttcttgaaaatcatagaagctattattatcaaaaaataactgagtaattaacttatcagaccctgaatcaactttctctttcaaataatgaaaatcactgatacgatttattgattcagggtgaacatatggataacaagcgcccaaaacttcgaaactactatcataatcctttataaattttaccaagtcactagcatatttgaagtcttttttagttgcttcatcacttatatcacctctcagtgctaaaactttcataatctgcttttctcttaaacgttccaaaatctctatcacttgggttttgtcgagataggccgcgggtaaatgagcaacagcaggaatatttaatgtattattaacataatctgcaaattttatggttgtatcagcaatattctcataattattattactacaggtaacgctgataaagtcaggagaaagtgctcttaaactatcaagtgttttcactaaatgagagctcccaacttgagttgttggaggaaaaacttcaaaagatagaattttagaatcacttgtcatatgttatcttttcctttcttacctcttttgttgcctcaaccaggtgagtcaaactagggattgtttccttatttcctcttgttttaagaccacaatcaggattaacccaaacttgctcaattggtaatttattcaaaatcttttctagttgaatttttatttcttgactactaggaattcttggggaatggatatcataaactcctggccctaccaaagtttgaaaatgatgagcttttagtgcatcaataattgataactggctgcgactagcctcaaaagaaatgacatcggcatccatcgcatcaatagaaggaataatatcttcaaattcagaataacacatgtgtgtatggatttgagtttcagctttcaccttagaatggaccaatcgaaaggctggaatcgaccaatctaaatattcactataccaatcacttcgacgtaatggtagtttttctctaagtgctgcttcatcaatctgaatgattttaattccagccttttctaaatcgagtacttcttcttggacagctaaggctaactgtaaagtactttcctttaaggaaatatcttctcttggaaaagaccaatttagaatagttacaggccctgtaagcatcccctttaccggtttagaagtctgagattgagcatatgctgaccagcgaacggtcatagcttgcggtcttgtgatatctccccaaacaattggcggtttaacacatcgtgttccataagattgaacccatgctttttgtgtaaaaatataaccatctaattgttctccaaaatattctaccatatcatttctttcaaattcaccatgaactaaaacatctaacccaatgttctcttgaagttccaaacattctttaattttttcttccaaaaatgcttcataatcacttttgctcagttcaccacgcttatactgcaatcgagcttttcttacttctggcgtttgaggaaatgaaccaatagtcgttgttggtagcagaggaagcctgagtgcttttatttgatcggcacgtctttcaactaagctaggcgttctaataaaatctttatcagttaaatgagtaattttttgtttaagttgaatattttcttggactctatttttatcaaaaagtgcaatattcttatctaacagggaagtatttttcttaacataaatttcggaaatttcactaacttccaccaatttttctttggcaaatgcgaaatggttgagaatttctttgcttaatttgatttcattctcagttgttactggaacatgctgtaaagaacaacttgtattgattacaatattatcaatgtttcctaaatcttttagcaaactcagtgttttttgataatgattacgccaaatatttttcccattgacaactcctgcaaagagtaatttatcttgaggaaaaccatacttttgaactagttttacagactctcttccttcaacaaaatcaaggccaatcccatcaaaatcgagctttatgatttcttgataactatcgcgtaggtcaccaaaataggtttgaaggagaaccttaagcttatttttattcttaagtagctcttgataaatttttatgaataactgttgttcttcttctgtttgatctaaaactagagctggctcttcaatttgtaaccattcccctcctaaattattcagttggtcaaataatactgtgtaggctccaatgaggtcagacaatatcgcgtcctcggttactccagaaaggtaatccgccaaaattaaaaaggtatatggaccaataattgtcggtctagtttcaaaaccggcagtctttgcttcttgatattcgtttaatagttttgaaaaatttgcttttattactgtttctttgctaatttctggaacgatataatggtaatttgtattaaaccattttttcatcggccttgctttcacgtcattttcttcgtcttgaaaaccacgcgctaaagcaaataaagtatctaattcattgagttttaattttttataacgttcgggaattaccccaagtgcaatagataggtctaaagtttggtcatagaaagagaaatcgttggaaatgggataatcaattccagcttctttttgacttttccaactttctaaacgaagttctttggccacaatttgtagttcagcctcagaaatttccttacggaagtatttttccagagcaaatttcaattcacgatttgaaccgatacgagggaaggcaataattgattttttcatagtagctatctccaatatttaataggtctatcttatcaaatttaataaaactttaataatacctttttgatatgatgacctatagtttttaactatattgaagtcgtaaaaacaataaaagtccaagcaaatttgcttgaacttttattatttaataatctatcgtatgtgcatcaagtgaatgcttgattggataaatgaaggaataacaattgagctttctctatcttcttttatgattatcgaattatcttctaatttttcaataactttaattaggtgtgggagagagagctctaatttttcaaaaaaagcttttcctttttcttctatcgccgtaacatgataagtttgtgctacttgcgcttcatcaagcgttagctctacttcattttttaaccaaaatgactccgtaggaatttccgacccgtgaggatcagtctcaggatagcccattaaaacatataatgattcaatcaatctcggagatgatgcatgctctaaattttcagcttcatcatgaacttcttccatcgtataaccaactttttcaaagaggaaactttcccagacccggtgactttttagaatgaatcgggcttcatgtgtccctaaatcagtcaacaatacaccataataaggtttgtgaataacaagttcttttttggctagacgtttaatcatttcagttgcacttggagaagaaactgaaagcttttgagctattgcattgatacttactgattcattattttcatttctcagactataaatcgctttaagatagtcttgttcattttttgaagttttcatttttttaccttacttttctccatttaattataacatagactatttcaaagtaaaatcaaagagaaaatattctatcatctttatttttaaatttatagtaactcaccatattttgagacaaaaattttcttaaatagggtaacaagaaacatgtacatgactactgttaaaattaaccaagggaaaaaggtgagtggcaaagccattaagccaattgatttcccaaaacttgtgaatggaatgattgtgagaccaataattcctaaaaaagtaagaagcgtcaatggagctgaggcacgactttgtaagaaaggaatttttggagtccgaatcatatgaattactaatgtttgtgtccacattgattcaataaaccaaccagtatggaagagagcaataaagccaatataggctgcacttcctggaacaagagtgctgaatgggccaaatgttgctggacagataacgaaaaacattaggagatatgtcgtgatatcaaaaacagaacttgttgggccaatccataacataaatttacttacagaacttgcatcccattttcttggaacaactaagtattcttcatcaacattatcccatggaattgctgtacatgagaaatcataaattaaattaagtaagagaatatggatagataacattggaataaatggtaaaaaggcactcgcaattaaaactgaaaacatattaccgaaattagaacttgcggtcatctttatatacttaatcatgttagcataggtttttcttccttcaatgattcctttttcaaggaccattaaatctttttctaacaagatgacatccgcagattctttggcgatatctacggcactatctactgaaattccaacatcagaggctttcattgctgctgcgtcattaataccatctcccatataacctacgctattgcctgaatttctaagagttgtgacaattcttgccttttgttggggagataacttagcaaagacagaggcttctttagcaacttgtgccagttcttcatcatcaagttgatcaatgtcagaacctaaaattgttttatcagcaggaagcccaacttgttcacaaactgaacgggttactttgtcattatcaccagtcaatatttttactgatacgccatatttattaagtgccttaattgcctttgctgttgactcttttggtgggtctaagaacgcaagatagcccattaataccatgtcagattcatcttgaacagaaaagctatctattggagagggattggttttctgagccaccagaatcacgcgcattcctagttcatttaattcatcaacttttttgaggatgtattgtcttaactcagaatttaagggaacaatctttccttcatcttcaactaaggtacaaatgtctaacatttcttcagctgcacctttagtaatcatttgtgtttttgcgtttgtaccattcccgttactttggaccacaacgctcatccgacgtctttcaaaatcaaaggggatttcatcaacttttgtatatttactacttaaaccagataattcaggatttttttcttgcttggcttctgctccttcaataatagccaaatccattaaatttttcaaacctgtttggtagtaactattcaaaaatccatgtcttaatacccgaatattttcttgaccatgaatatcaaggtggcgcatcaatacaaccttatcttgagtcaatgttccagtcttatctgtacatagtatattcattgaacctaaattttgaatagaatttagatttttaatgattgttttttctttcgacattgtaactgcaccttttgccaagcaggttgtcacaatcattggcaacatctctggtgttaatccaaccgctactgctaaagcaaatagtgcggcttccatccagtcgcctttagtaaaaccgtttatcaataagacaaaaggaaccatcactaacataaagcgaatgagtacccaagatactgaattcacccctttttcaaaagttgttttagtagaatcttcggtcacacttctagccatttcaccaaaaatagtattatctccagtaacaatcactatcccataagcactcccactaataatattcgaacccatgaaagcaagatttgacgattctgtaatcgaatcataagcctctgatgttgctaaatctaatttttctactggttcactttcgccagtcaatgaggcttgactgataaataaatctttagcttggataattctcaaatcagctggaaccatatctcctgctgataggtgaataatatctccaacaaggacttcttcaattggaatttcttgactacccgtttctagtctatgaacgtttgtggttgtcgtaatcatttttaggagattttcggcagcatttccacttcttgtttcttgaacaaatcgtaagattccagaaattaaaaccattgtggtaatgatgatcagtccttgtggatttttttcccctggagcagctaatataatatcagtaaaagctgaaacgagtgccaaaacaaataatataatagtgaagggattgatgaaggcttgataaaggcgcttaattagtgaggtttttttacctctagtaatactattatcgccgtattgttcacgagaaatttcaacttgttcttcacttaagcctttatctgatgtcttaaatttttgaaacaattcttctttgcttgatactctggcaaattcaagtcttctttttatttcgttgttgtctacaaaatttgtagctctttttgtgttttcgagtgtttttctaagttttttcattggtctgtacctcatgttttttaatatttttgctgtacagtcctaaaccttaggcactttaaagaaggtgataagaacggaaaattgctcttatcacgttaattatctgcggcctttcgggctcgggactattaatactctgggattccatttccgttctcacctcctttaaatacaaaaaaccttgcctacaaaacttgaacgtaggcaagggaataattccaaaaaaagataacactataaagcgaatcagttacaagctatcgttcaagctttagctccgcagggcaatgttgttgcactatttcacgccttctttttcgacatgaactgttggccctctcatcgtgtctccacgactctgcggcagcaacccgtatccctgcggtagactcacctaccgatggctatgcttatggcataaccaaatccattatagctgttctatctttttttgtcaatctttttatttttttattttaagacagactctgttgcaccattcatcgcccaatcttttgataagaataatgagttatcaatatgatatttaagattacttggtgttttcataaatttttcaattgctttgtctgtcgctaaccagccttttgttccaaaatggactgtatcgccggaagcataaggagtattatacatgtctgttaaatcagcaatctgattaaatccttgactccgcaattgtgttttaattttagagctgaaattttgtaatgtttcttcagagacacctgtatatgatgaccaagagccattgacaggttgaataacaaataaaacatcattatgattttcagcaaaaacatttagaagttgttggaaatcttgatattctggactttcgagataagaaactttctttttataattttccagatgtttatatttggattttattctctgattccaaacattattgttaattttgaaaggattgttatttgaactcttttctccttggtcaactgccaagcgatttaaattctctgatgttggatcattgggtaattcttttgcaaatttgttgatttttggagaaagtcccaaatgatcagcggtgaattgagacatatttgagaaaagtaaatcttctttccgccaaaattgtaagttggttgccacagtcattttttgcaaggcagttaatggttttttagctgctaaacgttctagagaattataaattgtttcctcagatttaagtgatctgaattttaatagatgttttgcaagctgtgttgttgtggcagctttagggtctgcttctttcaaccaaccataaatttcacctttggatacaaagttctttagttcactttcaacaattccttgtttagagaaccattgtggactaataacaaaaacaattttacgattttttagttcgtctgccactgaattcatatagaaaaagtgagttaatgtcgttgttccgggttgtcctactaaaaatggtatgaaacctgaattatacttgctgaaataagcacttgggtgaaatgaatcaacgtgttccatttctgacgaaccgagaactggtaaaaattcaggatctgaataggcttgtttcttaattgaatatcctgtaaaagtaggggtatttaatggtgactgtgcaaacttaacgagttggtctttagaatatttcattccaacgttaaaagggagaaatattaataaagcaacgagaactaaagctgcaattagtgggccaattgctctaaaaattttaattttcatccgttttttcctgaacgcgtgctgctattttatttgctgtattccaatcttcacggtccatttctgatggtggaagactaatatcaaatgcaccttctaattcaacgataagcataatagctctcattgaatcaagaattccttcttcaaacaaatccatgtctaagtcttcacggaattcgtctgtgcctgagattgtttcgataatgtcaaaaatttgttctttcatttttttctcctaatgtttttataagtctaactcttttagaagttaggaagtgggtaatgtggatctaagcagtgcataatgatgtggtttggtattcctgagaagataaggaaactgataaatactaggttaaaagtgatgaaaatacttacagcacttgtccatttattatctggaattttccacttctttcgttttttcaaacgtttccaagcatcataaccaatcattaacatggcatggtagaaaccatatagaatgtaataccatgtcaacccgtgccagaatcccatgagtagcatgttcgcaaggtaaccaatatttgaaatggttaccatattttttgaccattttttgaccatgaatgttttcactagacgcatgaagacaaaatctcggaaccaaaaacttaaagtcatgtgccatctttgccagaaatcatgaatatttttggctaagaatggtttattgaagttatgtggtaaatcataacccattaaattactgataccaatggcaaagagtgaataaccagcaaagtcaaagaataaatacaatccataaacatacatagatgatgaaacattcaagaaacttggatgaagcgttgcactaattgcgataccatgtaaccaatattggtcaatcaaataaccgatgataaatttataaaggaaaccttggaaaattctaaaaatccctttatttaataaatcaagatatttttcagtaactactggtgcttttaattctttaacgaaatggcggaagcgatcgattggccctgatgaaattgttggatagaaatagaggaaataaagaaattctttgagtggaactgctttaataagcccatctcttatttctataatcatcgcaacggttttaaaactgatgtaagagattcctaaaaatccaagaattgaaccaggacccggtccaggattgaacaaaggatgaacttttacaatcactaatggcaagattgatagtaaaatgatgagataaaaaacaaaggtttggtttttactctgttttacccgataccattcataaaacttaacaatgatggtctgaaagaccccaaatccgattagagcccaaatggtaactgtccctgaaaatgtaagccagagaaaagcaatagtcagtaaaacttgataccacataagctttttgccaaggagctgagcaataacaatcggaattaaagccaggcctagaatcaggaagtaaaagggagttgaatagggttgcactagttgtcacctcgctctttttgggcgagtgccttgcggtcaacttttccattttgattcagagggaactttttgagataaataaatttggttggcatcatataatccataattgtttttgaaagttctgctttgagttgctttgtaaaggctcgttcttcagcacgatccgcaaatgttttttcactttcaagataagcgattaaagctgtaactttatgttggtcattcgatttaggtaaaaccactgctttttcgatatcttttaggttttgaatattggcttcaatatcctgaagttcaatacggaatccattaaatttgacttgaaaatcaattcttccttgataacgaagcatgccctcatcagttagtgaaccggcatcgcctgtatgataggcaggttttccatctactgcgaaaaaggcttgagcagttttctctgggttttcaaagtaacctttagcaacggaatcaccgataataatgatttcaccatccatgatttttagttctacaccaggtttggcaaaaccaataggaagacggtcattttctgtcagtaatttttcagtcacttttattgatgaaatagctcctgttgcttctgttggaccataagtattataaatagttgctgacgggaatgctgtcagtaatttttcagctgtttttttcgtcaattcttctccacaaaagatgaattgtactaaattaggatgttctttctctgtgaatgagggatccaataagcaaatatcaacaaatgatggtgtagaaatccaagtattgatgactgttgaattcaatcgttcaaaaagtaatttaaagtttgttgtttcgtcacgtgaaagtgagactaatgttccaccagttgtcagacttggatacaaactaaaaattgataagtcaaagctataaagggcttgtgataaaatttgattattttcaattttgttaaagtcgttgttcatccagtttgtgaaggtcacaagattagcatggctgacttcaacaccttttggtactccagttgttcccgaagtatagataatataattgctatcattaccagaaacggcttgactaaaatcaagttctggaagtttttcatcgagagatagagtgtttagattaactgagattctgtcagtaaaaagagcagaaaaatcttctgaaagattaacagtcgttatcacaactgctggttttgctgctgaattaatcatttctgtccgctcaaatggagtgtgggcatcgactgaaatataagcatgtccagtcaaatttgatgctagcattgctgctaaactaataaagtcatttttaccaaaaattaggattggacgattcactaatgtccgctccttgatttgttttgaaatctccgatacagcgacgaataattggcggtaagtaaatttctgctcacgctcggcaagcacgataaggtcagggtttttgtttgcaatttcaaaaatttgttctaataatttcataattaacttctccaataaatctctctaaaattcgttgtaaataaagtgtgctcccccagtatgactgtaggaataaagatagagtagaattaatataattacaaagtaaaatattattttagccaaaaatatacgaatttcttttttcttgtccattggaactccttttaatatataaattaataagaggtttttagaatactcagttaatctcatatcatttatgacttagattataacatttattaagcgaaaaaaaaacttacatttctgtaagtttaaatcatttttagaaaagaaaacggcaacaatttatttttagtaattttaagtgtacgtcatccgtttttagtgattttttgtctaatcatttgagcaacttttttgggattttctgcttctgtcagtaaagaaataaccgcaagtccgtcaagtccaatggctgacaattctgtcagtgaatcttgcgtgattccaccgattcctacaattggtaattgattttctagaagcatcagtcttaagtctttaatgccaattggctttgccgcatcatttttactgtttgttgggtaaattggcccaattcctaaataatcagccccactgctttgtgccgtttttaattcgtcagccatagtgacagaaagacccaaccacatttcctgaccaaccttctcgcgaactttactgaccgactcatctgtttgtccaatatgaattccatcagcatttagttcacgcgccaactccacatcatcattgacaataaaagaaacgcctgcttcttcggacactttttgtaatttttgagcaattgacagacgctgcttctgctctttataaatggttcccttatctcgaaattgataaacagtgacaccactttttataattaaagcaatcttttgcgttgctccatctagtgaacattctgaaaaattttgtggtccagcaataaaataaacacttaaatctaaagttttattagtcattaatattcacccaatgattcaatggcccatgaccatgcccaaccataatcgttttagaaattgcctcactaataaaagctttcgcattaggcatgatttctctcagactttctcctatagctaaatgagcagtaatataggaagaaagtgtatctccagttccatgtgttctttctgtcagtaatcttttagagtcataagtactgacagaaccatccgtcagtaataaataatctctgacaagttctccttggccatgtccacccttaataagaacattttttgctcctaatttttgaatatcatgaagcgcgcttaaaagcgaattttcgtcagtaatttgatagccggtcatgacctctgcttcctccaaattaggagtaactaactctgctaagggaagtaactcatcttttatcaagtcaatcgcttcctttgttaaaagaatagccccacctttagccaccattactgggtcaaccaccaaatgttttggtttgtatttttttaatccttgaatcaccccttcaacttgagcagtatcaaaaagtgctcctgttttggctgccgaaatttccaaatcagaaaataccgagtcaaattgagctaaaataaaatctttatttgtcggtaaaatttcttgtacgccataagtattttgtgccgttaagcctgttacgatcgttgctgaataaactttttgattatgaaaagttttcatgtccgcattaattccggcaccaccagaagaatcaattccagcaattgtcacaacctgtggaatagtaatcattataatactcctttattttatttcttgtgtcgcttgataaagtgtgtcaagaagactattgacaaaattacctggtaaattttgcacttgtttggtcgctatcattccagcttccccgaaaaattttgtcgcttcataagcagctgtaaacaaatcatcggaaacagctgcaaaggtgccaaccactgctgtcagcatgtccccacaaccaacattaattttaaagagtgggctgtcagtgtcaacatacatctcttcatgaccgttagaaataatatccactttacctgtttctataatcactgcccctgtttttttagccgcaagtcgcgcgtgttcattatctatatttgactcaagtgcatcaatgcctttatttaaactttttttatcagcaaaccaagcaatttcagccgaatttccgcgaataatattaaactttacttcttgactcaaccttttaactatggatgctctgaaaggaacattgaccgcaactgggtccaaaattaatggttttgctttttgatttgccaagcgacaagcttctaaaaagagaggataagtcgattctgatattgtgccaatattgactaccacagcatctgaaatttcaactaatgactcgagctcagcaatttctgacgtcattaaaggtgaggcaccaataaaactgataacgtccgcgactcgttgaggagttacaaaattcgccaagttcaaaataagcggttgtgttctttgaatcttacctaaaatagacataaaaaaactcctttatttacacaaggagggctcaagcatgacaagaaagtgagaattacaattttctcaaaagaaaatataataaaaactcggacacattcttacgcaggtcttaacctgttcaagtttgatggtctttctcaaccgataatttaaaattatcagtacccattgtgtattagatttatttttgaaactacaaccagtttagcatatttatagcaaaaaaaactgatttaataaatttaagaagaaaaaaacccaccgaaacggtaggttttttaaattattttttgtcttcattcaaatttttatcaatactttcctcttgacgatttgttttcacccagtcatttttagagttgaaaaatcgaatcgctgactgcggatagatttgagtcaaaatcaataagaatttagttaaattagccgtatctttcaggacatcccaatccttcattttttcattgtttttccctctattataaagcagagcccaaacaaagttgacaatgataatataaatagacatcacaataaaaaggataacaacaattttaagtgattgagtaattcccgttaaaatcgcagaattgataatcataatcatagtataaattacaatgatatactcaattcccattaaccaaggtttaaataaagtcatcagtatctcaaatttttgtttccaaaccagatttttcgaacgaatcgttggtaaaatatattttgatgattcaatattaccctgagcccaacggactcgttgcttgaccaaagcttcattatcattgataattccagtttgttcaatataaatatcatcatattgtgcatttttcacttcaatatctgaaagaaaaagacgtgttgataaataaaatcctccacaagtgaatctgtccacggttcttcatttaaagcttgaagagtgctcaatttacaaaactgcccgttcccaccaaaagcaactgtattagtcaaagtccgaaacatttgagtggcattaataatctcggaaaattcaaggtcttgcgacgaatcctttaataaattggcgacacgaacttttggttgaagaccagtgagcttatcatcataattaaaagcacgattgactttttcaaaataattagtttcaagttttgtatcagcatcaataattgctatcaatacttcctcaggagcaattcctttcgcttgaatctgttcactaatttgataataggcccaattaagcgcggttccttttcctttttgcgcatttggtttaattctccttaaaacatttaaatgagaatcattaatttctgatatcttttacccgaattgctagttgattatttagcgtaaagaataagtaataatggatttttatacaccagaaatgattgaattagatttggtgtttcaagtttaggagaaactatgaaaattaaaaaagagcttttgcttttactttctttgacgatgataggagttggaactgtccatgctcaagcttctacaaatgtgcccctttaccggatgtataattcaaattctggtgaacatttctatactgaaaatctttatgaagcaacctccttacataatgtaggatggaattacgaagggattgaaagttatgaaccagttactggtggggctcctgtctatcgtctttacaatccaaacgctggtgttcatttttatactacaagtgcttatgaaaagcagaacttagtgaatcgtggttggcgctatgagttgattgcttttgtttcgggtggaaatattccaatatatagggcatacaatgcgcataatagtcagcataattatacaactagtgctggagaacagaacaatttaactagcctaggttggtcaaatgaaggaatagccttttatgcaaatgcctatggaaatcccaatgataacactatttctcggcaaccagtttggcattctaattttttatatcaaaatgatccacgctgggcaaatgtaagggtgggtgattcaaccatggccccagagggctgcggccccacagcaattgccatgattttaaatggatatggtgctaattacaatcctgtccagattgctcgaacagctaatcaaatcggaaactataataatcctaatattcccggagatggtattgatggacagactgtagtgaaaactttgaattactacggaatgcagatgaaccagattacaacaaaagagcaattaattaatgaattgagatcaaacaaacctgttatctatggtatggagtggctttatacttatcctaagatttctcactttgtcgttctttcaggatacaataatggctatacaaccgtacatgatcctttgaataggattacaggtagtaactcagttgagcgattatgggcacatccctcacaactctctgacgattggaatgcaggacgtccagcatggtcagttcttcctaagtaaatattaaaaggagtaaattttgaaaaaaacattgtattttggagtgcgcttgtggcgcttgtatttttgagtcaaggtaaagctttggccaacgaggttccaggagggacaacaactattaatggtgataatgttgttttagaagtaccagtaaaagcaggtcaatctgaagcgaatgaaacacaagctcctaaagaagaattaggtcagaatgattcagtaagtcttcgttcaagaatggcagttgcaccagcgactcaagcacaaaccctagcagtttatagaatgtacaatgcaaattctggtgagcatttttatacaaaaaattcttatgaacgggattctttaaaaaatattggttggaattatgaaggagtgggatggcaagctccagagagtggttcaccagtttatcgactttataatccaaatagtggtgagcacttttataccttgagtgcctatgagcgtgatgatttaagaaaacatggttggaattatgaatctataagttttaattcggcagctaatacagggattccagtttatcgtgtctacaatcctaatagtggttggcatcactatactttaattagttatgaaagagattcgttagtaaaagctggttggcgtaatgaaggcgtggcttggtacgctgctaataatggacaaacaaataatgataattatcgtttgttgggggttcgtaattatgaccaatatgctttgggagcaccgagtggttgtgaaggagctgctttattgcaagctctgcaatataaaggaaaaattactaactggggcttggtacaatttttaaatacaattcccaaatcaacagatggaagtccaaatagtggtttcgtaggtagtccatttgttgaagcatcaaatgtatattcagctatttatccgggtcctttgtcaaattgggccaaaaaatatgatacaaatgttcaaaatatttcaggaacaagcgttgatggattaatcaatgaagttaaaaatggaaatccagtagtggtttgggtaacgattaattttcaaccggttcgttggggtgcttggccatttggctcagcagtaaataataatcaagcagtgactttggatggctttaataaatcaagcaatcaggttcatgtttctgattcaatcagtggctcttattggttaaatcgggcaactttcgaaacaatttataatgcacgcaaatatgctgtcgctgttcgatagtgagttgaaataaagcaagaatgaagattcttgttttttcttttatttaaacttagtccaagttaaaggtaaaatatagtataataaaagtaatataaatttgtaagaagttatgattggttctaagagaaaggagtagaaaatgtttgcacccttaaatacaaaaacagaatacagttttttagatagtgttgttaaactagacgattatttggaaggggctctacgtttaggctataaaacggtcggaatttgtgatgtgggaaacctccatgcagcctttcggtttgtcagaaaagctcaaatgcttaatttacaaccagttattagtattgaattaaattttgaatggcggggtttgccagtttctttttcttttattgctaaaaatacagaaggttataaaaacttacttcggatttcaacatttcataattatgatcgacgtcaattttctgatattcaaaatcatttgtcaggaatcgcactggttattccagaaacttatggggctttaagtgagctatcagagcttgcagcatttgccgacgaagcctatattgggattgaccagcagacagataaaggaactaaatttaatttaccaacccttccttttccagcagttcgttatctgaattttgctgataatgaaattttagctattttgcacgcggtgcgtgatgggctttcctttgacgaaagtttgacggtcagttcaaatgaattgctccaaagaccagaagcttatgaatcttattttcagaaatattttccgcaagcactgacaaatctgtcagtattaacagcaaaaattgcttatcaatttgatgaaaaattggaacttccgagatttgataagaaaagggaagcagttgaacatctccgagaagaagcgattttaggactgtctgcccgacttgaagaaaaaaaatcactgacaggaatttcgtcagtaagtctggcaaatgctttagctgaagaatcaacgatgattgatttgtcagtatatcaggagcgtttagaaaaagagttgtcagtcattcaccaaatgggatttgatgattattttttgattgtcgcggatttgttgcgctatgcgcgtgaacaagacatttattgcggaatggggcgtgggtcggctgctgggtctttggttgcctatgttttgggaatcactcaggttgaccctgtcaaacataatcttttctttgaacgttttttgaatccagaacgagtggccatgcccgatattgatattgatatgcctgatgaccgtcgtgctgagttactggcctatatgaaaaatcgttatggttcagaccatgtagcacaaattgtcactttttcaactttaggaaaaagacaggcgctcagagatgtcggtaaagcttttggaatgaccgaagctgaattatctaatttgactcggatgcttgttcgccgttttggaactctggctgatgaatatgaaaataatcaacgttttaaagccgaagtattgaaaaatggaaaattaaaacgaatttatgaagtcgccagacgaattgagggaatgcctcgccagacttcaacacatgcttcaggtgttgttctttctgaagaatctttggtgaattatgtgtcattaaaaccgtcagaagatttagctttgactcaatatgaggcaccagatgtggaagcgatagggcttctaaaaattgacttcctgggattacgtaatttaactatcatttcgagattacgtgatttggtgaaaaaacgtcaaaaaattgatattgacccgttaaaaatagatttagaagatgaagcgacattggcactttttagagctggaaatacgatgggaatttttcagtttgaaaatccgcaaatgcgacgttttctaagaaaccttgcaccaagcaaatttgatgatattgttgatgcaacctcgattttccgtcccggtccatcacagtttattccacaatttgttgccagacgccatggaaaagaaattgttccagttgtcgatgattctatcagtgaaatcttaaagccgacttatggaattatgatttatcaggaacaaatcatgcaagtggctcaagcttttgccggattttctcttggaaaggctgaccttcttagacgagcaatctctaagaaaaaagggtccgagttggagaaactgcgcgaggatttcttaatttctgcaggagaaatgggtcattctaaagaaaaagcagaagaaatttatgacctgattgaacgttttgccaattacggcttcaaccgttcgcatggcttcgcttatggagcgcttgcttttcaaatcgcttattttaaggcacatttccctgatgaattttacgaaatacaattacgtgaccgtaaacgggaagtcatgattttagatgctttggacaatggttttgagattgaaaaaccaaatattaatcagatgaaaattggtgattttgtaaaaaataaaaagattcgattaggattagctcatgttcaaggaatttctcgcgatttggcaaaatggattgttgaaaatcaatcatataagaatttggcagattttgttgagaaattacccaataattttcataaaaaagaaagtattctaccactaatccaaattggtgcttttgattatgctgattctaatcgagggaaattggcttataatttggctgaccatgctaacttactaaattattatagtgatgatatttttatggcaagttctggtggcggttttgcttatcatgaagcagaggattattcagaaacagaaaaatatgattttgagaaaaatctgttagggattggtgtaacgccccatcctttacaaagtttggctcagagattctcaggaaatttcacgccaattgctaatcttgtcaaaaatagtagaatgacgattttggttgagattaattatattcggacccatcgaacaaaaacagggcaaacaatggcatttttaactgtgtcagatagtcgtgagaattttgatgttactctttttccagagatttatcgtcaattttcgagtgagcttgagcaaggaaaattctacctgattagtgggaaagtaaccgaacgtaatgatgaattacagcttgtcgctgaccgaatgagtccagctttggaaactgataaaaaactttggttaaatttaagagatgagaaatataatcaaaaaatttcgcaaattttatgtgaatttccgggttctcatcaagtgattcttcactattcaaatttgaaaaaaacgattcaaacaaagatttatgtggaagagtcggagtttttgaaaaaacgattggaaggatatgttattggtatagtttataaataaaaaaacccgcttagcaaacggtttttttattttatcccacataaagataaacagagaagaacatgaggattgcagccagtaaaacaaagaggtgccaaaccacgtgagcgaaacggaatttaaaatgatagataagcgctccgacggaataaaccacgcctcctgcaactaaaagccaaaatccaactggatgtagggcattccataaaggataaatgacaatcaaaatcatccaaccaagaacaacatataaaacggttgataatttaggagttttaccccattttggtaagtaaattgaagttaagacaatccctaaaatagaacaaatccaaatcactgctagcacaatccaacctaaccaattatttaaagcaactaaacagtagggcgtgtaggttccagcaattaaaaagaatatcccgttatggtcaaaaactcgaaaaactttgaccgctttagtaaaatgtaaactgtgtgctaatgtggaacacagaaaaagaattactaatgaggctccatagattgtaaaagcaacaacttcaagtgcagacccagaagcagcacctttaatcacgagaagaactaaggcggcaattgctaagccggttcctgctccatgagttatcgcattgaaaatctcattgagaatctgataggttcttgaaccttgtgtttcttccatttgttctctccaatttattgatttattcagcttttgagcaattttatgatttgttttgaaatcaaaaaaataatattttcaaccttttttgctctttccaactgaaaatttgttataatatatgatagcacaaattgtatagaaaaggaattgaacgaacgactctctcatatagagtgagcgtaagttcaaatagtaaatatgccaataaaaattgtgacagattcatccattacgattgagccagaacttgctcgcgaacttgacattactattgttccgttgtcagtaacgatcgatggaacaatgtattcagacgacgacttgaagtttgaagatttcatggtcaagatggctgcatcaaaaaacttgcctaaaacaagtcagccaccagttggtgtttttgccgaggtttatgaaaaaattgctgctgaggatgatgagattatctctattcatttaacagaagctttgtcaggaacagttgaagcagcacgccaagggggaatgctttcaggacgtaatgtcaccgtcattgatagtgattttactgaccaagctcaaaaattccaagtggtcgaagcagcgcgtctcgcaaaaactggggcaaccaaagaagaaattctagaaaaaattaaatatattcgggaaaatactgaacttttcatcggattttcaactttagaaaatttggttaaaggtggccgcgtcagtcgaatgacaggactttttggaagtcttttacaagttcgggtgattgggacattaaaagaccgcgaattaaacacacttttgcgtggacgtggaagcaaaactttttacaaatggcttgaagaattatcagatactatcagtagttctggacgtaaaattcgtgaaattggaatttctcatgcgcaaggtttggagttttcacaaaaagccaaagatgtcttacaaaaatttgttgaaaaacctatttcaattttggacaccaatacaacaattgccacacatacaggtcctggggcttgggcaattatgattgattacgaatgaaaaaactaatttgcaattttattttttgaaaaactagggaggattgcaaagaatatgatgaagaattttatacgtacatttgccggctttttgctggcaattttgctaattttaggcttgtttttacttgcttttccaaaagctggtgaccgatttagaactgagaagaaagtatcggctttgtcagtaaaacatgtgtcctatgctgctttgggagattcactgacagaaggagtgggggatgctactggacaaggtggatttgttccactttttgccaaagagattgaaaattctactggcggctctgtcagtagtcaaaatttcggaaaggctggagatacaagtactcaaatctataatcgcatgatgaaaagtaagaaaattactgatggacttaaaaaagccaatatcatcacgattacaattggaggcaacgatgtactaaaagtcattcgagataatgtgactaaattatcttcaatgactgaaaaggactttgttaagccagaagagctttatcaggcaagagttaaaaagttattggataaaattcgtgaagataatcctcaagcacaaatctatgtcttaggaatttataatccattttatcttaactttccagaccttacggtcatgcaaaatgtgatagatagttggaataccgcaactgctggtgttgtcagtcaagaaaaaaatacttactttattccaattaataatttactttataaaggctcaggagataagcaggcagttgaagcggatagttcaacgagtgcggttgctaataacttactttatactgaagaccatttccatccaaataatatcggttatcaaattatggctgatgcagtctttgcaagctataaggaggtcaaccagaagtgaccaaaagattaaagaagcaagcaaaaccagtcgtttttctaggcattgttattggttgtgcacttattgtgtcaggagttcttggtctgtcaggacatttaaataatcaagaagcaatcaaaagtaaaaagaaaaatcaagtttcagaaacaaaaactaattcaagtagtcaaaataaaagtgaccaaaaaatgccaaaaatgactttagaacaaaaagtgggtcagttatttatgacggggatgcctgcaaataactatgaccaagcaacttttgatgcgattgaaaaatatcaggttgggagtatcattttgacgggccgctctaatctcagtattcctgaaatgaaagttattactgacaagctacaaggcttagcaccagctaatcgacgtcttttgatttcttgtgatcaagagggaggaaacgttcaggttcttcaagggactggtttttcagaaatgcctaatggattgattcaaggaagttgggcgccagaaaaattacaagaagaagctaaaaattgggggagtgaactttcaaccgctggaatcaattttgatttagccccagttgctgaccaggttttatctgctgattttgcaccacaaaatgctccgattggctactggagtcgtcagtatgcttatgacaaagctaatattgtcagccatgccgatgctttttctaaaggaatgaaatcagctggtgttttaacaaccgctaagcattttccagggcttggagcggtgacaggtaacacggatatcagtgctggcgtcagagatagtcaaacaaatcctaaaagtgaatccgttcagatttttaaagaattaatttcttcgggagttccatcaattatgacggcgacagcaatttatgatcaaattgcccctgagcttccgggagccttttcacctaaaatggttgatggcttactccgaaatcaattaggctttgatggtttggtaattactgacgatttatcaaacgctgttcaagttcaagcttggtcaccaggccaaagagcagtattggcgctggcagcgggaaatgaccttgtcctagccaatgagcccactcaaattccagaaatgatttcagaagttttgcaaaaagcaaaatctgatcagggatttgcagaaaaaattaatcaagcatcatcaagggtgatgaaagtaaaagaacaaatgaaacttgtagaatagagaagcaaatggaaaataaagaaagtcaaaccagaaaatctaaagcaaaggattcaaagaagccaaagaatgaagctgaagaaaaagttaagaaaagtgcaatttggaaatggctctttcttgtgcttttagctattaatttggctgggatagtatttgtagcaatccgcgtcacgacacccagagatcagactgttttgaaccaaaaatcagtcagcagctctgaccaaaaggtcgctcaaatcagtagtaccacttcacaactcaatgaattaatcaacagttatttagaaacttaccaaacgaaagaaatgacttataagttctatatttctaatcagcaagcagttcttgaggcttcttataaactgtttgggactaaaattcccttgtacatctattttgaacctttggcattgtcagacggttcaatcagtttatctgtccaaaatatctctgctggaagtttgagtttgccgacctcagaagtattacaaattgttaaagcatatgatttgccagactttgtacaagtcgaaagcaaaaaaaatcaaattgtcattaatttaccaaaaattaagcttgcaagtaatctttatattaaagttaatcaaattgatttagttaaaggaaattttatctttgatttcatgaaaaaagcctgaaaaacgccttaaaatggcattttgacttgcaaactgggctaagatttgctaaaatgaaaaatgcctatgtttaaggtaaaaaacaaatggaggacatttctaaaatggctaacaaacaagatcttatcgctgaagttgcagcaaaaacaggattgactaaaaaagactcagaaaaagcagttaatgcttttggtgaagttgtaactgaattccttgcaaaaggtgaaaaagttcaattgatcggttttggtactttcgaaactcgcgaacgtgcagctcgtgaaggacgtaacccacaaactggtgaagcaatcaaaatcgcagctacagttgttcctgcattcaaagctggtaaagcattgaaagacgcagttaaataattagtagaacttaacatcaagtgccgcgttcttcgtggtactttttgttttgcttaaaaatataaaaggggcacaaaataaaaaaaatatatctgagatatattttttgtctatagttccttcgtaaaaaagatttctgtcaccacttcccctagattttcctctttgaagattcctgtatcagaaaagaccatttttttgtaaaaattaatagcattttcattagtgtttagaacccataaacctactttggaatatttttctgttacaagctgctctaaagcaaattcaatcatttttcttccgattttattttttgataggcgtcaagcagataaattccttgaatttctcccaaattctcttgaaaagaattttctcgcagactaccccaacaacaaaatccaactactttgtcatcagcaatagcaaccactgtgttggcacaatgattatttttaaaaatagttatacttgattcaagactgcgtttgtctaggaaacttttaggtaataagccatgataagtttctaaccaagccttatagtgaacaaaggcgatttcttgaaaatcttctggtaaggctttgcgtaataatactttcatcagatggttcctcatttatttttttaatattatatcatttatcactaataaaataaaaaattgattatggatgatgaacttttaaagaagaataatgaaaaagccaaatagtgatgttttatagtcgatttttttgttatactaatgattataaaaaataaggactaaataggagaggacgaatgttatataaagcaagttatcaatcccccttgggagaaatgagtcttctgagtgatgagacctatttgctagggctatggtttaatgaacaaaaatattttggttcagcatatgatttaaacttagcccaaaaagatgaaagtttaccaattactgaagcaattgaatggttaaatcagtattttagaggagaaaatccgaattctcaaaaaatcaagttaaaaccggaagtaacagaatttagaaaaagggttcttaaaatactcagtgatattccttatgggactttaatcacctataaagaaatttcaaatcttcttcaaatcaatgatgaaaagaaacgaaatatgtcgcaagctattgggggagcagtcggtcataatccaatatctatcattattccttgtcatcgagtagtgggcagtgatggaagtttaacaggttatgcgggtggcttagataaaaaaagggcgctcttggctctcgaacaaaatagtttaatcaaataaataggagctttcatttgaaaataactgatgaaatctgggaagttattaaagataacgataaaaaacttgataataaactgtggtatggagtggcaacaaccaagattttttgtcggccttcttgtgtatccagattacctaaaagagaaaatgtaagtttatttgattctcctaatcaggctcaaaatgagggctatcgaccatgcaaaagatgtcgacctatggatagaattgttccaaatgaagtgtggattgaagaaattgatgcaattttgaatgagcattatgatgaagccttaagccttgaggaactcgggtataagctacatggctctagctcctatttacgacatgtttataaaaaaataaaaggaataacgccacaacaacaattgatgacaataagactagaaaaagctaaagtaaacttgctgacaagtaatgattctatttcagaaattgcccaaagagttgggatggcgaatactccttattttattaaagtttttcggcaacattatggaagttctcctaatcactaccgaaaaaaatataaaaagtaaaggataagtaaatgataaacgaaaattttatgctgacagaagaacaagtaaaaaaatatttaaaaagaatcaagatgtcatatcccatagaagctacattagaaaatctgcataaattacagttaaatcatttaaaatatattccttatgaaaatttaagcattttgtatggggagcctatttcactagatggacaagacttgtatgaaaaaattattgtaaacgaacgaggaggattctgctttgaaacaaatgctttatatcaatggttacttaaagcaataggttatcaagttacttcttaccatactcgattgattggtctaccgccagaagaacaattgaagcgtcatcgaatgataagagtagactttgctgatgcttcttatatcactgatgtgggaattagaatcgctctgtctcgaaaagccttgcgtcttgaaaaaaataagattcaaacggatggttattcagattttagatatttgtcaggggaaaatcagggctggaatatgcaatataagcggaaaaatcatgattgggaaaatgttttttcttttcaccaagaagcagagtatgaaaaagattttattatgccagccttttattgtgagaaacatccagagtcgccctttaggcaaggaccacaaatgtcaatttttactgacaaggggcaaattacgatagctaataaacttttaataatcagtaatgagacaaaaattattgagagaagggaattgtctagtgaaaaatttgaaaaatattgtaaaaaatattttcagataaacttaagtgattttcaacatatttgaaagataattagaatttataaaaggataggataatagcttgtccttttttattatctaaataataaaaaatattttatccctaattattgtcaatttatcccagagttttgggaagtgattttagtatattaagctaaaatagcagtatgaaaataaaaaatatagaaaaatcctatggtaaaaatcaagtgctaaaaaatattagctttgaactaaatcaaggagaaaaagttgctttgttgggcaataatggtgctggaaaatcaacattgatgaatatcattaatggtaatcttgaggcttcatcgggacaaattgattatggaacaatgaatctgacatcaaataatacaggttatatcatgcaaaatatgaccctacctcctgatgctttaggaaatgaagttttatctctatttgcgcgtgatgagaatgctaagaattatgggagaagattagttaaagaattcagaatggaatcatttttgaatcgaagattttctaatctttctggaggatagaagcaaaaactatttttgatttcagctcttcaaaatagtccagaatattttttcttagatgaaattacaactgggttagacagtgaaagtagagtagaactttttaaatttttaacatcaaatttgaaagtgaaggaagccactttacttttagtgacacattatttggaggaagctttacaattatgtgatcgtttcattattcttaaagagggtcaaattattgcggatttgaaaaaatcagatttgattcaggaagacttttcatatttagagtgctcaatgaatatttcagattttgaagaatataggattaaagaatatcaatataaaatccctaaaaaattagctgctgaagcactcgttagatttagtaaggaaattgtcttatatcaaaaagactatcgaattgatttggaggaattattgtcatgaaatttttaaaatattttgcatttggattgcgattacgctatcgaaatccttcgcaaatcttctttgtctttatttttcctttgtttttaatgtttgctttttcctcaagttttggaaaaagcgttccccactatattgaaaataatattgcttcaatacttttatatagtgttctgtcagcaagtttaacctcactttctgttcaaatagcagaatatcaatctggaaagatttatcaattatttattcagcgaggcataaagaaaatattttatatagcagcacaaatcgccagtttcatgatcattattttttgttcaacaatcgctattttattagtcgctcatttttcttatcattatgattttcctaagctgagtattttactggttttttatcttaaactttatttatattcactgccattttgcttattagctatcattattggacttttagccaaaaatacggcgacagcaagtgcaattgcaatgccgattatgtttctttcattcttcttttcgggaatgatgatcccattatcacagctttcgggaggaatccggaaaatcgctgatcatttttttcttactcagttactttcagatttaaatcataccttaacttcaacttacacggttattctaaattggtcagtcatcttactaagttttggagttctttgccttttgagcatcattgtttataagaaaaaggcctaatgatagaagctgctttagttaaataattgtttaagtaagcatttctttatataataaaaaagtgaaaataaaaaaacaaattgatcctaatataaaggaatcagaacttgtgattattgcacgaacagaagaggaattttcacaagtagtcaagcaatatcatttgcaagatttgactgcaaacgaagaggataaactctatttagcaacaaatcaaggttttgagattattaaaataagagaaattctatatataaaatcaatattttagtagaatgaaagaaccaaattgtaaaataaaagaggttgtgttatgaataaagaagctaaacaagccatgaaaacaacactttggcatcctgattttgaatcagatgcttgtggaatgggctttattgctcaaattgacggaaaagctagtcatctcttagttgaaagagcgctgaccatgttaacaagaatgaatcatcgtggaggaacaggtgctgaacctgaaactggagatggagcagggattttacttgctttacctgatgaattctttcgtaaaattgcagcagagcaagagatagaattgccagcaattggtaattatgctgttggccaatttttcttgtcgcgcaaagaaaacaaaaaacatcaagctcttgaagcgataaaagcggctgttaaggctcaaggatatgatattctattcacgcgcacagttccctttaattatgaagcttgtggggtgacagcccaagggattatgccttcttttgtgcaagttttcattgaaaaaaaagctgtcagtgaagctaaaggaactgacaacaaaaattctaactttgaaaatgatttatttacgattagacgaaatttggaaaaacgttttgatgaagaagaattatatatttgttctttatctagtcaaacagtggtctataaaggaatgcttcacgcttatcaagtgaaacttttttatccagatttgtctgacgaagcttttaaaagtcatattgcgctgacgcacagccgtttttcaacaaatacatttccctcatggaatcgggcgcagccttttcgctttttggcacacaatggcgaaatcaataccctgcgtggcgctgaaaactggatgaaagtcaacgaaattgaaatgtataatgaagaaaactcggattcggcaaaattagaaaattgcatggagtatttctatcgcaatggacgtgaattgccagaaagtttgctggccatgattccagaagcttggggcgagcaaacgggtctaagtccagaactcaaagctttctatgaatattcaacggctcatattgctccttgggatggcccggcagctttagtttttactgacggaaaaaccgttggggcaaggttggatcgaaacggtctacgtccaagtcgctatctggtcacaaaagataatttcattatcttatcaagtgagtcaggtgtggttgatattcctgccaatgaaatcattgaaaaatcagttcttggtcccggaaatatgctcctggtaaatactgacgaaggaaagattattcgtaacgaagaagtcaaaagttactatgctaacaaatatccctatcaggaatttctgtcagcaggtttgaaaaatctgtcagcgctgacagacagccaaaagataagttcaattccgtcagcaaaaatgaatacattatggaaattatttggatatactgacgaagtcattcggacggtgcttttgccaatggctgaagccgccaacgaacccacgatttccatgggatttgacgcacctttggccgttttatctgaccaagctcaatccctttataattttttcaaacaacaatttgcccaggtcaccaatccgccaattgacgccattcgcgagcaaattgttattgggacagaaacttatctgggcgaagatggtaatcccgccaaaatcacaggtgaaaatgtccgtaagttaaaattagacagtccggtactttcaacagccgattttgaaaaaattcttgctttgaaagaaaaacattatcatacagaagtcctttcaaccctctatgataaagatgacttattagaaaatgctctaaataaacttttttataaagcagaggaattgattaaccaaggggcaacaattattgttttatcagaccgtgattttgccgaaaataaagtaccaatgccaattttattggctctgtcaggactttatcattatatgcttggtcgtcataatgcttccaagtttgcgattattcttgacactgcagaggtttatgaagtccatcaatttgcagcattagtgggttatggcgcgtcagggattcacccttacggcgcttatgcgacgctttcagactggggaatgggcacagctgaacaagtcgaaaatttccggcatgcggcagaaaaaggaattgttaaggtcatgagccgaatgggaatttcaaccattgttggttacaaaggggcgcaactttttgaagctattggtttatctaaagaagttgtcgataaatacttcacaggaacaagtactcgaattggtggactttctcttgctcaaatcgaggcagagtatcgcctccgttatgaaaaagcatacggacaccgaggacaagatttgttggaaacaggtggttccttccagtaccgagcagatgaaggtgaacatcatatttatgatccaacaatgatttatcaaatccagaatgctgttcgtcaaaatgactttgaaaagtataaaaaatatagtcagtatttaaatgatattgccttggaaacccccacaagtttacggcacacatggaaaattaaatctaatcgcaaggctattcagttgagtgaggtcgaaccagtcagtgaaattgtgaaacgttttaaaattggcgccatgtcgtttggttcactttcccaagaagctcatgaatgtatcgcacaagctatgaattcaatcggtgccaagtcaaattctggcgaagggggtgaaaatgcgaaacgctatggcacaatcaataattcgaaaatcaagcaagtcgcctctggtcgatttggtgtgtcagcggcttatctgatgtcggctgaagaaatccaaatcaagatttcacaaggggcaaaaccgggagaaggtggacaattgccaggtaagaaagctttcccttgggtagccgaggtaagaaattcaactcctggggtgagcttaatttcaccaccacctcatcatgatatttattcaatcgaagatttatcacagctcatatttgatttgaaacaaatcaatccttatgcaaaaatcaatgtcaaattggtttcttcaacaggcgttggaacaattgcgacaggttgtgttaaagcgggcgctgacaaggttgtcatttctggttatgatggtggaacgggcgcaagtccacgaaattcaacgagagacgcagggctgccttgggaaatgggcttagcagaagcgcatcaaacccttagtttgaataaattgcgggatcgtatgattttggaaactgatgggaaagtcgtgacaggaagagatgttgctattgctgcaatgcttggagccgaagaatattcatttggaagtttagctttagttgcgattggttgtatcatgacaagaaattgtcatttgaacacttgcccagttggtattgccacacaaaatcctaaattaagagccaattttgctgggaaacccgaacacattgtgcgtttaatggaatttatggctgaggaagttcgagaacttctggctgaacttggttttagaaccattaatgaactcgttggacatgcggagcttttgcaagctaaagacgatttgccagataaaatgcgtggtttagattttagtcgtatcatcggtcatgctttaccaatcgccacacgacatagtgatccatttgctaatccgcgtgcttggcaagagctagaccaatttacccaagcaactttggacaatggtgctcaagccactgttcatggcaagattcaaaatactaatcggacaacgacagctcgaatggctggttggattgctgaacgttatggcaattttggcttaaaagatgcttcggttgcctatgaatacgaaggggttgcgggtcaatcttttggctcttatgcaactgccggaatggaagtcactttgattggtgaagccaacgactatattggtaaatctttatcaggtggacgcttgattgtgaagccacctcttgatgcggcttatgatattgaaaatacctcaattgtgggtaatgtatccttatttggagcgattggtggagaagcttacttccgtggtcgtgctggggagcgttgtggtgtcagaaattcaggggcacattttgtcgttgagggtgttggcgaccatggttgtgaatatatgactggtggtcttgcagttattcttggtacaactgggcgtaactttgctgctgggatgtctgggggtcttgcttatgtttatgatgccgatggcacatttgcttctaaagtcaatcgagaaatggttgatctttatcgtttagatgaaacatcaggcgatgaagtattagaagaattactaaaaaaacatctgatttacaccgattcagctaaagccgaatacattttagaacattggcaaagtgaatgtgaaaaatttgttaaagtttacccgcgtgagtatcatcacattaaaaatattgaagaagatttggctaaaacaggattgtcaggcgaagcacttacaatgacaacctttaaaaaagtaacggaggtgagctaatggctgatccaaatggatttttaaattatccaagaaatgataatccttaccgtgaattagcggagcggataaaagattttgctgaattgcaagttcccttatctactgaagaacgacaaaaacaagcggcacgttgtatgcattgtgatgttcctttttgtcatcaagggatattttatgggggcaaacgagctgtctcaggctgtccaaatgataatcatattccagagtggaatgatttgatttatcgcggtctgcaaagaaaagcttatgaacgcttgattttaaccaatccatttccagaattcactggacgagtctgtccggctccttgtgaaaaatcttgtgccgaggccttaaacggtgcaggagtaaccattaaagataatgagcgattcttaggtgatttaggaaataatgaaggttgggtagctgaaattggcaaagcggcaaaagcaacaggttataaaatagcgattattgggtctggacctgcgggtctgtcagctgcttggcgtctcaatcaattgggacatagcgttactgtttttgaaaaatcagatcgtttgggtggcttattgatgtacggcattccaaatatgaaattggataaaaaagtcgttcaaaaacggattgatttaatgacagaacttggcgtgacttttgtcacaaatagtgaaattggaaaaacaatcagctatgaagagctgtcagtaaattttgatcgaattattctggcgattggagcaggagttcctcgtgatttaaaaatttcaggtcgtgaattgtcaggtattcgttttgcgatggattttttgacagaaacaactaaaaaagtgttggagcatggcgaaaaaaatattgcccaatctcttaaaggaaaaaaagttgtggtcattggaggtggagatacaggaaatgactgtattgggacggcagtgcgcttgggtgctgaatcggttcaacaacttgaaattacaccgagtctaccaactaatcgcttagaaaacaatccctggccggaatggccaatgaccttaagagagggttatgggcaacaagaagctcaatttgtaggaaattcagatttgacgacttatcagatgacagccacagcttttaaagctgatgaaaatggtcatctaaaaggcttacaagtggcaaaagtcggtccagatttcagagcaattgaaggtagtgagcaattgattgaagcagatttagtcttgcttgcgatgggatttgtgggtacggacacaggcttgcttgataaatttggtgttcaagaaatttatgatgattatcgaacaaacaatgataaagtacttgtcgcgggtgatactagacgcggtccttctttagtcatttgggcgattagagaaggccgtaaaaccgctgaaattgttgacgaagagctactgaaagtagccacggcataatttataactctgtcagtaaaaaagtttctgtcagtaaaatgatgggaacttttttgtgtttaagtttttgacgatatgctatacttataaataatctaaaaatgaggtgaaaaaatgaaaacaccattcgtaacaaaagaacaactcgaacaaattacagctgaataccccactccttttcatctttatgatgagaaaggaattcgccagaaagcgcgtgatcttcacaaagcttttgtttggaataaaggatttaaagaattctttgctgttaaagctacaccaaccccagcaatattaaagatactacatgaagaaggttgtggagtcgattgtgcttcttatatcgaactattgctttcagaaaaatgtggttttgatggcactgaaatgatgttttcatccaatgacactccagcagaagagtttcaatttgctaatcaattgggcgcgacaatcaatcttgatgcctatgaacacattgagtttttgaaaaatctgccagattttgtctttccaaagacaatgagcttgagatacaatccaggtggagtttttgcgatgggtacaaaaatcatggacaatccagaagaatcaaaatttggtatgaccaaagcacaactcattcaaggaattaaagacttacaaaaactaggagtcaaagaatttggaatgcacagctttctggcttcaaatactgtgaccaatgattattatccagaactcgcccgcaaactctttgaacttgaattagaaattcgtcaagaaacaggagtgacgcttgattttattaatttatcaggtgggatcggtgtaaactatcgtcctgatgaagaagctaatgatatcgcaaaaattggacaaggtgttcataaggcttatgaagaagtattgactgctaatggcatcgaaaatctaaaaatttacacggaattaggtcgttttatgcttgcacctcatggtcacttgattacaaaagtcctgcatttaaaagaaacttaccggaaatatgttggggttgatgcatcagcagttaacttgatgcgcccagctttttatgatgcttaccatcacatcacagtcgctggcaaggaaaagcaagaggcgactgaaacctatgatattacgggttctttgtgtgaaaataatgataagtttgctaaagaacgtgcttttccagaaatcaaagtaggagatttgttggtcattcatgatacaggagcacatggattttcgatgggttatcagtataatgcgaagctaagaagtgctgaaattttacttcaagaagatggaaaaacacgtttgattcgtcgagcagaaaatccagctgattattttgcgacattagatggatttgatttcaacaattgatttataaaagttactgatgattctgtcagtaacttatctttttctcagtccttttgtcactaatataaagagctgacaaaaagactaaaatttgatataataagatgtcatcaatggcgaaagcgtttcgccaaatttaggagattcaaaatgaatttaatcttagctattttgcttatggttgtatgccttttggcaggttttttcttgggaacatggttctcacaacgccaaacaaaaaaattacttatggacaacccaccccttaacgaagatgccgttcgtcttatgatgggatcaatgggacgcaaaccaagtgaagttcaagtgcaacaagttcttcgtcaaattcgtgctgctgcaaagcaatcagacacaaacaaaaaataagctattataatacgctgagcgaagcagtagaacaaagttctaaactctctcagcgtttgcttttatcatcgtaaaaaaattatccaaaaaagacttcgcttgaaaattaaaaagcccaaaatgattttggatatttcaaaaattttgaattagatattttaaaaggagaagaaaaatggacaatcgaccaatcggcctcttggattctggtgttggtggactgactgttgctcgcgaactccttaggcaactcccaaatgaagaaattgtctatattggagatacaagaagggctccttatggcccgcgcagtcgtgaacaaatcattgcgtttacttgggatatggtcaattttttactttcaaaaaatgtaaaaatgatcgtcatggcctgtaacacagctacggcgatgactttggaaatcgtcaaagaagaattggatattccagtgattggggttattttacctggggcaagctcagccatccaaaaaacgaaaacaaacaaaattggagtgattgctacccaagcatccatccgttcagatgaatatcataaaacaattgctcgcaaatcgtcagctattgaagtcttaagtcttgcctgccctaagtttgtttcaattgttgaatcaaatgaaatggaatctgaaattgctaaaagagtggtctcagaaagtttggctccactggttggaaaaatagatacattaattctaggctgcacacactacccacttttacgttccttgattcaagaaacaatggggaaagaagttcgtttgattgattcaggtgcggaagcagtacgagatatttcagttttgttgaactatttcgaaatcaatgctcacgagcgcaaggaatatcagcactgtttttatacaacagcaggggtcaattcttttcgagaaattgcagaaaaatggttaaatataggacatcttcatattgaacatgccgaaatagagaatttcaataaggaaaaataaatggaaaatacacttattattgcgactagaaatcctggtaaaacaaaagaatttaaaaaattgtttgctgactttggttatgaaattaaagacttatcagactacccagaacttcctgaaattgaagaaacaggaagtacttttgaagaaaatgctcgcttaaaagcagaacaaattgctgagttgactggacaagtagttattggagacgattcaggactatgtgttgatgtactaggtggtttgccaggcatttggtcacaccgcttttcagcaccagaccctactgatgagaaaaatattgccaaacttttgcatgaacttgctccgacagcaattacaccagaacgtagaagcgctcatttccatactactttagtagcggcaagacctaatcacgacagcttagttgttgaagctgattggaatggctatatcgcccttgctcctaaagggggaaatggctttggttatgatcctgtttttatggttgatgctttcagaaccgctgcagaattatcagaaaaagaaaaaaatcaactttcacatcgaggtcaagcactaagaaaattaatgcaggaacttccagaatggttagagaaataaatttaacataaaattaattatgtaaaagagaggtgcttatgtttgtagtaatgtctgattcacactatgatcgtgaagtggttgaatctataaaatctaagtatttgaacgaagcaacagcaatatttcattgtggggattcagaacttccgagttctgatgaaatttggaatggaataactgttgttgcggggaactgtgattatgatgatggctatcatgattttcttactcaaacggttgagggaaaaaaggtattaattacacatggtcatctctattatgttggtttgggcctagaacggtattcttattttgctgaagaacaaggggctgatattgccttatttggtcatattcatcaaccagtagcgcaaaaaataaataatattctttatgtaaatcccggttcggttgcacaacctagagggaagtatgatatcaaaatgtatgctataattgaaattgatggagatgaatttatagtttcttatcgaaatctccaacatgaacctattcctgaactacaatttagactctgagtctacaaagctctttaaggagtaacttacatgattgataaaaaaattgaggattttattttgaatcaaagtgaaacctttatgattccagcctcaaatgtcgctgtactctacgcagagcataatatcgcacatgcgaaacttatgcttagccagtacaaatattcacgagttccagttttgaatgaaagaaaagaatatgtgggagttttaggtttaacagaaattgttgaatttgaaatggaacaaaatttcttttttgaaaagttacacaatacatctatttctgaaattgttaacaaagaggtccaaacggttggtcccacagtaactttggaagaaatgatgcacaaattaattaaggagtcctttctaccagttgtcaaaaggcaggaatttatgggaatcgtagttcgtcaagaaatattgaaggcttttagtgccttcgctcacgactttacaaaatattatgaaattaccaaacgagattgaggagtatttagtaagtagaaacttttctgaaaatactcgctcaaattattattatgacttagtctatttgcaggctttttttgaagataagtctgtcacacaagaagcactagagctttacaaacaccagcttagtaaactctctcccgcggcacaacgtcgaaaaatttcgagtgccaaccaatattttctatttttatatgaaaataaaaaaataaaccagtttttcaaaattaagcaagttgttcagaaaaaaactcaaagttctgagagttatcatcctatgataaaagaatttccagaattttatggacctctaagctgtccaggccaatttttagctttattgatattagaatttggtcttaattttgcagagattcaaaaattaaaatgggaaaattttaattggaattttaaatatctcacaatcgaaaaagctggaataaaacgagtcttacccattcgagaaaaatttgccatcagagttaaggccataaaaaatgccgatgaattatttgcaaaatctcgccaattcctatatacagaattaaagaaattcactaattattcttctaaagagattagggaacagtatattttgcatcaggtaaaagcgggaaaaacaatatatgagttggctaacttacttggcttaagcacaattactaccttagaaaaatattatagataggatttttacactattttaattatgtaaattatgatcaaagaaatcaatataaaaattaaaaactttgagggtccgcttgatcttctcttacatttagttagtcagtacgaaatggacatctttgaagtccctttagtaccggtgattgaacagtaccttatctatatccaaacaatgaaagaacttgagttggagttggctggtgaatatatgctgatggcaagtcagttgatgttgattaaatcaagaagacttttgccaacggtgaccgaaacatttatagaagataccgagcagcttgaatatgatttattagctcaaatcgacgaatatcggaagtataaaatgctttcagaggatttggacgagttacatcaagaacgtagtcattattattctaaatcgaaaactgaaatcatcacagatgagacagtcttattgcaagataaaacggcattggatttgttcttagcctttagtaaaattttggaattacaaaggcaacaaattgaagatgataatacaacgattgcagctgaaaaatttacgattgcggataaaatattcgaattaaatcaaagatttacagaacaaaaaatatgtaaatttacagatttgttttcagataaaaccaaaaaagatgaactcgtcacaacatttatggctcttctagaattgattaaaaatcagcaagtttctttttctcaaggagagctctttggagaaattattttagaaagaaaagaaattagtgaataagacagcgacatgtgaacttttactttttgtatctggagaagctggtttaacattgacagagttgtcatcactgacagaaatgtctaaacaagcttgtcagcaacaaattgattatttgaaagaaaaatatcattctgatagagaatcagctttgacaattattgaaacggctggaaaatatcgtatggccacaaaagaagacttttcagagattcttaaaaattatgcgaaaaccccacttaaccaatctttgtcaaaatctgctctagaagttctttcaataattgcttacaaacaaccattaacgcgtattgagattgatcaattacgtggagttaactcgtcaggtgttctatctacgcttcgtgcttttgatttagttgaaaaagtagggaaagttgaagcaccgggacgtcctagcctttatgcgactactgaatttttcctagattatattggtatcaataatttagaagaattacctgaaattgatgagtcaagatatgtggcagaacaacaaaccctatttaacgaaagtgaagaaaatgagaatcaataaatatttggcccatgcaggagtggcaagcagacgtaaagcagaagaactaattttggcgggaaaagtgacagttaataatgtcccgatgacaaatttaggttatcaagtttcaactggagatgtcgtcgaagttaatggagtggcagtttataacgaagaacctgtttattatctattgaacaaaccaagaggttatatttcttctgtccgtgatgataaaggacgtcaaacggtgatggatttaatgcctcaagttaaagaacgtatctatccagtagggcgtttggactgggatactagtggcttacttttactcactaacgatggtgaattcacaaatatgatgactcacccaagtcacggtgttgataaagtttatgtggccaaggttgaaggacaagcgaacaaagaaaacttgcgtcccttaacacttggaatgacgattgaaggtaaggaagttagcccggctcgttatgaaattatcaaacaagaaaaaacaaaaaaccattcaattgttagcttaacgattcatgaaggtcaaaatcatcaagttaagaagatgtttgctgctgctggacttccagtacaaaaattaagtcgtattcaatatggaacacttacattggatggactgcctacaggacaattccgtcgtttgagtaaaaaagaagtttctcaattgattaatgctgcgcaaggaaaatagtttaaataaaataaagacaattctctataaagagttgttttttatttcttaaataaatcttattcttgatatgctaagtatttttgtgctataataaaaatatcttcagggcaccgtgtaattcgggaccggcggtaaataaggctttgaccttatgactccgcgattcgctacggcgattgaagcagtgaaactctgctagcgacagtaaagtctggatggaagaagatgaacaatttttgcagagtaagtcgacctcggtcgacttactgtttttagctaaaccaaaaatgtctatcaacttcctcgaaatttgaagaattattttctcatatttggaggtttttttatgtctaaaacacgtcggatggtattaattgccatgcttgctgcattatcaacaattttattgttgccaatcttgcagtttccgttattgcctggaattgattttatgaaagtggaactttcaatcattcctgtacttataggagtctttactttaggattgggtgatggattcattatcctctttattcgctctgtcttatggtatcttctatttaatcaaggcccatcaacatggattggagttccaatgaactttgttgctctaggaattttcatggccatcatttggttctttacaaagaagaagttttcaattaaaaattatacagttgggattgtcttggcgactattgcttcagtccttgtaatgatggtattgaatgttttctatgctctaccattgtaccgtctggctgcaggatttgatgttgacaaaatttttgctggagcaacacatctctttaacatgggttcgctatcagttactttaaatccaacttacctcttaacagttgttttacctttcaatgccttgcaatatatcatttttacccttgttttcggcttgattgttactgtattcaaaaaaaataaagtagtaaaattttacaatgcttaattcaaaagattaggcaaataattctaaataaaaatacggtgggactttcctaccgtattttttttattttataacttaatgattcaatatgtataattaaaaatacttgaaaaatttcctaaagaaacatttttattgtgttacattaaatgtatttaaggatattttttatcaaaaaagtagttgcttaattcaaactaaagcgctatactatgggtgaaatattattttgtcggaaaataatgaattaatggaaaaattacatatgtgtttctttgattattttaattattaaaaaaagaggtgttttatgaacatatatacttcgcatcaaaaactttttaacaacggattcttgtttggagcgcttttgcttggattagctttctcgtttaaagaggcaacaccagcaaaagctgttacggcaaactttaatggtccagtttatcgactttataacccaaattcgggcgagcatgtttatacaatgggacttaccgagaaaaataatcttgtccatttgggttggggttatgagggagtgttggctgactcctactacaactatcctggggtaaattatacaaaaattccagtataccgcctctataattctcaaagtggacagcacctctatacaaaaaatacttatgaagtttcttccttaagaactaaaggatggtcaaatgaaggaattgtattttatgattcatcaaattgtcctatggcaagcactacccctgtttatagactatataatcccaatagtggtcagcattttttcacaaatgactttaatgaatcaaattatttaatgaatcttggttggaattatggagaagcttttaagtttaattacccatatcaatgggaaggaaaaaataactccacgtttaatagactataaaatttcaaagaggttctacttatggaaagtgcaaaaaggtatgcattagtgggaaatattttacaaacgatttattttattttcctatttattgctggaagtctgaacacatttactaaattctttcatctcgtgattcttgcaaacgttggagtacgtggtgtattttcagtcattcctcttcttattcttgtgattttgagttggtatgctgcaagtcgcttagaagatgcaacttggcgaatggttttactcattgtcgcgattattgcaatttccgggtcaggaagcctgattccaggaattctgttcattgttgctttcttcaaatccggaaagaaagcttaataaaaaccaaaaagacggctctagtcatttttttgttataatgaaattcatgaataaattagaagaaatttccaattttgcgcgaaaaattcatagtggtagcaatgatggacacggttttgatcatatcgagcgggttgtgaatcttgctcaaaaaattctactgacagaaccatcagcagattctgagcttgtccttgccacttgctacttgcacgatacttatgacgaaaaattaacgactgatgttcctaaacaaaagacaaaagtcctcaattttttaaatgacattggaataagtaaaaaagttagtgatgaaatattttcgattattgacaacatgagtttttcaagtaatttaagtgaaaaaaaagcactgactttgaatggatagattgtccaagatgcggaccgcctggatgcgatgggagcctgggggattgttcgtacacttgagtatggttgggcaaaaaatagagtcatttatgacccaaatcttcagcctttgacctataagtctaaagaggattatcatgctcagcaagataactcaacactcaaccacttctatgaaaaattatttttgttgaaagatttattgaataccacagaaggaaaacgattgggcgagaaacgcgataaaatcatgcatctttttgtcagtgaaatcgagcaagaatatgaagaatctcatttataaatttgctgacaagtttgtcagaggattttttgaatcttcgtcagcaaaattaattcaaaaattgaaaggcaatatctgatgaatttcttatccagtgtattcaataaaatacttactcaacttgataaaaaaagagtaaataaattcaaaactgagcaacctctcaagccaaacttgaattcaaaaaccttagtttttgcgcatcgtggttcaaaatctaataatccagaaaatacacttgctgcctttcgtgaagccatccgcgttcaatctgatggaatcgagttagacgtccatttatcgcttgataatgaattaatcgtcatccacgacgagaaaattgaccggacaacaaacggcaaaggcttagttagaaaaatgacttctgctgatatacaaaaatttgatgctggctcttggtatcatcctaattttgctgacgaaaaaattcctcgcctctcagaagtattaaaattactgacagatttatcctttaacggttatttaaatattgaaattaaaaccgataaatttaactatcctggaattgaaaaaaaaatatctgaattaatgacagagagtaaatggccttttatttatatttatagctcctttaatttgcagtccttaaaaagaattcacgaacttgagcctaagattgaaataaattatttaacaaaaaatattttacacttaaaaaaacgccaagaaggcatattgaccgactttatcaccggaattcatccccgcagaaattacgcactcaagcacccacttcttctaaaagcttctaatagaccctttcgcctctggaccgttaatcaagagtctgaaatgcgcaaagcttttcaacaaaatgtagctggaatcattaccgattatcctgaacaagccttaaaaattcgtcaacaaattcaagagcagccaaaataggctgcttttttgtccataaatgagatctacttcacaaaattttgaagataaaatcacatagtgtagcaattgtaagcgtgaagcatttttctttacattttgtttcacaaagggtataattaaatcgtgcgtgttattttgtcaaacttatttgacaaaataagcacaaggatttggaagggatgcataaatatgcaatttattaactatctaggtcaagacgcttacaccaatatcgcgatggacagctggcttctttacaacttaaagccaactgagcctgtttttgctctctggcaaaacaaacgtgcggttattgttgggcgcaaccaaaatacttttgccgaagtaaatcaggactacattgacagtcatgacgtccaagttgttcgtcgggtatctggcggtggcgctgtttatcatgatgagggtaacatttgtttcaccttttttgttccagttgaaaattctggttctgtaaactttaaaaagtttgttcagcctatgtatgaagcacttcatgctgtaggaattaaagcagaaatcaccggacgtaatgaccttgaagttgaaggcaaaaagatttcagggaatgcgcaacgctatgcaggaggatatctcatgcatcacggaacgctactttgggataccgatgttgaagctatgattcgctcgcttaatgtatccgatgaaaaatttgtcagtaaagctgccaaatcagtccgtgctcgagtaggaaatattaaagagtttgcacctgatgaattaagcttaggtagctttattgaagccttgaaatactacctcaccgacgaaggaaaagacggcgaactggtcttaactgatgagcagcttgattccatcaaaaaaacacgtgatgagcaatttgctacatgggactggaattatggtgaatcacctaagttctccttccaaaaccacgctaaatttactggcggagccattgatattcaagtcaatgttgaaaatggtaaaattaccgaaattaatttccaaggagatttcttgggggttcgcgactggcgggatattaaagaccaatttattggtgtcgaatttgaacccgcagccgtcctacaagtccttgaagcaaataaggacgggcaatatttcggaacaattcaaaataccgaactttctgaaatgttcaaagccgactatcgagtcgactaacttatttcacaagcataaccttaggaaatttctccaaaaaatgataaatttctaattatagacacataaaatagaaagggaatctattatgccaaattcagaacaaatcttagatttcaaagcgcagctatcactgcaagacaccgcatttccaatgctacaaattcttaatgaagaaggaaaaattgttgacgaagaaggtcttaaacgtgcaggactttctgatgaaaaactcgttgaactctttaaaagcatgctttttgcacgacaagttgacattcgctcaatgaaattagctaaacaaggacgtatgggattctttggacctcacgctggccaagaagcttctcaaatggcctcaggttttgctttcactgatgaagactggcttttcccaggttatcgtgatttgccacaaatctacgctaaaggttggccaatttggaaagggcttctttggtctcgtggacatcaacttggtaatgaatataccactgatgatggtaaacctgtaaactcatggtttccacaaattattatcggtgctcaatacgttgaggccgctggtgtagcacttggacttaaaaaacgtaaaaaagatgctgtagccttcgtttacactggagatggtggttcttcacaaggggacacttatgaaggaatcaactttgctggtgcctataaagccccacttgttgcctttatccaaaacaatggttatgccatttcgactcctcgtagcctacaaagtgctgctcctcatttggccgctaaaggttgggctgccggcgctccgtctatcgttgttgatggaatggacgcaattgccatgtatcttgcttctaaagaagctcgtgcttgggcagtagctggaaatggtccggttgttattgaagctattacaaaccgtcttgaaccccattcaacggctggtgatgacccacttcgctatcgtactaaagaagatattgaagcttggtggaaaaaagaaccactcgttcgtatgcgtaatttcttaactgaaaaaggactttgggatacagataaagaagaagcttatgttgctgagcttgatgcacgtattgatgctgatatcaagaaagcaaataatgttgaaaaacaaaaaatttcaagcttcattaaaaatacacttgaagtgccaagccaagcaatggcagaacaaattgcaaaatttgaaagcgagggcaaataagaatggcagtaaaaacttatattgcagcaattacagaagcgcttgatttggcgcttgaaaaagacaaagatgcactcatttttggtgaagacgtcggacaaaatggtggggttttccgtgccactgacggacttcaagcaaaatatggtgaagaccgcgttttcaatactccactcgcagaatcaggaattggtggaatggcaatcggtcttgcaacacaaggtttccacccaattatggaaatccaattcgggacctttatctttgaagttttcgactcaattgctggacaaatgagccggacacgttatcgttttaataacactcgttcaaataatattgtcgtgcgtacgccttatggtatcggaactaaaacacctgaaatgcatgctgattcaatcgaaggattgttttcacaactccctggggtacgtgtggttatgccttcaaatccagcggatgctaaaggtttgctactcgcatcaattgaaaataatgaccctgttattttccttgaaaacctccacctttaccgttcattaaaaggtgaagttcctgagggttactacacaacaccgcttgaccaagcagccgtcgctaaagaaggttctgatgtttcaatcattgcttatggtggaactgttcctcttgctctcaaagctgctgaacaacttgaaaaagatggaatcaaagctgaagttattgaccttagaactgttgctcctcttgacatcgcatcaatcggtaaaacagttgaaaaaactggacgtgttgttgttgttcaagaagctcaacgtaccgctggtattgcggcaaatgtaatggctgaaatttcagaacgttttgtcttgaatcttaaagcacctattggacgcgtaactggtccagactcaattttcccatttgcacaagcggaaaatgattgggcagttaaagctgaggatatcgtgaataaagttaaagaggtggttgattatgactgagatttttaaaatgcctgatattggcgaaggaatgcacgaaggggacattgccaactggttagttaaagttggagatgttgttaaagaagatgatccaattgctgaagtacaaaatgataaactcatgcaagaaattctctctccctactctgggactgtaacaaaactcttcgttgaagaaggaacaactgtagaagttgattctcctttggttgagtttgatggagacggttcaggaacttctgcagctgctccttccgctcaagaaacagcaagttctgatgctccttctggcaatgctcaaatcttcaccatgcctgatattggtgaaggaatgcatgaaggcgatattgccaactggctcgttaaagttggagatgaaattaaagaagatgatcctgttgcagaagttcaaaacgataaactcatgcaagagattctttctccttactctggaaaagtcacaaaacttttcgtcgaaacaggaacaactgtagaagttggtgctcctttgattgaatacaatggaaatggtgaatcttcaagtaatcctgctcctgctgctagtcctgcgccaattgcggaagctcctaaagcagccgctgcacctactgatgcgccattgacaaaaacaacttctactggacatattcttgctatgccatctgtccgtcattatgctcgtaaagcgggaattgatttgactcaagtacctgcaactggtcgtcatgggcatacaactttggctgacgttaaagcttttgaatctggtagcgttgcaccaattgctcctgtggctccagaatcagctcctgtggcacctgcgcctaaagctgataaagctacggaaaaagccccaactgttaaatctgtggctggagatcgtcgtgaagcaatgaatccaactcgtaaagttgtttctaaagttatgactgctcaacacactcatattccaccagtaacaaactttgatcaagtggaagtttctaaacttgttaaacatcgcgccatcttcaaagaagtagcagcaaaacaagatatcaaattgacttaccttgcttatgttgctaaagccttggcaactactgctcataagttcccagaaattaatgcttctgttgactatgataagcaagaaattgtttatcatgaacatgtcaacctcgggattgctgtaaatgccccaactggtttatatgtcccagtcattcatgaagctgaaactaaatcaatccttgaaattgcaaaagaaattgctgaattagcgactgctacacgtgaaggaacgcttaaacctcaacaaatgcaaggctcaacgattacaatttcaaatattggttctgctcgtggttcttggtttacaccaatcatcaacggttctgatgttgtgattttaggtttgggttcaattgttaaagaaccaattgtcaatggtgaaggtgaaattgtcgtaggacaaaacatgaaattgtctatgacttatgaccaccgtttgattgatggtatgttgggtcaaacatcacttaactacttgaaatcacttttggctgaccctgagttcatgcttatggaaatttaatacgatgtaatgaatggtgctgaatcccctattcattacacgcgaattcctaacggacattcgctaatcgtcttattagaaaacttatgaaaaaatatcgttttcataagtttccgtcatagtttttaaataaaattcttaggacaagtctgtcagtaagtttacaacgttgtaaaccctagttgacattgaagtttacaagaaaagaggaataaaaaatggttgttggtgcacaagcaacagaagttgatttggttgttattggttcaggccctggcggttatgttgcggccatccgtgcggctgaacttggtaaaaaagttacgattattgaaaaagataatgtcggtggggtttgtttaaatattggatgtatcccatcaaaagcattgattaatatcggtcatcattatcaagaatctttggaagaagaaaagggcgaaaatccttttggactttctgtcggaaatgttaaattaaactgggaatctgcccaaaaatggaaacaagataaagttgtcaaccagttgactggtggcgttaaaatgctacttaaaaaacacaaagttgacgtaattcaaggaacagctgagtttattgataacaatacaatcaatgttgaacaagaagatggtttccaacttttgcagttcaacgatgtaattatctcaactggttcacgtcctattgaaatcccatctttcccatttggtggtcgtattattgactcaacaggtgctttgtcacttccagaagtgcctaaacatttgattattgttgggggtggcgttattggttctgagcttggtggagcttaccgcatgctcggttctaagattacaattgttgaaggcttggaccacattttaaacggttttgataaagaaatgtctgatatcattgcgaatcgtgtgaaatctgctggttctgaaatctttacttcggcgatggctaaatcagctactcaaaccgataaagatgtgactttaacttttgaagttgacggaaaagaacaaacagtaactggtgattacttactcgtttctgttggacgtcgtccaaatactgatttgattggcttgaacaatactgatgtcaaattgactgaccgtggtttgattgaagttgatgattcttatgcaacgaatgttcctcatatttacgcgattggtgatgtggttcctggaccaatgctcgcacacaaagcttctttccaagccaaagttgctgcagcggccattgctggagctaaagatgacgtggacttgcacgttgctttaccagccgttgcttatacaacaactgaactagcaacagttggagaaacacctgaatctgttaaagaccgtaaagatgtcaagatttctaagttcccatttgctgcaaatggtcgggccatttcaatgaatgataccactggtttcttacgtttgattaccgaaactaaagaaggtgccttaattggtgctcaaatcgttggtcctggtgcatctgacttgatctctggtttatcactagcgattgaaaatggattgacttctaaagacatttcattgactatccaacctcacccaacacttggtgaagcgattatggatacagctgaattggctgatggcttaccaattcacgtttaataaaattaaaaatcactgacgaaataatctgtcagtgatttttttgtggaaaatttactggcaaaactctctaaatatttctgtcagtaattttaagttttccactgtggataaatttactgacagaacttccggcggcttatccacaggtttatttcataatatctgcccaaccagacattccgtccaagaattttttggattttaaatgaattccaacatattcatcataaagtccatcaataaattgacgaatttttgctttcatttctgcttttatcgagattttctttaattcatctaaagaaatttcttgaaaaagattgattaaataaatcacgttagggtcaagatgacttcttcgcaaatcttcatcgaaatgccttggacaaaggcagccactaaatttatatgaaaaatcaaatggtcctactgttttatgacaaaaagcacattctgaaaagttcaatgaaaccccaaaacgatgaagaacttgtaattcaaaaatattagtcacgacttccatatcaaatccttggtctaaaagttccaaacttcgctttagaaatccataaagtgctgggtcatattgattatcagaaatggctgcatcagctaaacttatgatataagaggcatgagcattgatgaaaatatctgcactaatatttttataaacaacgacttcactgacatcttcgataaaagaaaatcctccgtcattaattgttgccgtcaattttccatcagtaaaagcttgtaaggaactggcataagaagattttccaaaatttttgacaaaaaacatccgcttaccaaaagactctgtaaaaatcttgaccaatttatctttttctttgtaattacgactataaagtactaaaccttgagtttcggcatcacgcatgattttcccctttcaataagttacttcattatatcaaaaaaatcactgacaactcttgcaattgccatcagtgattttaattttactgacagatttctcagccacgttttttagttacataatctgttaaccttgccattgcctgctcaatgacatccattgaagccgcataagacaagcggacaaatccctcaccgtactgaccaaaagcaataccgggaataatggcaactgcattttcttttgcaaaatcaaccgcaaacttgaatgaatcttgctccaaatcagctggaatttttgcaaaaatgtagaaagctccatctggttcaataattttaaaaccaagagctgacattttttcaataatataatcacgacgtttaagatattcttttttcatcggcagggcatcatcagctccatttttcaaagcttcaattgcagcaaattgagactgagtggaagccgaagttaccaaatattggtgcgtcttaataatctgtgccactaattcacgcgccgcaaagattaatccaattcgccaaccggtcatcgcatgtgactttgataaaccattaagaacaatcgtttgctcaggggcatattcagcaattgacacatgcggttggtcagtgtaatttaattcagaataaacctcgtcagcaattacaaaaacttcatgctttttcaaaacctcagctagagccttgatttgttcacgattataagttactcctgtaggatttgcggggtaattaaaaataacagctttaacttttccttcacgctcaataatcgcttgatcaagcatctcaggcgttaaaacaaaatcgttagctctggtatcaatttcaaccaaagaaccaccagcaagcgtaattaaaggctcatagccagggtatgcaggggctggaatcaaaacctcatcacccgcaactaaaattgacagcaaaacactagaaatggcttcggtcactccaacagtaactaatatttcatcctcagcaacataaaataaaccatatttttttaacaaaaattcactagcagcctgacgtaattctaataaaccagccattccagtataatgactttgattattttcaatcgccgcaattcctgcttgcttgacatgttcaggtgtataaaaatcaggctctcccaacgtcaacttgataatatcagggatagatgaaacctgttggtcaaattggcgaatgagtgaaatttcaattttatctaaattagggttaaatttttttaataaatccataaaaatcctctacttaccatcctgttctactgacagaaatcttttgacaatattatacactattttcagactatttactttactgacaaacctgtcagtaaaaaaagcactctaaatttttaaaattagagtgcttttactatttatggctcggcaggggctcgaaccctggacccatagattaagagtctactgctctaccaactgagctaccgggccaacctataaaaagttgaatattttgtgaccacttctagaattctaaaattctgtggtagtaatgataaattgcttcgcaatttttctatctgcaaccttgaagcagtgcttcaagccaactgagctactgggccaacttactagcttattataccgatttatagaccaaaatgcaagaatttttattatcttgactcaaaaatataaagccagcccccaagagtttgaaagacagttactccttagttaaaggcctctgagtactgaattactcctgattttccttctaatctaccatcaattaattctttaatcataaagttctcatttggaacttcaaagggtgcttggatttgatattgacttgctggaacatagccaaatctaggataataactttcatgacctaaaatgctgataaaggaatagtccaaaattttggctcttttttcaagctctaatagtattgcagctccaattccttttccttgataggcaggcaaaacatcaagaggagctaataccaaacctttaaaactctgactctgattgacaatactcacctcacttaaaagcccatgacctgtgattttaccatcttcaaaagcaacaatttccaaatctttgatatagccttcttcattacgaattttatcaacaagttcagcctcattaccataaccatgttctgactgactaaaagattcacgaataagttcagcaacttctttatagtcttctaaatttattgttttaattatcattatcttcctctcctaataaaatctctatcattattttaacagttattcttcagtttttcattagatattagtaataaatttattttctggttttttaattacaagaaatctatctaatcttgattttatttcgattccgataattatttgattagattacttatctctgctatcatagaatattgtgataaaaaaataaaggaattattatgattaaacaatttttaggtattattaactcagagttcaaagactacaatcgacgaaaattcttgcaagatttgatggcagggattaccgtagcagccgttgctctccccttagcccttgcttttggtgtgtccagtggaactacggcagcagccggactaatcacagcgattgtcgcgggcctaattattagttccttttctggagccttttatcaaatctcaggcccaacaggagcgatggccgctatcttaatttcactcattggcaaatacggaatgaatgggatttttatagccactttcatggctggaatctttctcttacttgctggtattttccgtttaggaaaccttatctcactcattccatctccagtcattacaggttttacttccggaattgcaatcattattgctagcggacaaattaaaaactttttcgggattgaacactttacaggttctttttttgatttaatgaaatttatcggagggttacatattgattatccctcaacaattattggaattttaacgattttattaatgattttttatcccaaatcatgggggaaaaaatttccagcttctttattggctatccttctttcaacccttgcggtccttgctttaaaattaaatgtcccagtcgtaggaaaaatccctacaacactcattccccaagcacatcttcgtttaactgaaataaatcttcaagatatgaaaaccctccttattccagccataagcatcaccgtccttggaatgactgaaagtctcctatgtggagcatctgctggacgtgctactaaccatccaatggataataaccaagaacttgtcgctcaaggaattgggaacatttttatccccttcttcggaggtattccagctacagccgcaatcgctcgaacaagtgtggcaattaaggctggagcgcaaactcgcttaactggtattattcacgcgctcattttacttttatcaatgttcttgtttgccccatttatgacacacatcccactcagtgcccttgctggtgtccttatcatgactgccctaagaatgaatgaatgggaagcaattcatttcctattcaaaaacaaattaaagagtgggatgattgagttttttgtaactatgattattacggttatttttgatttgagtactgcaatcttagccggaatcatcgttggcttcttacttttcatcttaaaaatttcccaaattgaaattaacagttctcaaattgaacccgaacgaattagtcaaaatcatcatgaagtatttagcgaatggactgtcatttatatctctggcccacttttctttttaaatagcagtaagctaaaacaggtcattgatgcccttcctacaaacacaaacattgtcctctctctaagaggtgttccaatgattgatgtcacttccattaagttactgattgatatttatagcgttttccatgaagaaaatcgccaaattgtctttgcttcaatgaatggtaaattaaaagaatcctttagaagaacaggacttatcaatctggttggtgaagaagctatctatccaagtgtcaatgaattccttttagatttggtagataaaaagaattaaataaaaaaaatagacccatgatatggatctatttttttatttataaatcaatcagtaattgttctgattgaatacatttaaagagacttacttttatctagaataacccccgttaataaaagtaatatcttccgtatcattataagtactgtaagcttttaccattgctataatccaatccactaaagaccaaattccaagagtaaacccgttgaataacaatttacaaattccaactccaatttgtccacgcataaaacgatcgactccaagtccgccaaataggaaacttcccaaccagacaaatagatgtttattgactgttttcgttgtcataataataactcctgtcagcttttatcgtggctcagcgcttgcacgtagtttgattaaatctttaaattaaaaattttgcttagattatttagctttttttagtaaggtgtagttaataaattcttgtcctctcaaataaacaagattctgtttcaattcttgataacccattttttcaaaaaaagcttttgctgtaatcgaagaattaacgctaaacataagagcctgagaacttttttccaaatcctttaacaattgctgaccaactccctgccgttgataatctgcacttatgtaaaacaaatcaatataacctctatcatcaatattaccaaaaccgactatctcatcttgattaactacaatccttgagttcgtagccaacaaattatcattaaagcttagcttatcgacttttgaccaagcctctacttgagctaaatcataatcagcaatatttatctcaaaaatagtctttttaaaaagcctgataatttcttccaaatcttttggctcatagtttctaatgatcaacactatccactttctagtctcacttattatcttcttatccaaatttatcaactcagacacttaatttttaaacaagaagcaatgataaatctgcttcatttaatattataacagaaattgcacgaattatttcataaagttatattttgtctgtttttgtaatattaatttttattctttcctaaatctttaaattaataaataaaaaaacacatagaaattaaactatgggtttataaaatcgaaagatagttttggcacatatccaggtacaaacaaagttagactgaccttttattgtggttgtcagataggcacatttttgaggtactttcattttacaaaaatatctcaagcaatagattaacaaaggttaataacaaatgaagcccaaaactattttttatcagtagtttgattcaaaaggaaatcactctacttttattttttaaaattaggtatcttttagattaataatttgattagaaactttttcaacaaaggcttggtcatgttcaactaaaagcattgtcggctgactattttccagaagttgggcaatctgttcatgattaaaaacatcaagataattaagaggttcatcccaaagataaagctctgcttcttgcgacaaactgcgagctaattcaacttttttctgttgtccttgactcattgtttctattttttgcgtaaactgcttccgctccatgcctagctttctgaggttggaaagaaataattcataatccaattgattttcggtagcaaaatcttttagatagccacgattatcataaatctgacgaacaaatgatatttttattccttgcggaagttgaacaaatccgttgcgctctccagaaaaatttccagataaatatttgataatacttgatttcccttgaccgtttggtccgacaattgctgcaatttctcctactttcaaggaaaaatcaattggttgaaatagtatttttttatcaaacgccaaggaaaatttttcaaactgtatcagccttctatggtgtgagggttgaaaattcatgcctaggtgatcagttttttcgatatttttgagtaatttctctttattctcaacttcctgtcccattcgcttttcaattgcttttgctcgttgattttgtttcttggcaacttttttatccacaaaagttgcaccagcaacattttcacgttgatttgaccaatctcgtttttccaacgaagtccttttcagccttgaaatatctttacgtaatctttcatcttcagcaagttcaaaatcatcacgcagttttttttcttgctcataagttgaataatttccttgatagagaataacttgttgacgttcaatcgccaaagtatggtcacaaacctcatcaagaaaatttcggtcgtgtgaaacaacaataaatcctgattttttcttgagatactgagcaacgacttttcgactagccatatccaaatgattggttggctcatcaatcaaaggaaaattcgtttcgtccaaaaataagattgccaatagacattttgtttgctctccaccagataaactttcaaaagggcgccataatacctctaaatcaacttttaaaagagataattcccgttctaattcccattgttcaaattcggccaattcatttaagagataaaaggtcaattgtgactttctgtcagtaatatttactgacagactttctatagaatcccccttatgagactcttgattttttgattcagatgatattttttcatcatttaaatcttcttctgtcagtagttgtggaaagtaaacaaaatttttatcagcaataatcgagctatcagtaattatttttccctctaatagctttaaaagtgttgatttcccgcggccatttcgtccaactaatcctaatttccagcggtcatcaatatttatttgggcatggtcaaaaattaggttttctccataaccaaaagttaaatctttaaattcaatatttgacatttaattctcctcccatctgtgagaattaagaaattgaatttgaggagaaatgtctcagtaaaacagatatttatttgtattgctgagaatttctcttatttctctgaatctcaaattcccgcttttcgtggagcattaatttttgctccatgctgattttgcttggttgcttttacggctgtcagtccatttgtatttttttcagcaaattgcggtttatttttcttaatttgttctagtctagcttgcatttctttttgtttttgattcattttttctccttttatataaaaagctcttctcacaacttaggtgaaaagagctttaaaagacacaaattctggcaaaacacccaaatttgaagcataataaaagcctattttctctaagttgtgaacgcaacaaaaacactcgatttgacgaatattttttaaagttcaaaacttagattttcaatagaccttacctcattcatttatttaaaataattatagcataaaataaaaagaactgtcaagataaaaacttgacagttcttttttgattaatgaaattgcattccaccatcaacaataattgtttgacccgtaatataattagaatcaggaccagcaaggaaagaaaccacattggccacgtcctcaggctctgacaaacgtttcatcgcgatatctttggcaaaagtctgcatgccccattcgtcatctttacctgcatttttacccacttgatgtgcaatatcaaacatcattggtgttttaacaatccctggtgcataggcattaactgtaattccttcttctgctagatcgcgagcggcaatttgtgtcattccacgaacagcgaattttgaagaagaataaagcattaggttaggattcccaacgacacctgcttgcgaagttgcattaataatcttaccaccatgacctagtttacggaaaagtgctgtggctgcctgtgttccccacaaaactccaccaacattaatattataaacttgatgaaattgttcaggagtaattgtttcaatcggagtggttggggcaattcctgcattatttactactacattcaaatcaccaaatttttcaacaacagcttctaaagcggcaactacttggtcacggtcagaaacatctgctctaagagcaaatgattcgccaccaagttccttagctgcttgttgagctgtttcttcattgtaatcaatgattgcgactttaaacccatcattatataaacgttttgcgatagcaaagccaattccttgacctgacccagtaactgctgcaactttagacatctttatttctcctttaaatgagtgaaatttatatttatagaccttttccagttggtgaaactaaagtcttaactgctgtttcattgtgatgaatcaaagtatcaaaacctttatcaatcaggtcatctaagccaattttacctgtaataaattgattcaatttaatcttaccagttgcaactaaatcaatggttttaggatgagtattattataagcaatagtccctaaaagattagcttctttaatgactaattttgccatgtcaacactagctgctttaccccaaattgcaacgataacaactgttccacccatgcgaatagaatttaaacacgcatcaaatcctggttgaacagaagtacattcaaaagcagcatcaactcctttttcattaatttgatgaactttttcctgaatatcatcttcaattggattaaagaaataatcagcaacttctgcttcttgagcttttttacgacgcaaaccactaggctcactaataattactgtatgcccttgagctttggcaactgcagctgtcaaaagtccgattggaccagctccaacaacgagtaccgtactcttttcactcaaattggcacgttcaacagcatgatatcccacagaaagtggttcaattagtgctgcttcatctaatggtaaatagtcaggaattttatgtactcaacgttcatcaactgaaattttttcagccagaccgccgccatttccgcccaaaccaataaagtttgatccttctgagagattgtaatgtccagtttcacttgtatcagtaccttcgggaacgatataaggttcaacaacaacatggtcacctactttgagaccacttaccccttgacctacaaagtttacaataccagacatttcgtgtccgagagtaactggtggaacttcacctgtaataggatttggatgttctgctgatggacaaaaaattggtccatctaaaaattcgtgcagatctgtaccacagattccacaccaagccacatctatacctacttgaccagtttttactgctggttcattaatttcttcaacgcgaatatctccgcgatcataaaaacgtgctgcgcgcataaaaacgcctcctctgaataggatggttgtcgtttcaggcaatcaatagtatttaattttgagatttctctcacaaatttattttatcatttatttttaaaatttacaaaaaattaaagcgttttctagcttgctatataagacttatagacagatttgaggtaataaaaaaactactaacatttctgctagtaatcttcattttttataagaagctaagaattttttaagttctatttctacgacgatttttacgactatctcccttgactggaatctgtctttgttctctgacgaattctgggagctgattatatttcatcgataggacaagtcctaatccaatgatattggacatcaaagccgaacccccttgggaaataaatggtagagggatacccgttaatggaacaaccccaatagcagctccaatattttcaaagacgtggaaaagaatcatcatgataataccggttgaaatataagtataaaactgattatttgagttaaaagtcactcgaatcattcgataaatcaacataaagtaaaggaaaatcaagaatgctgaaccaacaaatccgaaatcctcagcaataactgtaaaaatcatatctgattcacggacaggaacattaacattggcaacgccaattcctttaccccaaagtcctcccactccgacagaaatcaaagaacgtgcttgttgaagactgaaggtttgcgaatactcaaagggatgtaaccaagcaataaaacgattgacttgatattttgcaaaacttgtactttcaagaaacttctgtccttctggagaagcaactaaagccacaatcccacctgcgactgctgctacaaaaagaaaagctggcgccagtattttccaagaaactccagatactaagacaatcccagcaaagattgcagcaaataccaagaaagtcccaaagtccttttgaaatactgacaagattgcgacaggaattgtttcaagaatcaaaagtccaattaagcgaaaatcgtctttgagaactctctttttcaaattgttttggaatgttactacaattcgggctgaaaatagaatgtaggaaagcttcataaactctgagggctgaaataaattccgtccaccaaaagcaagccagttttttgcacctgttgaggcataagtcgctctatcatagaagaatatcggcaaaatcatcaaaatcagacctaaaagatagaaaaatggggttaaattccataaaaatcttgaatccatgtgcatgactattaaggcaacgaagagcccaacgattacccaggttccttgttgaactaccagagttgtggcttgtgccggatgatcgtgacttactgccacataaagtgcgtaaagaccaattaaaattaacataaaggctggtaatatcagcccataatcaattcttgaatcaaatgtaaatctatttactttctttttgttcaaaactagctccagtcagtttaatattgttttagccttaaaaaatttatttcaaaaaatcacaaatcccttttaatctgctaaaacaactttaatattgaggtgacttcccttttaaaatcataaatccattctattatacaattttttcgaatgatttgggcgttctttatcaaaatttcgacaaaaaaacgctgaaaacactttcagcattttataaaaagtgcccaagaacatctcctccaaaaataagaagatatgaatagagaagaattggtaatggtttacataataagatactccaagtgaagaatttccaactcatttttgtttgactagcaatcaaaactagagcatcgtctggggcaatcggtgataatataaggagcgcaaatacgatattaaagcgcttttgtcctttatctaaccaagccatgtatttattatatgttttttctttgacgaaagtcttagctagcgaggagccatattttttcccaaagtggaaaagcaaaaacgaacccgcaacaattccaaagtaattataaataaatccccaaacgggcccaaaaatcatgacaccggcggccattgtgattccgccaggtatgattgggacgattacttgtaaaacttgcatacaaaggaaaatcagcggccccaaaaaacggtgggcgacaatcaattgttgcaagacggcttgattttgaaaagcacccagtcgccacagataaactccgccgacaattgtggccacaaaacctaagatggtaattacattaaaaactcgtttgacatatcttaatacgttatcattcaaagaaaatcctcactttgggcatttttttttgctttaagataggcctcattttcttcaatccaactaggtagagagtgagcaagggttttaaagccaatcttgtctcgtgaatcagtaaaatgtttttttcggtagatatgatgaacttgtggatttttttcaagacttcggattgacaagctaattttgccattgtattcatcaatatcgatgatttgggccattattttttgcccaattttagcaatatcatggatgctcttgacatatccggattgaatttcagaaatatgaatcaaacctttttgttcaattttctcattggtttctggattttgcaggaaaaactttacaaatgcaccataatcctgcattccaatgatttcaacttcaacaatatctccgattttaggactttttttatccattttatggctcgataatctcaactgattcaatgacaacatcgtcaactggtttatcttgtgcacccacacgtacatctgcgattttatcaaggactttgtagctttcttcatcaactaattgaccaaaaacagtatgtcgaccgtcaagatgcggagttccaccatcagtatatgtttctgctacttcttcaggccaacccccttgaataagtgagtcctttggataaggcaagtttttattttgaacgatgaaaaattgactaccgttcgtattaggaccggcatttgccattgacaaagccccacgaaggttaaagagatccattgagaactcatcctcaaatttttcaccgtaaattgaagaaccacccatcccagttcctgttggatctcctccttgaatcataaaatctttgatgattcggtggaaaatcacaccatcataatagccttctttactgagttcaataaagttttttactgttttaggagcaagactatcaaataatttgacagtcatttttccatgattggtattaataattgctgtggtacttttgtagttttcaagatcaagttgtgggtaagtcataattttttagtcggcatttctatttaaaaaatgccttcctttcttcatagtttaagttactgacgaatctgtcagttttattttttcctgacagatttgtcaatcaataatttttaaggcttgtagggcttttaagattccatcattttcgaccgaatccgtaatataatcagcttttttcaaaatttctggatgagaaactttcatcgcaactgacaagccagcaaaatcaaaaagttcacggtcattgaggccatcgccaaaattcagcatattttcagctttcaccccaagttcttgcaagacctgttgacagccaattgcttttgagccttcaagcggtacaatatctgaactatttggatgccatcgcacaagccgaattttgtcagccaagttttctggtaacttcaactgatcatcatgatccgaaattgtcaacatttgataaatttcttctgtttgataataatcaggattttctttcagttcagcataaactggaccaatcgcctcacttgcgattttatcccattttgaaacgcgtaaattgtcagctgccacaaatgaatactcactttgttcggttctcaaccaagcaattatttcctctactaaatccttggaaaaagtatttttatataaaactttttgagtgcgcgcattctcaacataagcgccattaatggccacgtaataatcaggtttcaaggcacgaacttctggaacaacaccaaaaagatttcttcccgttgcaattccggtcatgattcctttttcatgaagttttttaaacacttcattgattgattcaggcataaatcctgaatctttaacccttaaagtatcatcaatatcaaaaaagataattttaatcttttgggctttttctaatattttttccatttatttttcactctaaatttatttgcacattctcaattatatcatatttccaacttgtttttcctcaagtttatactaaatgatgttgaatggcataaatagtagcctgagtgcggtccgaaacttcaagtttattgaatatatttgaaacatgtgtttttactgtttttaagctgataaaaagttcgtcagcaatttcttgattggaaagtcctgtagcaagaacttttagtacttctaattctcttttagataagtcatcatagagttcatgcttgcgatgcttttgttgggcaattttttctttgaccgcgtcagacaaaacgtcttcgccattggcaacttttctgattgccattgcaatttctgcggcttgtgaagttttaagaatatatccttttgctcctgcagccagagctggaaaaactttttcatcatcaataaaacttgtcaaaatcaaaatttttctttcaggatttttggctaaaattttctgagttgccccaataccgtcaagtctatccattaccaaatccatcaatataacgtctgggtcaagcatttctgtttttaaaaaacctgactccccatcggcagattcaccaaccacttcaatatcgggttggatattcataaaacttgataaaccaaggcgcaccatctggtggtcatctacaattaaaagtttgattttttccattttattctttctaaatatctttcatttttaaagactcggcttagctttgggaataataatctcaacagtggttcccgaaccaggcgctgaaatcactttagcatctccaccaattaaaagcgctcgttctttaatatttgctaaaccatagctcgctgttttatcactcgttgaaacatcaaatccaactccatcatcagcaattttcaagaaaatattttcttgggtttctcttaaagatacttcaatgtattcggcttgcgaatgacgcaaagtattcgataaaatctcctgagccattcgaaaaaggttgtcctcaatattacttgttgcttcaatatcagccaatttaacagtaatatttgctgatatttttgcttgcaattcgtctgtcagtgctgacaagccttctgctaaactcttaccatctaattctacaggtctaagatgcaataagagcgcccgcatttcgttttgagccgaatgaaggactttcaaaactaattgagtctgtgtttcgatttgctctttacttaagctttgggtggaaccagccaccgaagataaaatcatcgttgctgcaaatagttcctgactgacagaatcatggagttctcgtgaaatcctttttctttctaattcaataatttcagccttgtcagcagatttttgcttcgagagttcttggagttctgccgacatattcataattttatcatgaacagcttgtaattcaggagattcgggctgctgattttcttctaatagctttatgtcatcttgaaacttttgttgaatactcatgttttcaacatgattaaacaaggtaaaaatcagcgcaagtaatcctgcaactgatataaatatccataaaccatagaaattatcacgaagttctctaataatattagcggtatttagaccacccaaaggttgtccactattcatcattatgaatagaagaagatacataataaggatgatactaaaaactgctaaaaaggttgtgaaaagcgattttttcatcctctaatcacctcaatatttcctgagtcaacacgaatatttatttttatccgtttttctgcctgatctaaattgtcactaaaataatgtatgttacctgcattaatttgtgctgcctcattaaaaatctttacaagtccagcatttgttgttaaatcgagcgccactcccacatcgtcaggaacaataatttttgtattacctgtcatctttttaatagaaagactattgccagaaggtttaaaagtaacatcatcaagatcaatgatatcattttgattttcattcatgactgactcagattcatcttgagaaatatcttcataagaaaaacttctttcttctccttctcttggattatttttccaaaaaacgatacaaacaattgccggaaaaacgatggctaaccaaaaccagccaactgtgaagagaatcataactgatatcgcccaaaaaatgaaacttataatgcgtaatacacgcgcacgcgagcgcgtcgccaatatcgtaaagaggatagctaaggcaagcactacccacatacgcggtgtactaatcacatgaaaaatcaatcctaatacaataaaaatttctataataaagattgctttcaattttttattcataagtctattgtatcaaaaaatatagtaatttttatcggacttaagacttaatttttacttaattattagtgatgaaatatctgtcagtcattttatcagaaaaaaactttccttagtaaaattactaaagaaagctttatttatgtttatcgaattcccaaagcaatacgggcgtagcggctcattttatctactgtccatgctggatggtttttgaaagttattttttatttgttgttataccaatgattataggctagtaaactttaaaagtcaagtaatatgtggcttggactgtctactaaatgtactataaatcagattctagaacactcttactccctacctaaacttggttcaagtcttttacgcaaaatatcttcaatcattacaatataaccagccttagcatattctggaaaattatcattcaaagtaaatctatgacaagtaatattatactctcctactacttgtattgtatctttatttgttagtttctgagcgtaatcggttctgccacttactccaaaatgatttaaagttatgtctttttacttattttatctcttattaaattcagaacaaattttatttcaatctttgatttttttatgatgacattcttatatattttgttagttctaaaaattttttaatatccttttacgttattgcacaataccttgcttacgaagccaatccatttgaacctcacctgaagatggttctctaccatattgttccttaaagttttttctaaattcgtctgcttctgcaacaggatctgttgtttggtttaggttgttacttgtgcttgcatttggagaaggagtaaactggtctgacactgattgtttcaaaagtagttcttgttcttttttagccttttcctcctcagccaatagtcttgctttttcagtttcttccgcttgtaattttacgatttgatctttttctttttgggttattacactaactttattaattaagaactctattttatttttattaaaaatattttccatctcttggtaactcttcgcattgttctcaagtgtagcaatatttgactgaagttcgtttatattattaaaccgtacgtcattattaggaatatctttcttatttatgttactttcgatatattcataaactgctttaacatctttttcaatgtatttagatttcaaagattgtgcttctttagttttcagattcaaatttttaattttaacaacagtattaataacgctctcattatcgattgaaattgagttttgtaattcattgattcttttcttttcagtagtaactttgttctcatagactttttgagcacgaagttctttttgatggtcgatatttttttttataaaaaatataccaaaacttataataactaaaatcactacagcaataactttatttctgcttttcataatataacgatatagtatctactatatctatctcctcatttaatttaagctgtttagactatcacttaaccagttataaaaacatttataggttgtcttaagtcttaatttttatcaaaatccttgcaataaataattattaaattcatatttatcctgcttataactgctattatataaatattttatcacagaatgcgtagattttttaactttacaataaaattattcttttattgttttcttatctgagtatctaatgttcttaatctaatattgtattgctaaattgatgagtgatagacatcgataaaaaagataatcgcagtacctgatatcagcaatatcaatttttgacgttaataaactctaaattctcaagtacatagattaattcccaagtattatgattattatcttctccccaaacatttctcgcaaaatctttattaataaatttatatttaattttagccctacaaacaaaactaccattttgatatcctagtatagtatctccaatttttaaattttcccatcattttttgttgctttttccagcgacagctccccaataatttaaattctcagagttaatcatgagcttttgttctgaagtaaaaaattcttcaatatttttatattcaactttatttacaatcgttttatcatagtgaatttgtgcttctttactacttgctgtaaaccaataaaaaattatatatccttcttttctaaatcattatacttatcttttcttcctttacttttttcagcaggataattctgaccattcttctttatcttatccctaataatatcctcaacgcttaatcctaaatcatcagcgagcatcaatgaataaatcattacatcagctatttcgtctttaatattttctaaatcatctgctattgcttcttcacttgttttccattgaaagttttcaagtagttctgatgcttctaaagaaaccgataaggctaaatctttagcattatgaaattgtctccagtctctttcatctctaaattcattaatttcttttattaaatcatccattctaaattcctcctacaaacctactcgttctttgaatagtttttctacattcttatcttcaaagtaaacagcacacccatcaatacctcttgatagtagtacatagtaaatatttaatatgtactctgttaactcagacaggctaaattcttcctttagcggagtaccaccaatatctttataattttctgatacagctacaatctgcccattctctacggtaatatcgttacctatgataactccagaataatttaaatcataaccttgaatcgcatgaatcgaacctatttctttttctgaatttggtttctttacccaatcctcataagtcgagttccatctcttttgaataccatcttcattccaatcatatggtaattcttctgctttcttacctttgttctctttctttttagtattggatgcccattccctacaataaccagcaatcactctatttgttgttttaggataagcatgtgagtggtcatccacataatcaataacatctttaaaagtatctacgattttaaaataatcatcttcgaagacttttgaattgaagtttttatcattacttaattgaaagccatataagattccttttaagaaatcctctcctgaaaagtctccatttccgcctattctaaattgttgcattaacaatagttttttataatcttttgtaagatttctgatttctgaaggtctaatgttttgaggtttaattccttgatatgggtcatataataaaaccaaaccatctgttaattcttcaaggagtgtgatttcttcatctccttcattgagatgtcttcttgcatttggatgtcctttacgataatgttgtttcaatttatgagcttcatctacaatgattacatcaaatctcttatcattgttccttgcatcgactataagttgtgaacctgttttaacagttaatctaccattcaatccgattgatttaaatatcaaattaaactgtcttgttaggttaccagtagttattaagcctattcttaaatcaagatttttctcagctaaagaaaatgctagattggtaaagagaacagatttacctgagcctgctggagcctctactaagtattttttggctacatctttttcaatttcatcacaaattattttttgtttaggtgataactgtttaaatggtgaatacttaaatagtaaactctctcttaattcctcaatattaggattatcgactaaccccaaccaatgtaattcattactccataatttataaaatacttcagttaaaatttcttctttgtttttatagaccaattcagtttgaccattatttccatttgcaaatacaaatttggttacatttgattcagcaatcatatagtttaataacaatgactctaaatcaagaatcgatgatttatcaaataggttagaataaataactaagcaatttgtatattctttgtaatctactttgggatttgtttctcctagatgctcgttatgtcttctagtaaaaccatttgtttcaccaacgtaaatgtctaatcttcctgagggctatttcatttcagaagtgatagataacaatggaaagtcttatactgatcctgaagtggcgattagtcagcaggaggatgctagtccaaaatcatttaaaattattgtttctgcaaaagaaagtaacttaaagctcacagttaataaaccagtaggtggcgaatctacaaaagaattttctggtctctttatggggaaacttaccaaattccaattgatgaaattttaactactaatggaaaaacatatcgtgccattgttaaaattcaaaaagttgattggaaaaatggaatcactacaacgataattgaggacccagaggaaattgcttcattattgaagggaaatttattggtcggaaaatatgatagtcagacgacttctatcagtgtgtcttataaagaaaaagctgctattcctccacttccttctaaagacgaaggagatgatagctcaccatcaactcctgccaaaagcatagaaagtccgaaacagaatgaacctgataagcagaaagttccagctcctataactagcactactagtcaaccagaacaaagtcatgataaagagaaattcaaagaaaaaaacgtagaagagcctaaaaaaactgcacctattcaaaaaagtgaacgaccaagtcaatcgcctgaaaatcagataaaagctccgttagctcctcctacgccatcattttcaacaacgcaaaaagcaatagctaatcgttctattgctagtgaagtgaatcaaaaagcacatattcttaaattaagaattgctggagcagctggtttagcggctgggacagcatcggcttatggaatcttacgtgccttaaaaatgatgttgcaacattttggcaaattaagcaatttaattaaataagaataagtcttctttgtttagttcaataaaaaaaacaccgtaaggtgttttttatattaggcatttaaaacttttgataaaaagtcttgtaaacgtggatgtttaggattgtcaaaaagttcttcaggggtaccatcttctaggattactccaccatcagtgaaaatcacgcgattggcaactttacgagcaaagcccatttcgtgagtgacaattaacattgtcattccttcttcagcaagtttttgcataaccgcgaggacatctccaaccatttcagggtcaagcgctgaggttggctcatcaaagagcataacatcagggttcattgcgagggcacgagcaatcgcaacacgttgtttttgtcctccagaaagcatttctggcatcgcgtcttttttatctaccaagccaactgtttcgagaagctgcatggctttttcatttgcatcatctttagataattttttcaactcaattggggcataagtaatattttgtaaaacagtcatgtttggaaaaagattgaaatgttgaaagaccattccaacgttttgacgaacgagattgagatttgtatttttatcagtcagattaaatccgtcgataatgatatcaccagaagtggctgtttcaagaccattcaaagctctaagaaaagtcgattttccagaacctgagggaccgataatacatacgacatcccctttttcaaattttgtagtaattccttttagaacttcattttttccaaaagatttgtgaagatcagtgacttcaatttgagtattgattcccatgttagtatgttctccttatttattatttcattcttttttctactcgacgtccaacccacatcaagaagaggaggacaatcatgtaaactaagccaattaatccataaacacggaaggcttggaagttacgggccacgatgatttgacctgtttggagtaattcaacaagtccgataactgaaactaatgtggtatctttcaaagtgatgatgaattggttaatcaagctaggaattgtgattttaatggcttgaggcaagataaccttacgcattgaagttaggtatgtcacaccaagtgaacggctggcttccatttgtccagaagggactgcttggacaccagaacgaacgatttctgcgatataagcagaagagtttaaggtaagggcaatcacaccggccgtaaattcattgagtggagattgatgaccagtaatgatttgtagaaggttaggaattccgtagaagataaagattgttaacactaaaagcggaattgaacggttaaggtcgacataaattcgtgcaattgtacgaagaatcttgcttggagctacagagaagagtccaaagataattccgacaatcattgctaggataaatgagagaacagcaagttcaagtgtaacgagcaacccgcgtccgatttgttcccagttgttttgcaaaataccaaagaaagtattttcttttgcacttgattgaatggttttagcatcactagctaaatatttatcaatgattttatcatattcaccatttgcacggagattagctaaaccattattaaacatttcaatcagttcaggattgcttccttttttaacggcaaatccatattgaccgtcagggattggtttaattggtgtagtaaatttttgtccttgtttaatggcatatttgatgacaggttcatcgtccattaaagcattgatagagccgttatttaatgatgaatacatggttgttgcatcagtaaatgtttttacagtataaccgtattcttttgcgtgatcattaagataatcgaaagaggcagtaccgtttttagccccaagtgttttaccttttaggtctttccatgatttgatagaatcatcggtacttgatgtagcaatggttaagttagatgaatagtaaggattaccataatcaaaaacttgtttacgggcatcggtaattgacatccctgacatcattccgtcagcatgaccagattgaacagagtcaacagctgcttggaaaccaatgaaattccatttgagtttgaatccttggttcttggcgatggcatttagtaagtcaacgtcgataccagtgaattgtttgttgtcattttgaaattcaaaaggggcaaagctattatctgaggcaatggtataaacatcttttttcggtgttgcttttttagaagttgttattccatattttttcaggattttatcataatccccatttgatttcatttcagtcaatgctttattgaaaccatccacgagcgtttggtttttgcctttcatcacagcaaaaccataacctcctgaaagagagatagaagggaagtttgtagctaaatcttgaccttgtttcatagcataagagataactggaacttcatccattgctcctacgatgtttcctgaactaagtgtggcaaacatatgaacaccatcagaataggttttgatgttatagccatatttcttttgattttcttgaagccaagtttgagcggcagttccgttttttgctccaactgcttttcctttaagttcactataatcagtaagcttagaatctttggtagtcgcaatagttagtgcagatgtatagtaaggattagaaaaatcaaaagtgtctttacgttcatcggtgattgtcattccagcaattacaccgtctacttgtccagctttgagattttgaagtgcagcatcaaaacctgggtaagacatttctaatttccaatcattgatttttgcaacttcttgcataatatcaacgtcgatgcctacccattttttctgaccattttgaaattcaaatggtgcataagagctatcagacgcgattttgacagtcgtctcggccttgaccgaaggcgctactaggaaagctgtaacagtggcaaacatgagtgccagagcgaaaaataatttcttcattttgtctccttgaatatgagatttgaacttatcccttaatataaaaaaatgaaattaaaaaaatgttcttctgaataaaaatcggaataacattcttttagtttcctatatttaggagacaagctcagtttattttattctgggaaaattatatcacaaaaattgtctagaatcaagttgatgttaggttttctgacattttgaatttgtggaatttgagagttctctgataaaatataagaaagtttatattgtcaaaaagtcctttttgttgtaaaattgaacgagtgcttgatagagatatttatgtattctatttaagtaaacagaactactgtaagaatttttaacttttgaaaaggaatattatgtttgtacaactttcgatttttggtttctttaatgattggatggctaattttgcccagatgcctaatggtcatatttggatatatgttgttttaggggcgattatatttattgaaacaggattagtgattttccccttcttgcctggggattcaattttattttttgttggttctttagcagcaatgtcaaatggaaaattatccattggcttattgattttggtgatggggattattgccttcattgctaatctgttaaattatgaaattggtcgaagatttggagatgttattccaaaacataaatggctttctcgcttcttgaaaccagaatatatggaagaagctcatcaattttttgaaaaatggggttcttgggccattttcttagggcgattcatgccaatcattcggacgattgttccatttacagctggtgctggtaaaatgccacataaaaagtttattttctttaacttcatcggtggttttgcttgggttattgttgccttaggtgcaggctatttatttggtggtattccttttgttaaaaaacattttgaaatcatcatgattgccattgtctttgtgtcactactaccggcaattattggcattttgaaacgcgttcttggaagtcgcaaggaagcttaactttatgataaaataggacttaaaaaactgtcagtcctttttttatcgattgatatgtcaatgacaatagaatttactgacaaaaccatcagcaactgctggaagaacaatcaagttctttgagcgggagcttaggacatgaccaaaatgtttgtcagtaattttggagaatctttatgaaaattgacggttacacgcggatggctgctgtggtggcaaaccctattaaacacagcttatctccttttattcataatttggcctttgatttaactgatgaaaatggcgtttatttagcttgggaagttgagtccaaaaaattagcggctattgttgaaaatgttcgtaatttggacatgtatggtctgaatatctctatgccttataaaggtgaaattattaaatttatggatgaattgagcccagcggtcgaactaatcggggcggtcaatacggtagttaatcattcaggaaaaataattggacataacacagatggtataggatttttcaatagtttagaaaaatatcatttcaatatccaaaataaacaaatgcttattcttggtggagggggtgcagcaattgcaattattgctcaggcagctttgtctggagctaaaaaaattgtggtcgcagcaagaaaatcggcctcatatattccgctaaaagagaaattggaaaagctgtcagtaaaaacagggattgaaattttactgacagacttatctgaagctgatagattacaaaaagagttgaaacagaccgacttattagtaaatgcaacctcagtcggaatggatggagaatctttgccgctggaaaagagcttagttcttcctgaaaaacttttggtggtagatgctatttataaagtaagagaaacaccatttttacgttgggcaaaagagcaaggagctcaaactgaaaatggacttggcatgctgattggacaggcggcggaaagcttttatttatggacaggtaaaaaaatgcctgttgcagaaattacattagaaatggagaaagaagcatgaaattaaatgtgaatttaccagaacatccctatgatgtcatcatcgaaaatggggccttggctaatattggaacttgggtttcttcattgtggaagaagcaaaaaattgttttgatttctgataatcatgttaatggactttatggtcaaaaagttgttgaccaacttgaaaaagcaggttttgaagtggcaacttttgaatttccagaaggagaagccagtaaaaatttactgacagccgaaaatgtttggaacttttgtgccgaatttggactgactcgttctgacggaattattgcactcggtggtggagtaacaggtgatttagcaggttttgtagcctctacttacatgcgtggcattcatttcttacaaattccaacaagtttgaccgcccaagtggatagttctattggtgggaaaataggaattaattccaaaatgtctaagaatatgattgggacttttacacagcctgacggcgtgttaattgacccagaagttctgcaaacgctcggtcaaagagaattccgtgaaggactgggagaggtcatcaagtgcgccctaattgctgacaaagacctctggaatttactgacagacttgtcagcgaatgatttggtagaaaagcttgataagattgaagaaattatctatcgatcttgtgaagtaaaacgaaaagtggttgttgatgatgaattagacaatggtgtgcggctctatcttaactttggtcatacaattggacactctattgaaaatactgcaggctatggcaaagtgatgcatggggaagcagttgctattgggatggttcaaatcagtaaaattgccgaactcaaaggtcttatgcccaaaggaattactgaccaaatccgaaaaatggtcaaaaaatatggtttacctgacgaatttcaaccttgggatgaagagcttttgtttaaagccttaactcatgataaaaaagcacgaggaagaatcatcaaaaccgttattgttcctgaaattggcaccgctaaaattaatgaagtgacttttgaagaaatgaaagactatctcaaaaaataacttgagttattctaagagaaaccctatctaaaaattacaaaaatgtggtagcattaaaaaaatcccagcttttataaaagctgtaaaaacacttatttaaaggagaaacaatgtatatttacctagcttttgcattagttggcggttttttacttgctaatcaaaatccaatcaatgcggatttacgaaaaattgttggctcaccatttttggcctctggaatttccaactttgttggttcgatttttttaggaattatcactttagtgaccagtcaaacactttttcctagttttcaatttgtcagcagtcacccagcttggctctggattggagggatttttggcggaatatttctgacttccaatgtcttattatttcctagattaggggctgttcaaaccgtaattttgccaatcttgggccaaatattgatggggacactcattgattcttttggttggtttcacgcgatgcaacttccaatgactttgatgcgttttatgggaattgttattactttaattggggtcattattgcggttgttctaccaaatttaaaagaaaaagaagccgaaaagccaaaaggtaatttgctgggttggcgaatttgggcagtcatcgccggagcaatgtcagctgcacaacaagccattaatggcagactaggagtcttgcttgaaaatatcgcacaggcagcttttgtttctttcttcatcggatttttagccattttcattgtgtcactttttgtagaccgccgattgccgaaaatttcagatttgaaaaaagcaaaaccatggaatggaattggtggatttttaggggcttcagttgtctttgcaacagtagttgctgttccacaaatcggagccggtttaacaattatgatgggcttaatcggacaaattctcggcagtatgcttgttcaacaatttggctggtggcgttcaaataaatatcaaattcaagtctggcaagtgattggaattttggtcatgttagcaggaattgtatttattaaatttttataatgtagctagtaatatggaacagggcttcacgctcactaacttcctactcctattatggccgaatgaagcgtaggatagctgttgccagtttactggcttacagatatgctagttgctccacctagaaacgataattttccgctgagtgagtaataaggtttctaggaagttcgccataacgacttccgtgctgatccttcacgcttgcgactcgacttgtcgttttagcgacttagcgagaaccattgcgacttgtgactttagtcacttagtgagcatggatacctctggtgtggacagcatagctagcgtgatataagcagtgatacttataaaagaacttagaaaattggggataatcaataaaaaatgtttactcaaaaatcatttgaaatttttagtatagatggcttggaagctagaatggccgaaattcgttcggaaattcagcctgttttttcggaaattgggcaaaagttattgacaaaactgtcagcaaaaatttcaaatcaagaattttactttcatattgctcaacatcgtagaagaacagcgaatgctccagaaaatacttggtcagcaatttcaactaaagctcgtggttataaaatggaagcccatttccaattaggaatctgggaagattatgtttttatttatttatcaatgattgaccaacctaaaaagcaaaaagaatacgctgaattactgaccaatctgtcagtagaaaaaatgttgacagaagattttataatctcaaaagaccatacaaaagcagaagttttcccctgtcagcattttcagaagccgctgaacgcctaggaaaagtaaaaaaatctgaattggaaattggacggctttggcctaaagaaagatttaacggcaaagaggacttaataattctagcggaaatgatagaaacaattgaccaactcctaccgatttatcaaaaattaatggaggcctaatctaatgacaacatttatttgggatttagatggaacactaattgatagctatgaggtgtttttagaagccttgtccgaatcatttgcaaactttaatcgaccatttgatcgagaaacagtatataattttataaagggtcaatcagtcaatgctttactaaaagaacaacccgttccatttcaagaaataaaagaagatttcacggcaaattcgacagctaaaaatgacaaaattaaattaatggttggtgcaaaagaggttttagattggactcaaaaagaaaagattcaaaatttcatttatactcacaaaggcaaaaatgcttatgatttgcttaatcagctggaaatttccccctattttctagaaatagtcacttctgaaaatggatttaaaagaaaacctcatcctgaagcaatcaattatttacttaaaaagtataaattaaagcctgaagaaacttattatattggtgaccgaatccttgatattgaagccgcgcataatagcggtcttggctcaatcaattttctttcgtcagcaaattcacaagaaataaaaaaattgacagatattattaaaatttttgaaagaaaataaaagataaattactataattggaggtataatatgcgttactttacagcgggagaatcccacggaccaagacttacagcaattattgaaggagtaccagctggactttctttgtcagcggaagatattaatattgaactaaaacgtcgccaaggaggctatggacgtggtggacgtatgaaaattgagtctgaccaagttgaaattacctctggagttcgtcatggaaaaacaattggtagcccgattacgctcaacgtgacaaaccgtgattttaaaaattgggaacaaattatggcagcccaagatgttgaagataagatcaaaaaacaacgccgtttgactaaaccacgtcctggacatgctgatttagttggtggaatgaaatatgaatttgaagacttacgaaatgttttagaacgctcatctgcgcgtgaaacaacaatgcgtgttgcggttggagctgtagctaaaaaacttcttcatgaattagaaatcgaagtagccaaccatgtggtcaactttggtagaagagaaatttcaagtccagaacacttaagtgttcaagaaattcgcgaaactgctggccgcagtgatttatctatctttgatgaaagtcaggctgaagacttacggacttacattgaccaaatcaaaaaagcaggcgatacaattggtggaatcattgagactagagtcgaaggagttcctgctggacttggttcttacgtacaatatgacagaaaacttgatgccaaaattgctggtgcagtcgtttccattaatgcctttaaaggggttgaatttggacttggatttgaagcaggaaaacgtccaggaagtcaagtaatggatgaaattatctggtctgaaaacaaaggctatactcgttcaagcaatcaattaggtggatttgaaggtggaatgacaaatggcgaacagctcattgttcgtggagtgatgaaacctatcccgacgctctacaaaccactgatgtctattgatactgaaagccacgaaccttacaaagctagtgtcgagcgttctgatccaaccgcacttcctgctgcaggtgtggtaatggaaaatgtcgttgcaacggtcgtagctcaagaaatttgtgacaagttcaattctgataccatcaatgagttgaaaaaagcactggttgactacaaaaaacgtttatcagaatactaaaaattaaaaagccgattaaggctttttttgtattcaaaaaaagtaacttacgaatttgtaagttttcagaccgaaatttcttgttacaatgaatttatcaagaaaacataaggagaacacaatgaaaaaaatactttttggaataatcgcactcatcttagtagtcggtggagcaggatttgcttgttataaagtcagctacggcggtggaacttattatgtacaaattaccaaagacggaaaagaacaacaggatacagcaaatggtcaaaaatatacaagatattcatatcaaatgaattcttataaaaaagacggtaaagaaaagaaagttgaatttacggcagaccataatcttcgtaaagaagcttatttagaattaacagttaattccgttaaaggagtcacttcatgggaagaagtaaaaaaagcagaagttcctaaggaagcactcaagaaaattaatagcaactcataaacctaaaaagtcaaaaagaaagtaggagaaagaaccatgacatttttacaaatcaaccttgcgctaatgacaattacagtaatacttgccacgttaatgggctcttgcttactttatacgatgaagactatgagagcacgtctagctaaattaaacgaaagcaatcaaacagaaagataagtataggagaaaatatgttactcgaagtaaaacatctcaaaaaagtttttaaaacaagattttcaaaagaagaaacaactgctctagttgacattgattttggagtagaggaaggcgaatatatcgcgataatgggagaatctggttcaggtaagacgaccttgctgaatatcttatcaaccctagaaaaaccaacttctggacaagttcttttaaataaagaagacattacagccattaaagataaagaaatttccgcattcagacgtgaccatctaggttttgtattccaagattttaacctattagacacgcttaatgtaagagataatatttatctcccacttgttttatctaaatcaagcgtagaattgatgaaaagtagactaaaagttctcgcaccaaaacttaatattgaaaatctcttagaaaaacaaccttttgagctttcaggtggtcaaaaacaacgtgtagctgtggctcgggcattgataagtcaacctgatttagtacttgccgatgaacctacagcggctttggacttcaaaaactcagaagatttgctcaatctttttgaggaaattaatgacagtggtcaaaccattatcatggtaactcactcaagcttagctgcgagtcatgctaaacgtgttctttttatcaaagatggtgttctctatcatcagctctatcgtggtgaaaaaacctctattgagtttgccaaagaaatcacactttcaatgaccgcattcctagggacctcagaagaagaggagggatcattaaatgcttagtttaaagcttgcggccaataatattaaaaaaggttttaaaagctttgctccatttttaatggcctcaatcacgatgtttgtaatgattttcgttactgcatccatcgctttatctccttcaattcataagttgaaaggaggagaagccctttcgcaaattatgggctttgccttaattgttttatctatttttgcagtacttattctaatctatagttatcgtttccttcaaactcaacgttcacgagaatttggactctatgatattcttggttttggtaaaacgagaattgttggtgtagcctttttagaattgattttaagttatatcattactttaattgctggaacagtttgtgggattgtgttttcaaaatttttatttttgatttttgtaaatatgattggtggaaattattttaatctagtcattagtcctacggcgattatcttacttgcttttctctttcttattttctttttagtcttaatgatgattggtatttggattatctggcgctcttcaagtttagaccttttaagagaagaatctaaaggggaaaaagaaccaaaatcaaatctattttttgcaatagctgtggtaattcttttggctgctggttattacatagccttaactgtcgataaccctatttcagccctaatgaaattctttattgctgttttacttgtaatctttggaacttaccttttctatatcagtttcactgtgtggtacctgaaattaaagaaaaaacgcgcaagttattataaaccaaataatttcatcacaacgagctcaatgctttaccgaatgaaagccaatgctgttgggcttggaaatatcactatcttgttatcgatgactattgtaacagtcgttatcagcttgggagttttccttggaacagaaaatgtagttaaaacattttatacaagagaagctcaagtcttcactgttgcatcaaatgaaaacagacaagaggatattgaacggattaagagcgctgcagacagtaaaaagatagatataaaaaatatttctgatctatattttgtccaagatttagcagtagacagacaagaaacatctaatgataaatttgctacatcaactaaacaaggggttatgtttgacaagagtacttactatgcaactttaaccactgctcaaaccctaaaatctttaggaaataaagatattcctactttaaaagatgaccaagttttagttgtaaatttagctaaaaataataaaaataaaacctcagagaaccaattgcagtcacttcaatggtatggtgataattaccaagttaaagatacccttaaaacggttaaagactttcctgcaagtagcgttacaactctttcatctaaagtgatgatgattgtctttgctaatgaccaagcctttgaaaaggcgcttgctaattataataaagtaattagtgccgggcaaggattttcaaatcttgcttcaacatcaattatttttgatattaaacccgttgatgaaaaaagatttactaaggctttcaaagaggagtttaatgataataaagatttaacaatctcttatcgtagtgaagctttgcaagaccaacgtgctcaagttggaggtttagtctttgttggatttgttctaggaattagctttattcttggggcggctctcatcatttactacaaacaactttctgagggtgcacaagacaaacgatcattcaagattttacaagaagttggactctcaaaagaagaagtacaaaaaacaataaaatcacaagttcgtatgattttcttccttccattagtgattacaatctgccactttgcaggtacttatctcatggttgagaaaataatcatgttgttcgatattaatgaccgttcggctattctgacaatttcattaggaaccattgcgattcttgctttgatttattatcttatttataaagcgacaagtcgtgtttattataagattgttgaaagataaaactctttaatatctctaaccgtattattatggtcagcaagaatcgcactttcttcttttgtcttaaatccaagcattttatttacttcctcctgaaaacttctgataaaattctttatttataaactccatcatttctttaaacttaaacgaccagttatctcctttaccatttgggtaatatacccaacctccgttttcaactgatattctttttcttaaatcaggttttcttaaaactttggaaactgttggaatactacggtttgatttttctgtaaaaacatccataccaacccaaccgtcaaagtctttttctttaagctcttgatattcaactttatctacaagaatcttatcttctggaattaaaactgaaatagtcgcttgtacttcaagtgtttgttccatggattttcctctctattcttcaaagtcaaagctagtttgtgagttcaatccacgaatttcaagcgttgtattgaaagatggttgccacatatcaagatattctgttgcttcatcataacgacttaatggaatatcgctatatttaacaacatcgaagcgattgttcaaatctttataaaactctctgaataccttagctcctaatttcttatgagcatttgaatatttgccgccagtaaacatataaactttgcttgctactttcttttgcaaaactttagccttatttgatggaagtccgaatcggtcagtcaaatcaagaactgaattttcgatttgttcgacttttttattcaagttcacgtttccttgagcaagtaatgcaatttgttgttcaggagtttgaggtaattgtttttcttcttgaactttgaaataagtatcgactaaaatatcgtacatgtcccaagcttcatcagttcctaaagatttcgcatgaagcaacgcccctttttctgtccaaaggtaaagtttaggtgctcgatttccgactacaccgaaattttcgttgttgtctttgaattttttcagttcttctccatctaataaaaagaaatgcttaccttctttaaatcgtgatttattatttccgaaattatcaacgatagtccgtttttttgttccatatccatcagcaatttgttgagtagtcaaaactcgttgaccatttaattctgtaatttgtaattcgttcatttttaaaccctttcttttattggtgtcctttaagacactaattcttcaaaaaaaatatcaagcatttcatcatttgtaaaattcattactttgctgataacttttatttgttgagctgtaaactcagactctccacgaagctttttataaatcgcggaacgagaaacttgttctccgttcttagtcatttggctttctagccaatcaacatttttacccattgattttaaacgtccaagaaattgatttgatttcattgttcaccgcctttcttttctttgtgtcccttaagacacttttagtatatcattataaaaatatcatgtcaagaattttgtgtcttaaaatacacttttttattaaaataaatatttttatgttttactttctttttttgtgcactttgcgacactttagtgttataatgtaaaaaaggagatttttgaacaatggaaaacatattaaaagaaaaacggctagaaaagaaattaactcttgaacaagttggtgaaattgtaggcgttggtaaatcaaccgttagaaaatgggagaacggtatgattgaaaatatgggtagagataagattgtttctctttctaaagctcttggaatttccccgcttgatattttagggataggagattcggaaaataaaacagaccctataaaaaaagaattaaatgatatttttgatttacttaattcaaagcgtcaaaaaaaagttttaaattttgcaagtaatcaacttgacgaacaaaaggacaatgtattagatattaataaaacaacggaaaaaaataagcttattcctattgagactatagaaaaagtttcagctggttttgggtttaattatggagaaaacgaaaagactacttactatacttcaagaaatgatttacctcgttttgactttgctacagttgttgatggagattcaatggaacctactttacacgacggcgatgtcattctaattagacaaaactatgatactcctcaaggtggaatatatgtagtagattatgatgggacttcttgggttaaagaagttagcattgttgaaaacgaacttgttcttcattctattaacgagaagtatcgtgattgtttcttgccagttcctcctgaagatggggaatactggaacatcgtcggcgaagtagttgattggtttactccagaaaacatttaaataataaaaaactacgagcaatgtcttgaatttcatttaaatatcgaataggagaacttatgaaatttggagttagaaaacctagccttacaaaaagtttaaaagctagaacaactgcaaaatataaacgaaaagtaaaaaaagcacttattcctggttatggtaaaaagggtatgggttgggttaaaaatccgaaaaaagctgcttataataaagtttataagaaaacaactttctcaatttgggatttgtttaaataaaaatagagttgccaatctcgttaaaaggcaggagtaatttatgacatatattgacgaattaaaagaacttaaacagttgttggatgatggaatactaacacaggaagaatttagtgctcaaaaatcacatttacttgaatcttctaaagaaatagttaatgctgatccaacttctaatagtattgaatcagaagggcatgaaaaaaaagttgaggtttttgataaaaacaaatgcgcatcatgtggtgcaaaaattggtgtaatgactcgctttaaattaaaagacaatcattttatttgtgcaaactgtataaaaaaagccggtttaacaactagtccttctaaccaagaatttattaaacaaaacgtaacgcttgatactctctttggcgaccatgataaaacgaaatcaagtcaacctacaattaacaaaattaaagccccggtagttgataaacatgcaattaaatgtcccaaatgtaaaagcactgatgttgtattcatgcaacaagggaaaaaagggttctctgttggtaaagctgtcggtggcgctatcttaactggaggtatcggtactctagcaggttttgctgggaaaaaaggtaaaaagcaatggcattgtaataattgtggccgagtttttgaaacaaaaaaataaataaaaaaagccgcccctactttggcgagcggagaacggcttttatctagtatggtaaaaattgacaaaacagtcaagtcttttactgtactcattttatcatagaaatggagtaaaaatcaaatatggctacatatcaaaaacgtggtaaaacttggcagtattcaatatcaagaacaaaacaaggacttcctcgtctaacaaagggtggtttttctacaaaatctgacgcacaagctgaagcaatggatattgaaagcaaactaaaaaaaggatttattgttgaccccattaagcaagaaatttccgaatattttaaagactggatggaactttataagaaaaatgcaattgatgaaatgacttataaaggttatgagcaaacgttaaaatatttaaaaacctatatgccaaatgttttaatttccgaaataacagcatcttcttatcaaagagcgctaaataaatttgctgaaacacacgccaaagcatctacaaaagggtttcatactagagttagagcatctattcaaccactcattgaagagggacgactgcaaaaagattttaccactcgtgcagtagttaaaggtaatggaaatgataaagccgagcaagacaagtttgtaaattttgatgaatacaagcaattagttgattatttcagaaataggcttaatccaaactattcatctcccactatgctgtttataatttcaattactggcatgagagccagtgaagcttttggcttagtctgggatgatattaattttgataataatgtcattaagtgtcgcagaacttggaattacagaaataaagtaggaggtttcaaaaagcccaaaacagatgctggaataagagatattgttatagatgatgaaagtatgcaattgctaaaagattttagagaacagcaaaaaacattatttgaaagtttgggtataaaaccgatacatgactttgtttgttatcatccttatagaaaaataataactctctcagctttgcaaaatacattagatcatgcattgaaaaaactaaatatttctactccacttactgtacacggtttaaggcatactcatgcttctgttctcctctatcatggagttgatatcatgactgtttcaaaacgcctaggacacgcaagtgtggctatcacacagcaaacctatatccatattataaaagagctagaaaataaagataaggataaaataattgagctactaatggagttataattttcttacaacaaaaatacaacaaatcattaaaaatcaagaataaatccattatctaaagcacatctatcctttactatgtagttcttcatgggagctcaagaagaataaaagacaagcaaaattttatcaaaactattaatgatacctaggccttcgtgtgcttaggtattttattttcaagccatcatcattttaattttttcacaaatttttagtttattatttagtactaattccagcatatcttcaatcgagttaatcatttattatattttggaagttaagactaatcaaaactaaaataagttgctatctctctcccgaaaactataataattccccgctcccacaataatatgatcaataaaattaattcctatattatcacaagcattttttaatttttttgtaaaaattttatctgcttgactaggttgtaaattgcccgaagggtgattatgtgcgactaataaaccaaccgagagattttttattgcatggtaaaggatctctcgaggactagcagttgcatgattaactgctccgataaaaatagttttcttctcaataatttgattttgtccatctaaataggtcgcggtaagatgttcttgctcaaaattttgcatttcaaaagcaagactcatgccatattcttttgaacttaaaacttgaccataacgttttctggttgtcgtttgtattctttttccaagttcaatcattgctcgcaattcaatagcttttgtttgcccaatacccgaaatctccttgagttcactaatagatgctttgcgaaaattatccaatgtccaaaaatgttgcaaaagttctaaagctaaatttaatgatgagtattttttccgacccgtccgcaataatattgcaagtaactcaacatcggacaaatactcttcacctaaaagttctaaacgctctcttggttgcattggataaaatttctcttttaattcgtacatacttacttatacgaaaaaacaaatcgtttgtcactgacaaattaaaaaaatataaaaaagttctgacagaatcagaacttttttatatttttttactgacctttctgtcagtaaatttttattctactgttactgctttagccaaattacggggtttatcaacgtcaagaccacgttgcattgaggcatagtaagcaatcaattgtgttgggataaccattgaaattgctgacaaataagggtgaacttgattgattacaattgtatcatcttcacgtgccactccttcttcaacgattgtaattgctgaggcaccacgcgccacagtttccatcacattaccacgagtatgggctgctacttcttcattattagaaatcaaagcaagaactggagtccctttttcaatcaatgaaatcgttccatgttttaattctccagctgcaaatccttcacattggatataagaaatttcttttaatttaagcgaagcttccattgcaacataatagtcttgtttacgaccgatataaaaggcgctacgcgttgttggcaatagttctgatacaatagccgcaatttcatctttttcagataaagtagactcaatagattgagccactaaagagagttctttaaccaaatcaaagtctttagcttttgcttgtccctctgcttccccaactgctttggcaagaaaagccaaagttgcaatctgaccagtataagcttttgttgaagctaccgcaatttcaggaccagctccaattaacattgtgtaagtcgcttcgcgagacaaggtagagccaggaacatttgtaacagttaagctaggaagtcctaattcatttacttttactaaaacttgacgactatctgctgtttccccagattgtgaaaggaagataaagaatggttttttgctcaataatggcatatcatagccccactctgatgcaagaccaagttcaacaggagtatccgtaagtgcttcaagcatcatcttcgcaccaaaaccagcatgataagaggtaccagcagcaataatatagatacggtctgcttcttgaatacctttgataatgtcttgatcaactttcatcgtgccatcttcattggtataagtcgcaatcagtttacgcatgacagctggttgttcatcaatctctttaagcatatagaatggataagttccttttccaatatctgacaaatcaagttcagcagtataagaatcgcgtgaaattatttgaccttcatagtccatcacttcaaccttatcttttgtcaaaacaactagctctttatcatgaatttccataaattctgatgtttcacgaatcattgccattgcgtctgaacaaaccatattataaccatcgccaagtccaatgaggagtggagatttattttttgctacatagattaaatctgcatcttctctgtccatgagcgcgaaagcatatgatccttgaattaatttcaaagcttttttgaacgcttcaagagttgtcaaattttcttcttctgcaaacttagcaattaagtgaaccgcaatttcagtatcagtttgtcctttaaagctgtcattcatcaaaaattcatttttaagttctacaaagttttcaatgaccccattatgaaccaaaacgaaacgaccagaacttgaagtatgaggatgagcgttgtcttctgttggttttccatgagttgcccaacgggtatgtccaatcccacttgtccccgaaacatcaatcccaagcttagctcttaaatctgcaatacgtcccactgatttaactaattttgcagccgttttttgaccatttacaaaaattcctgctgaatcgtatccacgatattcgagtttttcaagtccttgcatcaaaatatcagttgcatttttgctacctacaacaccaacaatcccacacataataaagctccacttaactcactaattaaattggtatagttaattattttctaattttttatttataaatagcattataatacactttttggttcatgtcaaggaaaaataatctaattttatataaaaaacggaaattggtataatattaattgcaacaataataaaagccaattaataattaattggcttttttagctgcttcttggtatttaataaatgtcggataagtgaacaacaatagactcattccttctaggaaaccaccaattgtatcactcggataatggacccctacaaaaattcttgaaaacatgactgttgcaatcaatatcaaacagagaattcctaaggcaatcttagaagatttattttttaattttctaagacaaataaagaaaatacttccaaaaataattgttgcaaatatagagtgaccactcggaaaactttttccagcttcattcgcaaaagcagctagacgatgaatttctggacggtcacgcccaataatcatcttaatcgctgtgttgataagcaaacttgatatgaccattgtagcaacccaaatcgttgctttcttttctttaaatatcaaatagagaaccaaagcaagtaagacggctacaattataccacccttatccccaaaaatatttatcatgtgagaaaaaaagaatgtgagtcccgaagaactttgtaagtgaaaagcccagttttgaatcggagaatcaaacgggagaggagcgtgtgtgtaatatattttcacaagtacagttaaaattaaaaaggcgagggtcgtcaaagtacccaaaatatagtaattttttttattcataatataagtttagttttctatagactccataaggagatgaaaaattgatcctttcggagtattgtttgtgacaaagacttcagcatggtttaattgcgcatattgtttagcaatcgcaagcccaagacctgtgccaggaatttcactcgaacgggatttatcaatacgataaaatcgttcaaaaatattaattttttcttcttctggaatacccactccttcatcagcaacttgcagctctacttgatgattttcagaactaatttttactttaatttctgaatcttggggtgaatattttccagcattttcaataaaaacaatgatgattttataaagtgacattttatcagccctgacaaaaatcccgctttttccattaaatgtaattttttggctcaaagcaggttgaatttcactgaccactttgtcagtaaattcagtcaagttaaatttttctttatttacttccaaatgatttcctcgagaaattgtcagtaaattttcaataagtcctttcattctcagggactcttcatcaatataagaaagcgagtcatcaataatttcgggatgctcatgccatcttctttttaataaagtgacatgcccacgaattgcagcaacgggcgtcctcagttcatgtgaagcatccgaaacaaactgctgctcattctcaattttttgatttaatctgtttaataagcgattaaaactttgacttagctgacgaacttcaattggatttttactgactggtaattgtttaacttctttttcatcagtcgctaacatcatatcagtcaaaggctggctaattgtatttgcggcctttcgaattaaaattagagcgataaaaaagagaataatcatgacagcgacaatgactaatatcgcccttatcattgattttacaacaatatttatgtttaaccataattctactttgttcccattcttggccgtttctgagctataccaaaaaataacatcttttgacagactaaaattgccccaagaaagccgtgactttaaaaaatgtgatgtgccatgactttcatcaatatctccagaagcccttgttagtctaacaaaagtagatttttcatctttttcactatccagtttaaattcatcacagtttacgttaccattttctgccgcttcttgtaccgaagaaatcagagacgtcccctcactctctcggatttgtaaacttgtaaaagcaacaattcctgagacaattatcgtaacaaggagtgtaaaaatcaaaaatatacggacaaaagtttctgtgatgatgttggcacttgttttagattctgtttttttcattcgttagtttattttaatatttttcagagatgaatatgattgcccctttgaaagttgtgccttcaattttcgatattctaataaagtcaaggtaatcattaccaaatcaaccacacacaaggcaagcattggaatcgccccatgattgaaaaattcgaacatttgataagtgataaaaccaagcaaaagcacgattgataaagggtatgaccataaaatcttgcgccagagcaaagcgagcgtcaccaattttaaggcaccatgtaggagtagataaataacagcaaatagagtcgcatcacttgtcactctctctcctgcatttgtaatcatgcttgaaagtggagcaaaagcaatcgatgctgctaaatgttgaattgttgattttatcaaatcaagtggaataaaaatcaaaagtaaaccagataaaaattcaacgaatgcaaaaatacttttcccaagaagcatggcgttaaagctgacatccaataattcttctttgttttttactttttccatggtctacctcttttcatttttcaaccttcgtcattcaagcgatagcctactccacgaactgtttcaatcagagatttatgatttggaagatcaattttagcacgcagataacgcacataggcatctactgtattttcctgaccatcaaaatccattccccaaacatcatccaaaatatctgctcgactaaccactataccacgatgttctaaaaaataacttaacaaagcaaattctctttgagtcaaattcactgtttttcccgctacttccgttgtatgagccgttaaatctacctttagataatcaagttcatatacttttgagcaagaagttgaccactttctaaagataagtctcagacgagctaaaagttcttcaatttcaaaaggtttagtgatataatcatccgctccagcatctaaaccagcaactttatcaccaatataatcacgcgccgttaaaaatataatcggtgtgttgggttgaattttcttcatgcgtcgtaagacggtcaaaccatctaatttgagaatcatccaatcaagcaagacgacatctaccgctggttttgcttgctcaaacacctctaaggcagcaagaccatcaaaagctgttgatacttgataatcttcaaagactaattcttttttaacataatcagaaatactaggttcatcttcaacaattaatacatgataagtcatttcctcccctttctctttaacagctttctttatttaagttttaactgccaatttattatatcaagcctaaaacaaaaaaaccatacgttttttctgaataattaatgatattttatcattttttaaattaatcttcgttaatgaagtcttcaattaaataacgcggacgttgtttaacttcaaggaaaattttcccgatatattcaccaattacacccaaggccaacaaattcgctccaccaaaaccaacaacaactagcatgattgaggcccaaccagcaacatcagaaccattgacaaaatgacgggcaatgatataaattgctcctacaatggccaaaataaaccaaattaagccaatccaaaaaattagacgcataggtgctgccgaggtagaagtaattccgtcgatagcgaaactaatcattttcttcaaaggatatttgctttctccggcaaaacgctcgccgcgtttatagtatacaatctcagatttgtagccaactaaaggaaccatgcctcgcaaaaaaagattttgctcaggaaattgtgctaaaccttctaaagcacgacgactcattaaacgaaaatccgcatggttaggaacactttggctacccaatccttgcatcaatttataaaaagctcctgctgttcttcttttgaaaacagtatccgtttcacgattatctcgtactccataaacaacatcacagccgtcattttcaaatttttcgagcatttcatcgatggcattaatatcatcttgtaaatcagcgtccattgagataacacaatctgcgagatttctaaccgtcaataggccagcaagcaaagcattctgatgtccgcggtttcttgtaagattaattccactaaacattgaattttctgcatgtttttcttttattttttcccaagttttatcttttgatccgtcattaacataaacgattctactttttggactaatgatatcattcgaaattaattgttcgtatttggccttgagacgttcggaagtttcatcaagtaccagttcttcgttgtaaaatggcacgaccatataaagaatcttagtcatattcactccttaactctttttttctttttaaattgattatcaattaaacctagacttgctaaggcaatcattactggtgcaaattgataaagataacgtgaatttgtttcccaaagaataaggaaaaaactcaatccaacaaaggctaaagctggaacaaaccaaggatttgaccagttctttttacgacttaaaatccgccaaatttgtcgccaaagcaatacagctaagccaatccaatacagcgtttgaacagctttaagcataaaccaacctgtaatattccccggtccatctaaagaagttaaagatgttcctgacaggtaatcgaaataacgattaatgaatttattttcatggtaataggtataaaaagcactattcaaggcgccatagagccacgtataggacaatttccgccctatttgtctgacaataccagcaggtcccattttcttaatattatcaataaaaagttgtttatctgcctcttttttcgcctcataagtggggaaagattcagaatactgacgaatctttttattaaatccccctgttttattgctaggcgcccaagacatggcaatccaatgcatcatcgggagattatgacgttcatttgcttcctgtgaaaaagcaggctctgtcgcaattgttgctttgaccatgaaatgtcccccaacaaataagagagcaaacatagggattaaaagtaaaagttgcttccactttttattaaggcctaagaaaaccaatgcagcaataagtacaattaagacagtcggtttaaattcataacctaaaactgtcagtaaagtagccaagaaataccagagaatttgtcgatttaacttgtctgatttaattgcataaatgaaaaataacaatccgaaagatacaaaaggcaaagtaatcgtatcactataaagttgcgcgccatatacataaaaaggtaagaaaccaagtgcacaaacattatataaaatggcatgtcttttcccacttaaagctttaacactcaaagttccagctagaacaccaagacttgtcagcaaagcagaaacggctgtaacaacccacattttcagcagaacattctcagcaaaaggagaaaaaatctgattaaataagattcctaaaaattgattattaggatatctcaggaagtaacctaaacgtgaggctgtttctgggagaagcccaaaagactgaccatgtaactctgttgtagaattaaaaatgacaaagtaatcccaagcatgcttgctatcaggaacatgaatcataaaaagaaagggcaaaataaaggtcacgagcgctactgcccaaaaacttatttgataatatttttttactgacaaatctgtcagcaaaaaagatttactttctattttactgacagactcgtcaatgatttccatttcattttttggagcaaaaagtttttttgataatctaaaaatcccaataaaataaaaataagctgctactaaaagaagatttcctaacacaagtgcaataatatgatcactattccacgacttcgtaattgatacagcaatcccattaattaaaataaagagccctatcattaaagtaataaacggctttttcctattttaaagttcaaaaggttaatttataaacagaaaagtgtatatttatttcgataaaaggtataatatttttggatttattattagtaggaggccaagagaaatggctaagaaaaaaatagttgttgtaggtgctggatttgctggagtgtcagcgacacgcttacttgccaaaaatttgaaaaatgatgcagaaattactgtcattgataaacatgattttcaaacttccatgacccaacttcatgaggttgcggcaagccgtgttgaaccagatgcggttcaatatcagttagaacgaacaattggtaagtttcacaatgtaaatgttgtgaaagattcactggttgaacttgataagtctggcaaaaaggttatcacagaaaaagggagctatgattatgattaccttgttgtgtcaatgggaggcgagccgaatgatttcggagttccaggtgttaaagaatatggatttaccctttggtcacttgaagatgctttgaaaattgaagcacatctaaaggaaatggtgcaagccgcagccaaagagtcggattcagaaaaacgcaaaaaactgctcacatttagtgttgctggttcaggttttaccggaattgaaatggccggtgagttgattgactggcgtaaaaaagtttctaaaaaatacggtattcctgaatctgaatttacaattaatattgtggaaatgatgccaaccattatgaatattttggatcgtagcctagctgacaaagctcttacttatcttcaaaataaaaatattaatgtgctggtcaatcacgggattactgctgtggcagaagatcatattactgtaaatgttggcgggcgtgatgaagaaaaagttgttaaggaaattccagggaacaccttaatttggacaacaggtgttcaaggaaatacagaagcagaagcctgtcaactttcagaaacagaacgaggacatcatctccaagcgaatgaatacatggaagcaattggaaatgaaaacaaaggaatctatgtcgcaggtgatgtctcaggctatatcgttccagaaaatggtcgcccaactccacaaattgttgaagctgcataacaaactggaagtactgctgcgaagaatattattgcggatattaaaggtggaacaaaaactaaattctcaggaaactaccgtggaactcttgtttcaattggttctgactatgccgttggaacagttggaaaaacaaaattgagtggtttctcagcaacctttatgaaatatatggtttatcttgtttatacctttgaaattcgttcaggacattacttctttaaatatattaatgaccaacttttccacaaaggagcgatttaattaaaatcactaaaaaaacaaaacttttctaaaataattttggaaaagtttttcttgtgtaacagtttacaaattgttctaaaaaggatataatagtgcctgacgttattattatattactaataggagaaccgttctaaatgactaagaaacaaatcgtagtcatcggtggtggtgttgcaggagtacatgcgacgcgtgagctttctaaaaagcttaaagcagatgctgacatcacattgattgacaaacatagttaccacacaaccatgactcaactccacgaagttgcagctggtcgtgttccattcacaactgtacaatatgatttccaaaagcttttaggaaaacgtaaaaatgttagtcttgtgaccgattcagtagtcagccttgacaaagaaaataaaaaagtaattacaaaacatggtagttacaactatgactatgttattgttgcgcttggtggagaaccaaatgattttggcgttccaggtgtaaaagaacatggatttactctttggtcacttgaagacgcaatgaaaattaaacgtcacttggaaacaattgttcaatatgcttccacagaagttgacgatgaaaaacgccgtgctttattgacgatttcagttgctggttcaggatttactggtattgaaatggccggtgaattgattgactggcgtaaaaaagtttcaacagattggaagattcctgaagaagaaattacaatcaatgttgttgaaatgatgccaacaattcttaatacattagaccgtaaacaagcagataaagctcatgcttatcttgaaaagaaaaatgttcacgttttgactaatcatggaattgttgaagtggccaaagaccatatcaaagtaaatgttggtggacgtgacgaagaaaaagttgccaaagaacttccaacacatacattgatttggacaacaggtgttcaaggaaatacagctgcaaaaacagatctcaacgaaacagagcgtggccatcgtcttcaagcaaatgaatacatggaagctgttggttttgaaggaaaaggaatctatgtagctggtgacgtttcaggctatatcgaaccagatactggtcgtccaacaccacaaatcgttgaagccgcagaacaaactgcacacacagcagcagcaaatattcttgcagacatcaacggtggaagcaaacataaacacgaaagtaaataccaaggaacaatggtttcaatcggttcaacttggggagttgctaaaattggtagcatgcgtctaactggtttctgggcaatgttgatgaagaatattgtttactttatctatacattacaaattcgctcagcacattatttctggcgttatgccttggatgaagtcttccgcgtaaaagataatcgtaactttatgcgtggtcatacttcacgtcaaggaaatgtactttggtctgttccgcttcgtattttctacggtgtagtttggtttaccgaagcaatcaagaaaattgtgggtgacggtcaatacttcaatccaacgacttggtttggtaaaggttcatggtttacaaatgacctcaaattcccattctcatggttacaagaagtaccaaaagcagcagatgctgcagctggagcttcaacagccgcttcatcaagctctagtgttgcagatgccgcagcaggtgcctcaggtgcagcaacaacagccgcttcaagtggtggtggagaagccacacacaaagcaactgaatggggactttcatatgcttatggctctgacccaatgactgtatttgataaagtgccacattggatggaaccaatctttaagttcatgattccaaaccgtgaagttgccttgttcatgcaaaaattcatgtctatcgttgaaatcttcctcgcacttgcactcatttttggacttttcacttggattgcagcagcagcaacagccgctttgactgttatgttctcactttcaggaatgttctactgggttaacatttggtttattccagtggcaattgccctcatgaatggttctggtcgttcatttggtttagataaatgggttcaaccttggattcaaagatggctaaccaagatatggtatggtcaatcacgttcaatttataaaggacgtcaatagaaagtagctcttcggagctattttttttgcctgaaaaagcttgaaaattatgttatgatatttgaagataaaagatagtttataaactatctttgtaagaactgaggtttaaatggataatttaagatataaaagtgtctttgacatcattggtccagtgatgattggaccatcaagttcacacacggctggtgcggctcgcattggtaaaatagtacgttctatctttggtgaacttccagaaaaattagagattcatctttatgagtcttttgctaaaacatataagggtcatggaacagatgttgctcttgtcgctggggttttgggaatggatacggatgatgaacgattgccaatggctccgcaactggcttatgagcaaggaatggaaatttcttatgtaccacatccagaagaaagagcagaccatccaaataccgcacgtttaattgccaaaaaaggtgaccgaacgatgacggtgacaggtatttctattggtggtggaatgattcaagtgacagaactcaatggatttgatattgcaatttcggctggcgtaccaacatttgttgtcatccatgaagacgtccccggaatgatagctagagtttctagccttctttccgagcatcaaattaatattgctcaaatgaatgtaaccagggaagccaaacgcgaaaaagccattatgattttagaagttgatacaccaaatgttaaggaagtaattggggaaatgaaacttattcctcgcttgcatgctgtcaatttctttaattaaaaacagtagaggaataaatatgtttaaaaatatagaagaattaattgaggattctaaaaactattcttcaataacagaattaatgattgcgattgaaattgagcaaactgggcgaaatcgtaaacaaatctgggaaatgatggaacataatctagatacgatgcttgattctgttaaaaaaggattggttggggaaaaatcactgacaggtttgactggtggtgatgcaaaattaatggatgactacattcaatcagggaaagctttgtcaggagatattattttaggagctgcgcgtgatgcagttgcggtaaatgaggtcaatgcccaaatgggtctgatttgcgctactccaactgctggttccgctggatgtttaccgggggtcttaacttcggcaattaaaacattaggtttgacacatgagcaacaagtcgaatttctatttgttgctggagcttttggtctagcaattgctaataatgcgacaatctcgggtgccgaggggggatgtcaagcggaagttggttcagcctcagcaatggcttcggccgctcttgctcttgctgcaggaggttctgcggagcaagcaggttatgcaattgccattgtcttacaaaatatgttaggattgatttgtgaccctgttgctggtctggtcgaaattccctgtgttcaccgtaatgcgatgggcgcttcacaagcgatgatatcagctgatatggctttggccggagtcaaaacagtaattccagtcgatgaagttgtgaatacaatgtataatgtcggacgctctttaccagcagcttttagagaaacagccgaaggcggattggctcagacaaccaccggacgtaagattatggaagaattatttggttaagattaaacttaaagattcgaatatgagattcgaactttatttttttgagttgaatacttgacttttagtgtttacacgtgtaaacttattttatgaaaacgaatatggaaaggagaaaaaatgaacgaaatagaatttaatgtttcaaatgccgaattaatcgttatgcgagtaatttggtctttaggagaagcacgagttgatgagatttatgcccagattcctcaagaattagaatggtctttagccacggtaaaaaccttgcttggccgtttagtaaaaaaagaaatgctgagtaccgaaaaagaaggaagaaaatttgtttatcgacctttgatggaagaatgtacagcaattaatttgatggcagatggactgattcaaaaggtctgccaaacaaaacatgtaaatgttttacaagaaatgattgaaaaatcaactctgaccgcacaagatttggagtttttgcaagaatcgcttaaagccaaagaagcggttgagcaaaagcattgtaattgtctagaaaccagtggtctttgcgcctgcaaacatgaacatgagcaaatttctgcttagaaaagagagaattgaaaaatgaaagaaactttaaaaattgatggaatgacttgtgatcactgcgtgatgcacgtaacaaatgctttagaatcagttgaaggggttgaaaaagcaaaagtatctttgaagaaaaaagaagcacttgtaaaatttgatgctcctgccaatttggatcaaatggcacttgctgttgcggaagctggttacaaagtaatttaaaaaacacttcgtttgtgaattgaaattaaatttgctagaatgaaattggtaaagcaaacccaaatattgttttactaaataataacaggtcatcttcattccccaaatggagatgattttttcttgactttttaagtttacaatcgtaaactatatatatagataaaatatgagaagaggaactaatgagaagtcaatcatttgtaattacaggaatgacctgtgcaaattgtgtaaatacagtatcaaaaactttgaatcagtcagataaaattgttgaagcgacagttaatttagccacggaaaaagctaaaattgtagctgatgatagcttaactgatcaggaaattatcaatttagtggaaaaagcgggttatggtgccattgttaatgacaaggctcaccaagagaaaatcgcaagacaggcggcaagaaaagcgagaaacttgtctttatctttttggatttctttaattttgactttgcccttagtagttgcaatgtttgctgatatttttggagtacatgcaaattgggtgatgcttttacatgaaccgctcttacagttgattttagcaagtccggtacaatttattgttggttggcgcttttatgtcggggcttatcatgctttacgtaataagtctgcaaatatggatgttcttgttgctttaggaacatctgtggcttatttttcaagtttgattttggctgtttttatgggtcaaaaaaatgctttaaattttgaatcatcaatggtgattatcactttggtggtcatgggtaaacttttagaacataatgcaaaagagaaaacaacgcaagcgattactgggttaatgtctagtcgagcgagctttgttcatacagaatctgctgatttagcaattgaagaagtgcaaatgggacaagtcattcggattttgccaggggaaaaagttcctttggacgccatgattctttctgggaaagcttcgttcgatgaatccattttgactggtgagtccctcccagtggtcaaaatggatgatgagattgtttttgaaggaacgataaatctagatggcgaagtcaaagccgttgttgtccatgatttaaatgattcaaccatctctcgcatggtggaaatgatgagcgaggctcagggttctaagccaaatattcaaaaattggctgacaagatttcgggaatttttgtcccaattgtcctcgcaattgccttggttacttttgttgcaacttgggccatcagtggaattttactgacagcaatcatgcacgctgtggctgtattggtcattgcctgcccttgtgcccttggtttagcaacgccaacagcaatcatttcagggactggcttggcggcaaaaaatggtctattgattaaaaatgctaatgctttggaacttgctggtttagttgacacaatcttttttgacaaaacagggacgattacaacaggtgaatttgaactgacagactttaaattgctgacagaaaatgaaaaaaatactgacagaactgagtctatcaaatcaaaaatgttaactgatgaatttaaaattttggcgagtcttgaggcacattctaatcatcctttggctaagtcgctcaaattttctggtgatttttatgacttaacagatttatctgaacttgctggtcgtggtttgtcagcaaaaattaatggtcaagaatattttgcaggaaatgataaattgatgacggagttaaatttatcagttcctgaaactgaagatacggtcagttatctagcggataaagaaaaattattggcaatggctatctttagttcaagtctaaaagaagatagtgtggatacaattcgtgtcttgcaaaaacgtggaataaaaacggtgatgttgacaggagataatgccaattcagccgcaaaaatacaagagctgattcatttagatgaaatcaaaagtggtttgggacctgaagaaaaagctgaaattgtccaatcaacaccaaattcaatgatggtgggtgatggaattaatgatgccattgccctagcttcagcaaccgtgggtctgacaatggcaaccggttctgacattgctatggaagccggggatgtaacggtgattggtgggcaactccataaaatttcaactttctttgaagtcgccaaaaagacgatttcaaaaattaaacaaaattacttttgggcatttgtttataatattataggaattccgcttgctgcctttggattacttaatccaatgcttgccgccgcggcaatgagtttatcatcagtttcagttattttgaattcattacttttaactaaagcaaaaataaaaagcgttgattaatcaacgctttttatttgtagaattactgacagaagtgaaaattttactaacaaacctgtgagattctatttatttttatagaggtctgggtcaagtaggcctccttttttgaaattgacttcaaaatgttttgtttttagagaataagagacaggaatgcttaccgctactagaattccaagagtaaaggttaaaattgatttagctttcattttgctgacctccagcttttctatatttgttagtgaagtagttgtaacctataaataacaaaattcctaagataaagcaaatgattccttcttttaagccattagggaagaatttgagctctagttgatgttttccagcgggaacagtcacttttgtaaaaccatcttgagctttactgacagggacttttttaccgtcaattttagctgaccagcctttgtcataagggatagtaaggaaaatatctcctttttctttctcattataagtcatgcgaacaccattttttatggtttccgttttagggctacgagatttcaaaagcgccatttctttttgataagtctgagtatctagacgccaaaacgaagtggtatcaaaggtaacttgggaattttcaggaaaagataaggtcactttgagttttgtttctttagcaaaacttcccaaattgaagaaagaaccagtgtcatttgtgccaatataataactattaagggaacgagtcatttttggattagatacatcagagattgtaatcaaagtattttcagcattactgtttagataagtaatatttggtactgacagataaagttggctattggcgtcagctgtaatgccgtaagtgacagatacatcggtagcagtagaggtttttggacgtgttagcgtcactgaacttcccacaccagtaattttgtctgatgtttcttcacttgtagtgtaaaagggagtaaagaaggtagcctttgattgagttaatgcattaactaatgctgtttggttattgataaagttactagctttcgctttatcagtgaatttggcatctttaaacccaccaggaacaaagacacctaagccaattgcatttgagttctgggtcaatgtactaaggctgttggaagcaggtgaaaaaccaaattttggaggttgggcctgactgatattatacttgatagcaaaaattgaatccataagtattgtatttccaggataacgtaagttcaaataggtgctgtcagtatggaatcctaactgacgcatgattgaactggcattgctgttacggacagatgtaaattgggaaagtgcattgaaattatacttcattccatcattagcggtatcaggaacagtattgtctgttctggcgaaagttgaaccagaaagttcatttactttattggcgataggttctaaagaatttacttgagtattatagtagtcacgacttgcaaaattccattctttttgcacgccttgaacttgataaagggcattgacaccagcctcaacggtcataaagataaagagaagaatgacaaaaagatgatttgaaatccagtttctgatagaattaatagataaaatcagataggcaaggccaaacaaaaaggttagcattacttgggaagtcatcacgtatttgtaatggtcaaagactaaagttgacagaaagccaagaattaaaaataggctgatagtcaaaatatgccaagttttgatttcattccagcgagataaagtttcaagagccataattacgatgagcaagctgaataaaaaggcataacgatgtaaaaacatgttaggtgaatgcattccttgccataataaatctaaggcttgaagataaaaggaagcaattaaaaaaacaataattcctagaaaagcgaatttacttcggagtcgaatacttttagtaaaaaagaggatgatagccagtcctagtggcatcaagccgacatatatcattggtatggcattgaattgagtagtatcataagttccaacaaaatttttggcgaaaagatcgaatagatgcgagttttcagtaaaaattcctgataaagtggataaggcatcggaattattagacttcaaatcaagatacattggcaatagcatgattaaactagcgattccagccaaagcagaagaaactacaaaatcaagcacttttgtccaagaccatttttcataggtcatccgcgccaagaaataaagcactaagaaaatggcgaccataaagccaaagtagtaattctggataaataaaatcagtaaacttacaaaatagagccaacgctttccctcatccattaagcggtgaagtccccaaataatcaagggaaggagaatgaatacatcaagccacatagtaatttcaagttgcgaagttaaaaagctcatcagtgcaaaagcagtgcttattgataaaacagtcagattagaaagcttttgatacatatttttgaaactgacaaatgatgatagaccaattaggccaaattttatgatggtaaataaatacaaagcatctggcattgatttcacatcaaagaaaaaagtgaacggcatgagaaaacttcccatataataagccgaaaatgcataaagattaagaccaagtccacttgtaaaagtatataagaaaccttgagaaccaccagaatgtaaaatattacgatagagagaatgtatggcgacatactgatgataagcatctccagccaaaattgaccgtgaacttccccaataaatcccagtcattgcaagaacgataaccattaagattaatggaataaaaaaacttgcaagaagtgcccatttatttttcttgataaatttcataattctattataccaaagatacaaaattcaaccttatattaagtgtattaaaaaaatactgataaaataatcagtattttttatttaatcgaattctaagctcagcagcaatttcttctaattgttcaattctattaacttgtgggattttataaccaataaaataaggcgaagtaataaagcgtggaacaattttacaaatatatttatcgtcaaaatgatggaagaagagattataagaatcacagcgaccattcatgtagtctgtcattaaataagaagtcatttcatgaacgttgtcagcaagtttttcaacatttttaagatcagaaataatgacattaaattctacaaaacccataattggccgagtagataaagtaactgtcaggccatttttcttgatttcaacgccttcaaaattttcttttgcaatttgcgcataaccgtcagtttcttccaagccaacaacctgtaaatgaggatggcgtaaagttccaccagaatgagggccgaaatttttaaacatcaaaaccgattgataatctccagactgaatcatctcatcccaacagtcaaaagcaaaggaaaaaacttcgcgattttcttccagactgtaagtagaaatatcacccagatgttcatcagattcaataattacggtcatcattgaattttttagagttggaaatttattttttaaccaaattttatggtcggaagtttttaatataccggtcaggtgttcgacatcacaaaaaggacaaattttttctttgggtacaacagtttcattacgtttttttgttccaatagctgtattgaaaactaaaggattttcactatgtttaatcattaaaatattataccactttttttgaccactttttttgtcaaaagtctagtttttacttaggcaatgtgttataatattccagttacctattaatgttcagccttcaactgtaacatttacaaaagtcagccttcaactgatattttgtctaacttgaaaagaaaaaatttactgacgagacgactaggatatctataaccgctgaagcgtcaaggcttttcctaaggtaaagctgtcagtaagatttttgtcatttcaaaatcaaaatagaaagagatggtgaaaaattaatggataacacaaatactcaacttatgtctggtaaaagtccagctcaaacacgtgtcgtcgtcggaatgtccggtggtgtagatagctcggtcacagcattgcttcttaaagaacaaggctatgatgtcattggtgtcttcatgaaaaactgggatgatactgacgagaatggggtctgtacggccactgaagactacaaagatgtcgcagcagtcgcagaccaaatcggtgttccctattattcagtaaactttgaaaaagaatactgggaccgtgtttttgaatacttccttgccgaatatcgtgctggacgtacccctaatcctgatgtcatgtgcaataaagaaattaaatttaaagctttcttagattatgctatggaattaggagcagactatgtcgctactggtcactatgcccaagttcgtactgatgaagatgggactgttcatatgttacgtggagcagacaataataaagaccaaacctatttcttaagtcaattgacccaagaacaactcaaaaaaacaatgtttcctttaggtcatttggaaaaaccagaagttcgtagaattgctgaaaaagcaggacttgcgactgctaagaaaaaagattcaacaggaatttgcttcattggtgaaaagaatttcaaaaagttccttggagaatacttaccagcacaacccggaaaaatgatgacacttgacggtgtcgaaatgggaaatcacgctggattaatgtattatacaattggtcaacgtggaggtcttggtatcggtggacaacatggtcaattaacaagtgacccatggtttgttgttggtaaagacttgactaccaatactctttatgttggacaaggtttccaccatgaacatctttattcaacaagtcttgatgcaagcgatttgagctttaccagagaaatgccagaaacttttgaccttcactgcacagcgaaattccgttatcgtcaagaagacacaggcgttacgattcatgtcaaggctgataaagtgactgttgactttgatgaacctgttcgcgcaatcacccctggacaagccgttgttttctatgatggagaagaatgccttggtggagcaatgattgacgtagcttacaaagaacaaaaagtgatgcaatatcaataaaatacgaacctgccaataaaatgcgttaattcaaggataaacaaaaaacgcccttaaaaagtagcgtttttatttatagtaaaaaaagagacctatcggcccttttaatttatttccacgttccgtcttcaaatgttactgaaaatggtccatcgtttttagcatcaaaataaagttttgctttgacaacttgcccaatattaacagaatctggcatattattttcataggtatttaaatctaaatttaagacattcccctctgaatcataggccgtaaaatcatgggcattaaaactaaatgctttttttcctgtattttttatacttacagtaacaactagaggtttcgaaccgctctctgcttcactgtttagcgttactgatgaatcaatattggcacccaatacattaacttcaatattagtatcatcatttgaaaatgattgactactaccaaatttttctgtgaaatctgtactactagctgtagatgactctattgtactctgtgaagatccataacccagatatccatctacatatgaatcataatttgggacattactcatcatatactcattaaattttttattaaaagaactcgcctcagagtatgatttactcattgaagctatttttttactagaaacggcatttttagatgtaactgcagaaactattactaaacatataattgcgacaaatatactacacatggaaacccaaaaccacagcaatctataaaaaggtttattttgttcttctttcataattttctccttatttttataattcattatacacttttaaaataatatattgcaagcgttacctaaaataaaactaaaaaaatagctcataagagctatttttattttaatgactgtccaaattcccatagtgataacactttttcttgtttaggctcatctacgctaccatcatttgatataatttttgcaccaaccacagaaacaactgtagaaaaatcattactaaggatatctgctaaagtatatgaaccagtcgatactagcgtttttacaaagtctagaaattcagaacgagcttctgagactgtcattgttcctttttttcgtcacccgtaacttcttttgaaccagtaatcgtttcaaaaacatctttaatgaaattttgcaattcccaagcaggtacacttgccaaaattgatttttctgttacctttgaactatcgaataaaccagcgatgaaattaatccgttttttataaacgtctgaaatagacatcttatcaacgtttttttcaatttcaactgccatatcccaataatcaagaagcttttgaccgctaacatgttcttgagtaacagtaaactcaccgtctttatcacgaagagtaattgacagcttagtcatttatttcaccctcctactgccaatgaggcatcagctttaatttctgcaataccagctgcatcagtagaagttccatttcctacaaaggtagagtagtacaatcctttgtcatcagaaccaatggcaaagctaatagcttctgatggaagttcactttgtttgccttgtaatgaattaaactcaagaccatcagatgagaacattccatccacaaatgccattaaatatggatgtccttgaggtgttacatcttccaatagaatcgagcaatatggagaagtgcgatctgcagtagctttgtatacaccattagtagttgcagtaattccaagcactgcatttttaattttttcagggaagtccatgatatcgaactcaactttaccatctccaactccttttcctgaaatggagtatactttatttgaagaataagattttacggcatcaaccgctaatcctgatactttagcggaaaccataccaccattatctttttttccctcgataacaaactgagttttatcaagaactgcagttttaccatcttttatacgaattgttaaacgtttaaaaccaataggcactgacattgttttttctccttattttcaataattttcgtaaagattgctattgccttcataaaaccgagcatccacatatctttttgtatcgctaaaatattcatctagtccgccattcatctgaaagaatccttttgtttttagaatattttcaactgtattttgtaatttttttactgttaatcggtcaattgcctctatgctgacctgataaacaaaatgtttagctagtgaatcattgctactcatagctgtttgttccggtggaccagtcggagtaattgttatacttgttgagcttccagataaattttcatatcttgaataacttttaaacccacctgttctttgaattgctagaatatcagagtcattagctaaagtttgcataagttcacttagcatatcattcattttagcaactccttcaaattagcttgcgctgtcttaacaaatttttgtccttgagcatttgaaaatctttgtaaagcaccaaaacttttataacgatatgatttaccatttctgacaaagccattattttcaagatggacaagtctccaatgattaccgttgttacctatctttatggcggggaatcctgatgttctagaaacattccctcgaacaacaccagctactgtatcaccagaatttgcaaattgagaaagggtactctttaaatcaactacagcttcatccgcggctgctttaagtgcatcactttctatcttcttcacacgagtttcactaaacttttctctcaattttgcttcaattttttcaaatcctttgattgtcattgaactactcattaagattcgtccctcctagaattattttcaagaaagttcggtcatgaaaatcaggctgaatgtctactatcccccaaacctgacctgaatatctaggatcatcaataataaccttgtcatcatttttaggttgataacttgttaagggatcacgaatttttatcgttgctccattcttaacattttggcttcctaaaatagtcaagtctttattgcttgggctatacacatccgcaagtgttttaaactttttaatcagttctccacctcttccatcaaaagaggtatcaggacctactcgtttaaaagtaactgaagttcgcatcgttccattgttcgttcggttagaagattgaaggactttttgcgattttatcatcactttcctcgctttcttaaggttgattagctagaaaaaatgattagctagaaaaacgtcacgaatgttttgagcatagttctctttgaactcatcaagtgcatcattgtaagtataacgtgaacgctcatagattaactcctcaacttcggggtcagtcgcatcagatacaccaaccaaccgaagaattgaagtataagaggcaatgagcatttttgttaaattgacaagttcatcaggatcttctgtattaattctcatcctttgtttaaaagatttaagatgaccatccgcccaagtttccgcatcgctcatttacttctcctttactattaagcttctgtgactgtaactggggcaacattaggcatgaagttttacaacctgagctgtattattgtcgtaagcttttccgtagtagaaagctttgacagtataaagttgcaagtcttcgagagcgaaagtttggtcaaactcttgcattcttgttccgcccatataagcccagtagcggttagccgcaaagattactgcttttccttttggcactgcaacggattgaacaatttcaacaccgaaaggtaaaacagttacccaaacaccgttatgcgtgagatacatgaatttagcaagagtagagtaataatcatcaggattaactaacatttttacttgtccagagacatttactgtgatatttttttcgtttttagagagagcttgcattacaggggcgattttttctgctgcattttcaggatcaatatcagtccaatctgcaaaatcggttttatctggatacgttgttaaattacccttgatagcgccgttagcgagatccttcatcaatccaacaggttttttatttccatctcctgcaactacagctgtttcgagtgccacagccatcgcttcagacatttgaatgataataaatgatttcaaccagtcataaccattttcaagagcatctttagggattgcgacaaaagcagttaatttgttttgagagaagtctacttcgttgaaagtttgttttaattgacccttaatgtcatcaaaaactcctccccaaacagccgtactaccaccataaattgaatcagcgactgtagctctcattttcaatccggcgctttggaatttgataatatccaaaagcggatgagcgttttgtaattccagaaatacttggttcataagttcaagaggcaaggtcacttctggtttccctacgccagaagtaatatcattaaagaatttagtttcattttcagaaagtccattagttggacgcgaagccattaattcgttgattttatctgatgttgaagcattcatgttttccataatttcagctccaagagtgttcatcattttgtcaaaagctttagattgtgctgcttcatctgcaccctcttttactgcattagtatatctctctacagccgctgtgtaattaggtagttttgtgtaattcattatttaattcctccaaatttaaatagttgatttttaagcggcttgtctgccgagttattagctttagttgcttctggaacgtcagtttcactgttttcaaatgaaattatttgatccaaacgatcggttagcccttggtattgttcagaatcaagtttaacttcttgcatattattagtttcattcttaatctgagccatcatgaaattttttagcttagcaattttttcacttgagaacataggctctattgacgccatcatttgaagtgaggcttttgtctcttcaaataacttttcatcagcaattccagcctctacagcttggtcagccgagtaaaaagtttcttcgtccattgcagcttgcgcttcatcgagtgagcatcccattcgtttggcatacatttttgcaatactagaactcatttcttttaacatttcggattgtttagccatgtcacgataatcgccttgattaactgaccagacattatgaatcacaattgaagctgctggggaaaccgcaatatgttctgctgctagcataatgacactagcgattgaagcacatagacctgtgacttcggcagtaattttcccttgatagttcatcaacatagtgtaaattgaactaccactggtaactgatccacctctggaatcaatggacaatttaacatcttcaccgtttgcttcagctaaaaattcttcaactgacttagcgttaatattttcaatttctaacaaattgtaaaaccatgcatcatctgaatcaataactggaccatgtaaattaagtgttttcactctttttctccttcacatggattggaaacatctatagagatgtcaatttttgctttagatagtttatttaaggtattttccaattcactaacctggtattttacaactgtaattaaatctttaacttcttcaacccctgttattttcgtagtgattggggtcataatttctccaaatttactcatctttttcttttcctttcttttcataatttttagtcataataaacacatcaccatctggtgttggtggcaatccagctgcctcacgaacttcattaattttcactacaccgctggatccaactttatcaatcgcatctgcacggtcaagaatattaatcgttttaaagccagtcatttgcaaggtattcccattcataaaacctgattcttttattaataaactggcaaatccttcagataacttgtttccaagtggaatcgctgcagattcaattgctaaatctaaattctcagagttatttgcagtctctccaagaactaaagctggcggaattcctatcaatccagctatttcaccaataaaaatcttctttaatgtcccaaaatccgtgatttgattttgaagcgttgctgatttactagaagaaatttcatcataagcagattgtgctttaccattgtcgggtacgaatacaatagggtctgtgagtaaactttgagataaagttgtcgcaaattgtttttgaacttttttttgctcatcttcttcaagtttggtattgacgggaatacttaacttggctctcaactgaccaactcgcagttgattggtaattaatattccaaacaatttcccataatcttcccacagactatcaatatatttttttattccaatattgtcattatccaaatggaaacagtcaactccttgagtaaatactctatcaaaatacttttgagcatacggaccagaatttggagcatttgcgacattactacttgagaaattaatcgttacaccagaataggtatttccatctaatgagtagtttgtaacaaagctatcagcgacataaaatttatcattatctctgataactaataattcgccattgagtagcttttttaccattgctactttaaattcactggcagtttgatttggattaggctttacatttaaagcataattaaaatctgaatctgtaatagaactttcattcttaaatacaaattttcctttagaaattaatcgtgccaagtaacttacacatgattctaaagcagcatttttcattcctagggtagcttgtgcattaaataaggctgtgtaaccagaaacatcagtattttcaattttgcttttaaccgacgcccaaatgtctgaaaatagtcccacattttctcctttccgtacttttaattcaagtttaatggaaaagtagagcgaaaaagtagcgttctttataaataaaaggctgcccattggacaacctgtaataaaatataataaatatagttgactaatattggctaagccagagcataacctgcagtgcacgtattattaaataccgctttacgtgtaactccagttgcttttcctgtataagtaaagctaaagccagtggttgttggtttaaaatcagtcacttcaaaaaagtgataagtttgtccattgtttgtaaatacgatcagctctattttttctcctttaatttcctttggtttcataggtgcattagttcttttaggtcgctcaagatccatgttattcctccaacaataaaaggctgcccactgtacaacctgtaataaaatataatcaggatagctggatttgaaccaacgacatctcctttccaaaaggagtaggctaccagactgccctatatcctgtttgatacgaggttttacatactattaaacggaaagcctcgttaaccatttaatactgaactcctagctttgaagtccacaatagcaagatagagccacgaactctataacttctattagcgaagtcgtttctatcccttgcttacccactaagctgttagtcaaggactttcactcactacttgcctagcctttccagcaagcacttagctataaacgtttaatagcaagccactggttcgagcaatgacttgcttagaagtatatccaaccgaacgaattacattttgtttgctttcgctgataacttcataagtaaattatctaatatttttactctcaaaaagtatcgttttatcccataaaccaactcaaattgtcatagaaatcagtggtatctacttcatttagtaaatcagccttaaacattgctgcttcaaaagctttaaatccatctgtttttcgtctaacatcttcttttttgatatattccacattcccatcttttttcaaatgtctaagtacattatttgtgtaccaacgcatcatgtcattatcaccaaaattaattttttgattggcgaaactatcctcaattaccgttgataattgcgcatcaatagccctaaagttgcgaataacttccacacgataaccgagcggttcttcaaattttccattccaagatacttcgaatcctgcttcttcaaatttaggttgtaaatactccctcattttatagccgtctccacaaatagtttggaattcataaccttcttcatcacgcatacgaacaaaccagtctacaacgtgctgtgcatccattgagggttcatctaatactgtgagcaatccctcgtcttcccattgtctaatcggggcaaatcgccgcttgccattaacattttcatttggttttgaatagctatatattctatcgacaaattctttacgaacaaatgaatgagatttgaaaacataatccccttcaatcttaaataatgcaccaactgcaataaagtcacgagtagaggcaaagtcaaatcctccaactgctggtaaatttcggagttccgggaactctttttttgttgcttttaattcttcataagtggccacgcttctttcaatatctgtcaccggcaggttcatccgtttagtcataaattcatcacggccactcgggttaacctctagttttttatattgttttgtaacctttttatacaatcttttcgcataactgctcattggaagagtaaacataggattagccatttcccaatttgttggatcatcgacttcttgctcatcgttcagtttgcaaataaaaggaaataattcatcaaaatcagcatcacctttgagtactttatgagctaattccttcatttcatcaatgaatccctcgcgaacaaatccatctgttccgatatagaactctcttggattagcaactttccccaaaccagaaatataaacatctgttactttatggtcttcatattggtgtatttcatcaaatactactgcaccgtcacgcaaaccatcttttgtatttccattgcttgtcttatagcgaataatagactgggttttgcgatttttgatttcttttttaccccaagaaaacattctttgaagtttttcattcatctcaattgtgtcgtagatttcttcaaagctcattttagcttgatcttcactatttgcgacaagcgaaatatgatatttgggaattccgtgcattggagtttgcaagtagttagttactccagagattaaaccattcttaccgccaccacgccccatcatgattaaaaattgttcaaaaacaatatcattcccatcactccaaaataaaaaaatgaaactaataataaatttttgaaagtcctctagtttaaaataaaatgtttcgatatatctgatacatttatttatttgactttcatcaaagtaaatctcttttctttcaagacgaggttcaatttctctagcgatatattcaacaagttctatacgttccttgttaagttttactttttgagcatgataagaattgatataatcactgacatatttaatcagcatataaatcttcctcattaaaatcattatttttgcccttttcggctcgtttttcctcgaaaaattcatccaattttataagagctgtattaatttttactttctcagaaatggcaggatttggtttcaaaaattcttgattaccattaacgacttttatcattgttccatctttagaaatagatttatcaaggtttctggatattctaaccaaactacaatatctctccaccttttcgatttctgaagctgatttttcattaattagccctaataattctatttcaagtttgctttttgccatggataccccccctttcaaaaaaatggctttatatttggttaaaaaaccccaaccggtctggggtaaatttggaaatagacccaattattttagacccgggggtatattttaattatttttctgtaatttccgaacaataaaatcagaattcaaaagtttcatcatcaaactgcttgtatctgtgtctatcgtgcctcttgttgtggcagtcgtgacacaaggtgcgcaggttactaggttctagtgcaagctctggatgatactcaagctccttgatatgatctatctctagtgtcgcagtcttagccgttgtcactcttccttctgctttgcaccattgacattcattgttatcacgcttgagtatctgttctctcatacgtctccaagctcctgagcaatagaacctgtgtcttgcctttggtgtactcacatctatcatgattcaatcgtaaaacaaaaacgctacgaaaaagtagcgttctttatattaataatcttctgccagccattccataacttttgtataaactgtcgattttgttttataatttccttcttcaactttgcgtaaagttttctcgccaataccaataagtttatgagcttctgattttgtcagtcttaagtcggccctctttctccggactgcttttgcttgcgcttctgttatcgttaacattatgtggttatcctttctgttatattattcatggaacatcttaagtaaatgaccgccgtcatatttctcagcaaactgctgcgtcgctttgttatttctagcaatgactgcagtctttgagtaatacatattcatagtgatcttaatgatgccccagcgatcaatgtaataatgtttgaatatcttacgatcatcttcatctttaatattatctaatgcttcattgataagctgagattgtttggcattcttcttattacgaatgataattcttaaggtcattcgaacatcgtgccattgtgctttcgtcaattcttttgtcatattctaactcctgttatgttataatagtattagatataatcatgccgaagcccattgccgtggactttttttctattcttttgcagcttttaaatcattgtagaactttattattttttcgacttcatctacagttaaccctcgaagttcaactatttgctttttattagttgaaaagagaccagtgttatcttcagttttgaaatagatttccattttccctccagttgagtttagcgagttcctagctcagtatgatataatacgtatgaccataaaaattatccgtaaaactttgttctattaagctcgaatttggtcaactcgggctttttttgcgttcaataagtcttttttatcttctcctatttaaaataatgcaaatatttatggtgattgatagtaacgaaattatgaacgatatcatatttataatcagaatcactccacaacctccttgatataggcaactttgaaagctgcgttgtcagcagtgtaccaacctgcattactttctatgtcttgaattaaatctgctaaactattagcttcaataatactcattacacacttaggttttctatattcgctaacgaattctgcgctatataattcaaattttttcatctccacctcaatccatatgtttatcaagccatttatcagcttctgtcatttttttgttctcctttaaattcgctacccagtcacacactttgatgaccagcgatattagtttgtcggtcattcttagcctcctaacatcgcctttttaatattttgtaaatacctgagctgttgcttggcgtaacctaattcctggcaatcactcaaacgtttatttacatcttgtacaacagaaagcggaaaatcgaagctgctgatcacttcacttatttgcaatactactttttctagttcagtcaattttcatccctccaccactttcactaaatcaactccgagggctctgcctgcgaggtaggcaatgcagatatacccgttttctttgttattccaagcatagcgtttaacggtatcattgaactcagtgagatcacaatcttcatttgataactgagtaattggattatgaaaaggtactttatccaacgcatccgcaatgcttttcggaatcgtgagctggggttggctatgttgcgtttgttgagataatcgtgctatctcgtttcttaatttcaagttttcagcccttaaaattccaacttcgtgttctaattcactcattttttcacacctccttagtttgcttgtctgtatttttccataacatttggatatttactaacaaattgtaattgttcttgatgtaaacgactagaccaatggaaaagtctatcaatttctgctaaagcgctcaacttttggtagatctctttaatgtaaaactctgcatttcctactgatttccaatatgctgatgttctaactgtattaccattttcagcaagtttttgtgcgttaatatcagccttttcttttttcgtcatcaggctatcaatttctttgaatataatctttaataatttcacttgatatttttgtactatttcctctgttgttgtcatctatcccctccaatcgctgcgagtgctttttttaaatcctcttgtcattctccgtcctccacaggcacagcaaactgccagtaacgctcatcaattgacttgatttcttgttcggtaaaatgcactgtgtgcttttttgtatttgataaaaatccgacaaaatccacttcatctgtttctttatcaattctcaaaaagtcaaaaccattagttaattgcgatgcatcatcatcccaataaacaattggcattttgacctcgaacagctgcggtttttcgaccctgaaaccaatgagcagagcagttaaccacgttttttgatgattatcaatccaatctaattccttttgaatttcaagatagcttgctgaatagttaatatgcttgccatcttcaggggtgccaaaggtattgattaacttaccaatgaaatcaggcacgactggcagggcttgctgtggttttgcgttacttagtttactttcaagataattgatatattcatctcgttcttgaatacacttgtgagcttccctatttttgttagtataaaactctacggcattgcttagtaaaggcttgatactatattgagtgatattgctaatcggtcttttcatttctttagtcatttttcgtgtcctcctctatttcacaactcttaaaataatgctattggcttttttctcagagtatggtcccacatattcctttaaagcagctttaacgcattcttttgcgtactcttgcatttgctctgctgtgaatacatcaacttctttgatatattcgttgaactcgtccatatctttataaatcctaaactcgccagtaaaaatctttgttcttcctaccgcttcaatctcgcttagtttcatctagctgctcctataatcctaatgcttcttttcttgagttttcgattgccatttgcgctctgatatttcttcgcaacctacgttcttcttttgtttcgtgttttcttcgctctttttcttttgttccaataagttcttcttcttgtgggactgaaaacaatggaaatctttttctagtttctgcttcgtttaaaatcgcatgttttcttgtttttctgtaataaaaagcgtgcttaccaacttggatatatgaatatacgttacttttgctaatactctttagataaatttttaaaatcttcaagggttgcagaatttggaagttttcttaacatatcgtccaaatcatagtttggttttccataaatccaagtaatcagattagcagtatcatcaatttggcttaatagttctgcaatatctccaaaattatttcctcctagatattctgaaatttcatttgctggacaaagtatgtacttttcagaagtaacattttcattccccgtttcaccccacgaaaatttcaccttagctcctgtagtttgccctaaagaaacattatattgaatggtgaatgtagcaacagaagtattatcttcattttttgttgtaccatcgggattagtcgtgatatgatctttgttataaagtgtgagatcatcagtccctgcagtttctataattttagcctctttattatcaacggaagaattgacatcatatgtgacttgcacatcagctggatagttgagattaagagaataatttacacctgcaggtacagtaatttttaatttttttgtaaaagtttgctctgtattattattagaaggggcatcaccaaatttcgcttgtgcaggtgttagaccaggatttacacttccataacgattaatcaaatctagttcattttcatatttagctgtactgattccttttttatgcatggcagtaaacaaagctgaataatcttgacttgtccacgcgatgttggacactgaatcatttaatttgtccatataatcggttgagccaaagctatcagtttgcccaaatgaacttattaagttttgagcaagagcctcccttgcattttcgtccttttggtaatcacttgctatttttgaatcattgaagtttgaattatttaagtctgggttagtttgagcaaaaaattgtgtgtaaagtttgttttccaaatcaattaaatgatctcggttagctgtgagactatcaatttggctattaatatcatcatgaactcccgtaattagcgtattataatccttcacttgattttgcagattagttaagacacctttttcgcttgaatcatcttttttatagaaattaaagagattattgagcgtaccagagtgtaaatcatcaaactgtttaaaatacactttttggtcatcttccgattgatcagtaattcctttattaccatttttaagattgacatcagcaatttgtttttgtgtatcaaaatactgtttcaaacccgttaattggcttgtaaatgttttgcttgtggaatcaagcattgactgagtagattttgtaaaactattttgagacgaaatccacgcgctattttctgatttcaagccattggcagcagaaataacagaagaataattttgtgttgttgactgaaaaggaccatagacatcattagacagattagttaagacatttccttgattcgtaatcacatcattcatattattctgtgcttctgagatattacctgccacagaagcatagtacattttaacaatgttttgattgaaatctttcaaaacactcgtaattttatcatttagcacattttgtgacaaagcagattgactaaactgcaacttataattaacttgtgatttgattggattaatatcttccaaagtcaaaatatcatgtgaaaaagcttgtggaatataaatcaccgcatcaactgatttatctgcataagcacggtcagctacagaacgagataccacttgccagttatatttagaatctccagataccaaacttacaaaatctttcccaaagttatagtcttttttattaaaacttgaagcagtgtcctcattaacaagggcaatcgttggttttgcaacaacttctttctttttagttctaatagtcaagtaaacaaagacgcctaaaagggcgataagagcgacaagtaaggatgtaataattatccaatgtctttttttcatttttttatctaattgtttattcataaaactttcctcttcctcagatagtcgtttctcgtaaaaaataataagaatttaaatatcatttagtttatatatcgctctgcatattcactataactgggattttcttttttgttcattgcaaatatcagtgttcctcggaaataattatctgttgattctggttcaatcatcagagcaatatttttatctttttctggaaagataatactataattttttccattttcttctattccataataccttatgccattttctattccaatcgcattttgagtatatttgtactcatctccctctatcattactttcttgtcagtaaatttaagagttaaatttctttcatcaccattttgagcatgccaagtaccttgaatatttttggatcctttacatcccgtcagaagacttaacgtcagtctttcattatttccttctctttctacgtgtcaaacttctagcaacatatccggttaaaatcattaatggtaatgtcagaagtaaaagtattaacattccattattcttagagtctttcttcgattcagttgatgctacatttgtctgactataatctctaaataatttcgttttaagactttgataattcgttttatagagtttattttgactttttttactgaagtctatatcattaacatgctttgttgcttcttcagtatttctggctttttcttgtgttttcttatctaaatcttttgagaaaagttgagagcgaatagcaaaatctgaggtactagaaccagctcctgattgagtagtaatcatgtcagagttaagctgtaaacttccatcactatcagctaaaacaacaaaaggactataaaaaaacaagaatagtccactaaatattaaaaatacttttcgttttttcatttaatctccataaaataaggtttatgaggccctatactccttgccccttttcatatctacctttagaaagagccaaaataaaagagcaccgcagggggtgctcatcattaaaatccaaaactttgagcatcttgtgcatcgcgttcttcaacagtatcagcatatttattcaactgttggttgatactttcgagcaattcttcaaatttacgaacattttgttctaattgattatattgttctaagtatgcttgaaaggcttgacctttccactcttcagcaattgtagaattcatagaattcactcgttgaatggcttgttcaatttgctctttagattgaatgtaaacttgtgcttggtgttttagctcagcaggcgttacggaaatagctcccattttaaattctccttaaaaaattaatgtttttgtaatcaatacaactcattttctaacaaatatgttatatagaccccaattttttacaagtttattttatcacaacggatttgttatgtcaataatttttttgttcttaaaacgaaaactaaaagaactaaaacagacaaataatttctattacattactttttgatgctttctttaccgatattcttatttgccacttcttactattttcccaaatggtttgataacaacaaaaaaacgcttcttattaataaagaaacgtttaatagtatttttaaaattataaatctgtaacttgtactgatttttgggaattttacccgatagaaccttccattgaataagaaatcaaacgatttaattcaacagcatattccattggtaattccttggtaaatggttcaatgaatcccatgacaatcatatctgtggcttctttttctgtcaatccacgactcatcaagtaataaagttgttcttcagaaatttttgaaactttcgcttcatgctctaaggcaacttgtgaattgtgaatttcattgaatggaacggtatctgattttgataagtcgtccatcaaaattgtgtcacattcaatatgagaagctgattttttagaatttttcccaaaagtaacttgcccgcgataattgactgctccaccatttttggcaattgattttgaaataattgagcttgaagtatttggtgcattatgaatcattttagcacctgtatcttgattttgatttgctccagcaaaagcgattgaaagcattgttccacgcgctcctggcccatttaaatgcacagcaggatatttcatggatacttttgaaccaagattcccatcaatccattcaacggttgcatttttttctgcagccgcacgtttagtcaccaagttataaacattatctgaccagttttgaatggtagagtagcgcatgtagccaccctcttcaacaaagatttcaacgactgccgcatgaagtgagctcgcagaataagttggggcagtacatccttcaacatattgaatagaggctccttcttcaacaataatcaatgtccgctcaaactgccctgatttttcgttattaatacggaaataagcttgaataggaatctcacatttgactcctttaggaacgtagacaaatgaacctccagaccagacagcagaatttaaagctgctaatttgttgtcagttggcggaacaagtttgctgaaatattttttgaaaatttctggataatcacgtaagcctgaatcagtgtcagtgaaaataattcctaatttttcaaattcatctttcatattatgataaacaacttctgattcatattgggctgaggctcctgctaagtatgaacgttcagcctctggaataccaattttttcaaaagtatctttgatttcttgaggaacatcctcccaagaacgagccgcttttgctgatggtttttgataataaacgatatcattaaaatcaataccagataaatctggtccccattttggcatgtctagctttttaaaagcttcaaaagattttaagcgaaattctaacatccattcaggctcgtttttagtttcagaaatttcgcgaatgacttcctcggtcaagcctaaaccggttgtgaattcaagttctgcattatcatgaaatccaaatttatattcttcgaggtctttgacaacttcttgtgtactattttctgtcatttttcttcctctttggcattttattattgacagacttttcagcctagctgacaagtctttaatttactgataaaaaatctgtcagtaaattttagctattcaccatgaattactgtttcttgtgcttcaccaaaatcaatggctttttttagagcattccaagctagggttgaacattttacccgagctggaaatttactgacacccgcaagaaattgagcatctccaagtgcttcttgacgttcgtcagtttctcctgttaccattgctgaaaaaatagttgccaactctttggcttcttctttggtttttccaagaactgccactgtcatcattgaggctgaagctgttgaaattgtgcaaccatgaccgctaaaggcaatgtttgaaatcacatctccttcaaattcaacagtcagtcgaatgacatctccacaagttggattattaagatcaatcatacaacctgtatgtaattcaccagcatgacgcggatttgatgaatggtcgagaatgactgcacgatatagattatctaatttagataaagccacgctttcacactttcttttttctaatttttatatattgttttgatttatttttgaaaaaaattgaaatctattcataattactgacagaattattattagtcaataaattttctgtcaattactttttgctaatttagtcatcggtctttatcccatttttacgaatatatcgaaggacaagattcgctgcaatcactaccgctaaaataatgataacaaatagtataagtaagccaaccgagccttgaacaagtgagcgaaaaaggctgagccctccaatagcataaatgaagccccatgctagataacctggtaacgcggcaagcgtatatctaaaccaagaccagtttgttaaacccgctccaaattgaacagcagtttgaaaaccaaccgttaaaaaggagaggggaataattggccaaccaatccgttgaatggctataattccagaggaggtttctgaatttttttcaagctttttgccccactttgtttttaatattccatggtaactcaattttcctagccaaaaggtacattgagctctaaagaaaacaataacgaataagaaagtggttgccaaccaaagtgggagggaggcgacccaattaagcatattaatcaagtttgaaaaactcctttgttttttgaagtgcctcaaccaatttatcacagtctgctttggtattatagatataaaagcttgctctagccgttgccggagtatcaagataattcaataatggttgagcacagtgatgaccagctctgacagctaccccttccatatccaatgccgtagcgacatcatgcggatgaaggccttcaatattaaaagcaataactccactacgttttttgttatcttttggtccataaattgttaagccttcaatattctgaagttttggcatcacataatctatcaattcggcttcatgttgatgaatttggtcaattccaagctcttgaatataatcaatagctgctcctaaagcaatagcacccgcaatatttggtgttcctgcttcaaatttccaaggaagttctgtccaggttgaatgactttcataaacaaaatcaatcatttccccaccaaattctacgggttcaaattgattaagtaattcttctttgccataaagaacaccgattcctgtgggtcccatcattttatgacctgaaaaagcaaagaaatcgacatccattttttgaaggtcaagcgccatatgtggcgtagattgcgcgccatcaacgaccagataggcaccaccctgttcatgagcaatttttgaaatttcctctatcggattaatcgtccctaagacattagagacatgagcaattgacacgaatttcgtttgcgctgtgactttttgacgcaaatcttccatatccaattcgccctctttgagataaacaaattttaagattgcccctgttttcttagctacttcttgccaaggaacgatgttagaatgatgttccataatggaaatgacaatctcatcatctgctttcaagatttgtccagcaaattgagccacccaattaattgaggtggttgttcctctggtaaataagacttcttttgttgatttagcattgataaaggcacggactttttcacgcgctgcttcatatttttcagtcgctcgctctgctaacgtatgaacaccacgatggacattggcgttatcattttcataataatcctttatcgctgaaaaaacgctcaaaggtttttgagtggttgctgcattatccaaataaaccaaaggttcatcattaacaatttgattcagaactggaaattcatttttgatgccttcaagcattacatgcccagctttctttcaatagtttcaataaattctgcttgaactgatttgacaggaatttcactgacgactgagccaaggaatccacgaataacaagtcgtttagctgtttcttcatcaagtccacgagattgaagataaaataaatcttcttcatcaacctgcccaacagaagctgcgtgacctgcggttacttcattttcgtcaatcaagagaattggatttgcatctcctcgtcctttatcagaaagcatcaaaacatgagatgattgttgggcatccgcatttttggctcctttgataatatgaccaattgcattaaaggtcaaagttcctttatcaagaataacgccattttgcaaaatgtgtccgacagaatttaaaccaaagttagtcactcttgtggcaattccttgcgtttgatgacctgttgaaattccaaccacttttatttgtgaatgagaaccattccctttaaggtcactgtcaaagtccgccacaacatttccgtcattcatgactccaactgaccagtcaaccgttgcattatccccaatcaagccacgacgaatgactgatgctgtgacattttttcctaaacggtcaatggctgcaaatttgacttgcgcccctgcttttgcaataacttcaacaactagatttgctattgctttggctgtttgctccccacttgtttccaagcgctcgagataatcaactttcgcattttttcctacaataagcaaaattcgtttattaaagggaacttctgatgaaccctcttgcatcaaaattgattcaatgggctcaagaacttccacaccatctggaacatagaaaaccaaaccagaattaaaagttgcagcatttgctgctgttaaacgactttcattaaagggaacgacagatccaaagttttcttcaactaattctggaatttctgtcaaagccgaattaaaatctgtaaaaattaccccttgttcagccagcgttttcgtcatttgttccataaccgtttggcttccaacttgaacaagtaagggatgatttgggatttctgtaaaagtgggaacagagccaatttcttcattttcagaaattgttaaatggtctaagccccaacgattgattttaactcgttcaatatttggtaattctaaattttcaaattcaagcgccgctttttggcgtaaatctgacaaccaagctggttcagcatgcatttgtgaaaagtttaagatgtcttgattcataattattattagcaagtttttatttttataggtaaacttatcgatttattgacaaattattctgtcagtaaattgatgaacatttaaacttactgacagctttgtcagtagataaaaatagacttactagctcctttccttaaacttcttctttatattctagtccaagttcctcagcaatattgacatatccttcagtttccagacgtttagccaattcagcgccaccggttttcaccacacgaccatccatcatgatgtggacaacatcaggtgtaatgtaatcaagcaaacgttggtaatgtgtgataatcaatgcaccaaatttctcgccacgcattgaattaacaccttttgcaacgacttttaaagcgtcgatatcaagtcctgagtcaatttcatcaagaatagcaaaagttggttctaacatcaaaagttgtagaatttcatttcgtttcttttcaccaccagaaaatccttcattgagataacgttccgccatctcttctttcatgctcaagacatccatatttttatccaattttttgataaatcccatgacagaaactttatcatcttcagcacgtttggcattcattgctgcccgtaaaaattctgcgttagtgattcctggaatttcagatggatattgcattgcaagaaataggcctaaacgagctctttcatcaacttccatctctaaaacattttgaccatcaaaaagaacttctccctcagtgacggtataattagggttacccataatcgctgccgataaagtcgatttaccagttccgttaggtcccataattgcatgaatttcattggtattgatgactaggttgactcctttgagaatctctttatcttcaatcgccacatgaagatttttaatttcaagtgtagccattttttcgctcctttgaattgtcaattgtatttgacatttatagtctctattctaacaaaaaattgataaaatttgttattttcgctcatattatttttatcaatcgcaatataaaaaataaatgccatttggcttttttagataccaaaaaacctctataaaattagaggtttttttattttttatgtcgacttcttcgataattttgaattggaaattcttgtgtcggttcatcaacttcttcatctactactgaatactgttcttggtctttattatctcttttgtcagtccgttcagggtgaagaacttcgtcacgataagctgaatttccaacgaatttcaaagctttcaagactggctgacgattttcacccagaattccaacaagttcaataaagatttctagtccaaaaagacatgcgattactagtaaaatcccaccaattcgacttgaaaattgtaagagaatcgagataaaggcaaaaattgaggcaattccataaattacaagtacagcgccgcgatgcgtaaagccaagtgccatgagccgatgatgcaagtgccttttgtcagctgttgcaatagattgtcgatttaatttccgacgaatcatagccatgattgtatctgtgagcggtactcccaaaattaacaagggagttaaaacggctacagcagtcgcatttttcaagccttgtaaagaggcaaccgagattatgaatccaaggaataaagctcctgtatctcccaaatatataattgctgggtgataattatagggaaagaatcccatgattgcagctactaccgtgaaaatagtaattggtaagaacacatttggacttggtaggaaaaagtaagagacaattcccattgtcgtcagtgaaataatggataccccactggcaagtccgtctaaaccatcaattaaattaatcgcattcgtaatagccagtatccaaaataccgtaaagataaaggataaccagcccggaaaaattaataaaggaccaccaaaaggaatttttaaattatcaaaacgtgcattggtaaagaaccagataaaactcgcagcaattgtcaaacctaagagtttcattttaggtgatatttcttttatatcatcaaccaaaccagtcaaaacaacaattccaccacccacaataaagggccaaatgtaactcaaataactaactaattgaatgggatggtgaccatttccgtttccgggaggttgggaatggattggaggttgggcatgcacgatttgcggaaggataaataatgtggcaaccgcaaaagcaatgaaaataaccaagcctccagctgaaggcatcggttttttattgacgcggcgctcattgggtttatccacagcgccaattaccttagacacaaaagtcataattggggttaaaatcactgaaataccaaaagtgataattataaccattaaaaacttgagtgcaaaagggatttcttttaatgtatcaaccatatttagatttttctaagaacgtctaaagcacgcgttgtgattaggcattcaccatactcctgcaaaaattctcgactcatttttgtcgcttcaccatattccatcatccgtgaacgtgtgctttcaacatgcattttaccttttgctttttgattatctaaaacaacaagataaaaattaccatcataacgataaaattctgactcttcatctgcgaatttcacattttttattccagtcaagacagacatcatgtcatcataacgaatagagtagtatataaagtctggctcatgttcggcttcttcttttttagcccctggtaaaccaagtccaggtttaaaatcagtaattcctcgctcgcgcgccatatctgcccctatttcatttaatttattataaaaaccagtcattaattcttcaaattcttcaggatcatctggaatctctccgccttcacccaacattgcttcttcatgaacaatcatatggacgccttgtgggaagggttgaatttggaaagttaacatccctacatttccaaaacgattttctaagccaagttcatcaactaattcatagaaaaattgttcaatgacttcttgatttccaaaaaagtcagataacttgatatcataatctgtcaaatcatcaaaagacaaggtgatttttatagtgttttcatttatatcctcatacttcattttgtttctcttttctataatttatcttctatcactttaccagtcttaatagtattataccacagaccagaaaaaaaacagcactcatgccgttttttgatattccatataactatatgaaacctttattataagactttagctagaaagtcttgggtccgtttttctttaggcttttcaaagatttgagctggtttgccttgctcaacaattgttccatcagccataaataatactctgtcagcaactgttttagcaaagcccatttcatgagtgacaacgaccatcgtcatcccttctttggcgagttcttgcattactgacagaacctccccaaccatttccgggtcaagtgccgacgttggttcatcaaaaagcattacatccggattcatagccaaagcccgagcaatagctaccctttgttgctgtccacctgatagagactgtggataggcttctgctttatctgataatccaactctttgaagtaaatcttctgcagtctttagagcttcatctttcgtcattttccctgtttttattggggtcaagcaaagattttcaaggactgtcatatttggaaaaagattaaattgctgaaaaaccattcccattttttcgcgatgtttaaagacgtctacagatttatcagcaatattaattccttcaaaatagacttctccatcagttggtttttctaataaattcattgttcttaaaaaagttgatttcccagaacctgatggtccaatcatcacaacaacttcacctttttttatttgaatatcaagtccttttaatacttcattcttcccaaaatatttatgcaaattttttatttcaattaaatattcattcattatttcgcatatcctttcccaagtctcttttcaaacagaacaagtaagcgactaacaacaaaagtgaccacaaagtagtaaagtgcgacaaatatcattggactaattgtttggtaagtcaaattcgccacggtttgcgcgccattgaaaacttccataaccccaatcgtataaaggagcgagctgtccttaattatcgttacaaattcatttcctacggctggtaaaatatttcgcaatgcttgaggtaggataacggttgtcatcgcttgtcttggtcgaatccccaaagaataagccgcttctttttgcccaagaggtactgcttcaatccccgcccgaacaatttccgccatataagcaccagagttcaacgaaatcacgataatcccgggaatcaaacgtcccaaatcttgttgcaaaattcctacttgaaaagtaggtaaagaaatacttcccattaggccaaaaccaagcatgatttgaaccagcataggtgtcccacgaaaaatttcaatatagatattggctagccagcgtaatggagcaatcttagaaatttttgccaatgctgtgacaatccctaaaagcgttccaattaagaccacaaaagctgaaataaatatcgttacaatcattccatcattaaagtagggtaaatatttcggtaaaaaatcaaaattcatattttctctcttctattttctctaatcatcgaaacttttttcccttgacttgctccatggatatacaagctaagagcttcgtcgttccatgaataaccaaaatttactggtaacaacataaggatatttttcgccatttatagctatccgaacaacttctacttcatcaacaaattttttgattaaatcaatatccgtcacttgtcttttagctcttctcatttgtttattttcctctattttcattagtaaaatcttaaaaatcatctctataggctgatttattaggataaaattgcacttaaagtatatcaaaaaaataagaaatatagaatttataacctattttattcagtatctatactttattttatccaaaataacctcctaaatttaattatttacaaaataaaaatcacagaaatttaccgtgatatcattataattaaaaatccttcttaaccaaatatctaaaaaaaacttcatcagttttatatcgaaatctataagttccacttactacttttttatgaaaaaggtatcttcttacgctattgcggtctattgaaagtctgtgctataatattgatatgaatatagaaaagcttcagtttttagctaaatatcgttggattatcgtcctaattttagccttaattttttcaggtctatctgtcagtatttttcatttaccatttttaatgacagcccttgttttgtcagttattggactcatttttgcctatcacaagtctgtttggctggtcctttttatcctatctaatctcccgatgttagttagcacaatttttgcttctcagcatcatttttcaactttagatacgattatctttttcatcattttcatttttacaataatcagctcttatttgattgctcgcaaagctgagctcattcctaagttaagttggaaatatttcccaccgttaagaattatacttggttttgttttgctattttttgtttctattttgacaggaattttcgcccaaatcttcaatcaaagcccaacaacaactaaccaagaatcactaaatgaattacagaaagtgattccaatagctgtctttgctactcaaacccttgctgccagttttttggaagaacttgtttatcgagtaggaatttttgaacttatctttaaaaatcaaaagtattttgcttttttaactaccatgctcctgtttgcattcatgcatggaccaacggacgtttacagctggttaacttatggactgatgagtcttgtccttactgggctctatgctaagtatcgtaatttttatctcaatatgagtgtccattttctttggaatctttttggactagtcattgcacttatggtcaaataaaaaaattactgacaactctgtcagtaatttttttattaaagataaatcattttaaataatgcaacggctgcaagtgatgcaagaattggtgccaaaactggaacccatgcataccaccatttagatgaacctttagcttcacccaaaactgattttggtaagagactgtgaaccaaacgtggaccaaagtcacgcgccggattcaaaccaggacctgtaggtccaccaagtgcaactacgagtcccataacaaggaatcctaggaacaagtgagcaatcattttagaagctgaagctcctgatgcttgaacccaaatttgattcataacgtctgatgaagaaacatctgctccttgacctttcaagtagtttgtcatccaagtaattgattgactaccaaagaagatatttgtcgcagcaaccgcaccgaagaacaatacaaatgaacctaagaactcattcaagaaaccattaatggttgctcccaaacgagttttttcactgttatcatcaacgttgtcgatagttgagaaagttccaagaatagcatttggattttgtgttttaagatagtatggacgataaaccataacgattaataattgtccaaacatcgcacctaatacttgcgcaataatgtattgagcaacgtgtgcccaaggaaaaagtcctgaggctgcaagtccaagtgtgaaagctgggttgatttgtgaagtaatattaccaaaagcaactgctggcaacattacgccaagtccgtaaccccaaccaataatcatccaagattgtgcgtgagcttttgtacctttaagttcaacgttagcaaccgcaccattacccataataatgagtagggcagttccaacaaattcagtgatatatttcactgtccatgtaacatccattttttatggaaccctccaaaatttgattttaatataataacctcagctattataccagaaaagcacgtttgcttcaaatattcattgaaaatagcgcgtctttagtctgattaatcactgaaaatatgctataattaaaagaattatcatgtttattacggaggatttaaaatgcgctttaaccatttttcaattgttgacaaaaattttgatgaacaattagcagaacttgatcagcttggttttcgttggtctgttttttgggatgaaaagaaaatcttaaaagattttctcattcaaagtcctagtgatatgacggatctacaagcaactgctgaattagatgtcattgaatttttaaaatcctctatagaattagattgggaaattttctggaatattgctttgcaacttcttgattttgtaccaaactttgattttgagattggcaaagcttttgagtatgcaaaaaatagcaacctccctcaaatcgaagcagaaatgaccacagaaaatatcatttctgctttctactacctcctttgtacgcgtcgaaaaaatggaatgattttagttgaacattgggtatcagagggacttcttcctttagataatcattatcattttttcaatgacaaatcgttggcaacctttgattcttcacttcttgaacgtgaagtcctttgggttgaaagtccagtcgatagtgaacaacggggtgaaaatgatttgataaaaattcaaatcattcgtccaaaaagtaccgaaaaacttccagtggtaatgacggcgagtccttatcatttagggattaatgataaagcaaatgatttagccttacacgatatgaatgtagaacttgaagaaaaaaccagtcacgaaattcatgttgaacaaaagctcccgcaaaaattatcagcgaaagcaaaggaacttccgattgttgacaaagctccttatcgttttactcatggttggacttattctttaaatgactatttcttaactcgaggatttgcctctatctatgtggccggtgttgggacgcgttcttctgacggctttcaaacctcaggtgattaccaacaaatttatagtatgacagctgtcattgactggttgaatggtcgagctcgtgcttacacttctcgtaaaaagacacatgaaattaaagcctcttgggcaaatggtaaagtggctatgactggaaaatcttatctgggaaccatggcttatggagccgctactactggagttgaaggtctagaggttatcttagcagaagctggaatttcttcttggtataattattaccgtgaaaatggccttgtccgctctcctggcggttttcctggtgaagatttagatgttcttgctgcgctcacttattcacgtaatcttgatggtgctgatttcttaaaaggtaatgctgaatacgaaaaacgattggcagaaatgactgctgctttagaccgcaaatctggtgattacaatcaattttggcatgaccgaaattatctgataaatactgacaaagttaaggctgatgtcttaattgttcatggactacaagattggaatgttacaccagagcaagcctataatttctggaaagctctgccagaaggtcatgctaaacatgcctttttacaccgtggggctcatatttatatgaattcttggcagtccattgatttttctgaaacgattaatgcttactttgtcgcaaaattactggatagagatttaaatttaaatctcccacctgttattttacaggaaaattctaaagaccaagtatggacgatgatgaatgattttggtgccaatacccaaatcaaactccctcttggtaaaacggccgtttcttttgctcaattcgacaatcattatgacgatgagactttcaaaaagtattctaaagatttcaatgtctttaaaaaagacttatttgaaaacaaagccaatgaagctgtcattgatttagaacttccgtcaatgctgacaattaatggcccagttgagcttgaactcagactaaaattaaatgacacgaaaggcttcttgtctgctcaaattcttgattttggtcagaaaaaacgtttggaagataaagccagagtgaaagattttaaagtgcttgaccgtgggcgaaatttcatgttagacgacttagttgaactcccacttgttgagagcccttatcagttaatcactaaaggctttactaatctccaaaatcaaaatttactgacagtcagtgatttaaaggctgacgaatggtttacaataaaatttgaactacagccaaccatttatcatttagaaaaagctgacaagcttcgggtcattctctatagtactgactttgaacatacggttcgtgataatcgtaaagtaacttacgagattgatttatctcaatctaaactcattattcctattgaaagtgtgaaaaattaatatggcaattattggaattcttggaactccttacaacacagttgaacgttctcctttttggtggaacaaagtaagctatacacgtcaatcttttattgatgttttccaggaattaggtcacactgtgattgttcctcctgttgacaaaaccgaaaatataaaaaattatctgccattggtcgataaaattgtactgactggtggtgctgatgtcagtccttatctctatggtgaggaacctcatgctcaattaggaacgactgacccaattcgtgaccggtttttgagcttgccgcaattaaagctgctctagaagcgaataaacctattcttggtgtatgtcgtggcctacaattgctcaatgtttattttggaggaactctttatcaagacttgagactaacttcaagtcagataaagcatctccaaagtccaactccccaagaagttccaacacatcacattagcgtcgaaaaagaaagttctttaggttttttacctgaaaattacatggtcaattctttccatcatcaagtcattaaggatttgggtcagggcttgcaggccattgctcatggaaacgatggcttagttgaagcgattgaaaataaagaaaaacatgtgctggctgttcaatggcatccagaatgtacttggtaaactgagaattttgataagaaaatctttgaaatcttcgctaacggagacatctaaaagatataaaaccatcataaatcttttttatggtggtttttttaagtttatgttaatattatctctatattaaaagtctgctgaccaacaaccaaatttctaatttaataataaaggtcagctgacaaaatttctgaggagaaattgatatgaaaaaaataaaattattgactcttgcaacacttggaattgcctcaattggcttacttgctgcttgctcgtcaaaagataattcatcttctaaatcaacagataaagtgacaacagtaaccgttgcaacttctgccgcttctgtgccttatgaatacagcgaaaatggtaaaatgactggttttgaatatgatattttaaaagcagctgacaaggacatgaaagattataaattcgagttcaaagtctacgaagatagtgcgattttggctgctttagatggtggtcgcgcacaaattgcggcaaataattttggtaaaactaaagctcgttctgaaaaatatctctttagttatcctgttcgtcaaggaattgatgctattttctcaacttctaaagaaaacatcactaaaatttcccaacttgctggcaaaacaacagaaattcctgctggaacaaactatggtgatatgtttgaaagttggaataaaaaccatcccgacaaaaaaattgatgttaaatatagccaacgtcctttagctgaccgtctatctgcgattgctagtggacaaattgatttcttatttgcctctaaagcaccagcagaaaatttaatcagacaacatgcaattacaggtttggttgatactgttcccacagacttgaacaaacaatctgagtttaaaacttatgattactttatccttgataacagtcaaaccaaattacaaaaagatttgaatgcagagctcaaaaaactctatgaaaacggaacgctaaaagaactctcagaaaaatatttccatgacagccatattccagctgctgaccaattcaaataaaaaaaactcgtcattgacgagttttttattttactgacagatatttcttgtgtgacattcactcataaaacaaaactgtcagtaacttttatttcacttcattttgaaataaatcattcaaaccttcgcccatagtagggtgagtaaaaatttggtcacgtaaaacttgataaggagtatgcattttcatcgccaaacttacaagattgatgacttcatgagaatcttcatgatataaagttgcgccaagaatttcatccgtgttagggtcaactaatgctttaagtaatcctcgagtatcttgaacaactttggctttaacaattggtaccgcagccatcttaaataaacgataattaactccagcttcttttgcttgtttttcatctaagccaatccgagataaggttgggctgataaaaactgaataaggcacaagtttcctgtcacttaacttacgtgaatggtcgccaaataattgattattgacaatccgaaaatcatctgtcgaaagatagtagaattgtcctccaccccgaacatcacccagtgcccagatattttgagcagtcgtttttaaatcatcatcgactttaatataaccattttctgaaagttcaacatcggctttctccaaatcaaggtctttaatattcggccgacgtccagtagctattaatattttatcagctggataaaccttccctcctgcgaaaacctcactgtcagtaattctttcaatttctactccaagttgaatttcaactccagcagcaactaaatctttgtaaatctcatttgagatatcttcatcttctttaggtaaaaaagtagcatgtggctctaaaatagtcacttcagatccaaatttgttaaacattccagcaaattctaatccgatataaccggctccgatgatgactaatttcttaggaagttcagaaagttccatcgctccctcagaagtgacaacatttttagcttcatgaattccttcaatttctgggataatcggtgtcgctccagtatttatgaagattctctctccaatgacctgagtgacattctcaccattgaccacctcaacagttttagaattaataaaacgagctaggccatccataacataaacaagggcttcatctgctgctccatgataagcagcattatgtagaatctcacgaaccttatattttgttgtcattgcttctgaaaaattcatgtttttttgaccagcaacaatcaaagttttagacggagcacaaccaacattcggacaagtcccaccatacattgcttggtcacgctcaataattaaagcttcttctccatttttcgataatgatttcgccaaagcacgtccggctttcccaaatccaatgattatatttttaaaatgtcttgtttccatcttcttctctctgcctcccttttctttatgcttctattctataacttttgaaggtctgtgtggttcatcatgacttaataaaaaaacgccacaaggcgtctttttattattttatttatttaaagcggcatccaagtgagccaataccttttcttttccaagaagagcaatcgtttctggtaattctggaccgtgcattgagcctgaagctgcaatacggattggcatccagagcattttacctttcacgcctgtttctttttgagtggctttaaagagtgggaaaatattctcaaccgtaaagtcactttcaggaagttcagccaattttgcacggaaagtgctcaatgcaagtggtgttgtttcagcagctaacatttcgcgtgcttcatcagtcaattctgggaaatctccgtagaaaaggtctgttaattcaacaatctcatctgctgatttcatttgtggttgataaagtttaaccaattcttgcgcacgttcatcaaagcgattagcggcaagaaggaatggttttgtcaattcaaaaactttcgcaaaatcggcatttttgatgtattcattgtccatccagtccaatttcttttggtcaaaggctgctggtgatttagacaaacgattttcgtcaaaaagttcaatcaattcttcacgagagaaaatttctttttctccaccaggattccaacccaaaagtgcaataaagttgaaaatggcatcagacatgtagccttttttacggtagtcttcgataaattggagtgtgtttgtgtcacgttttgacaattttttccctgtttcagaattaataatcaaagtcatgtgaccaaattgtggcgcttcccaacctaaagcatcataaacaaccaattgttttggcgtattggcaatatggtcgtctccgcgaatgacatgtgaaatttgcatatcgtggtcatcaacaacaacagcaaagttgtaagttgggtaaccatcacgtttttggataacccaatcgccaccgatattgccaccttcaaattcaatttcacctttaacgatgtcattccatttataaatggctttttcgtcaacagagatacgaacgacaggttcaatattttgtgctttacgttcagcaatataagctgctttttcgtcatcgctcatgccagcatattcattgatataatgtgggggaattcctgctgcttcttgtttagcatggtcagcttctagttcttcaggagttttgtaagaataataagctttaccctcagctaacaattggtcaatatatttttgatacaaaggcaagcgttctgattgacgataattttcgtgtgtttcagggctttcatcccaatccattcccaaccaacgaaggttttcaagttgtgaacgttcaccatcttcaacatggcgttcacggtctgtatcttcaatacggatgatgaaatctcccccgtgatgacgggcaaaaagatagttaaaaagggctgtacgggcgttcccgatatgcaaaagtcctgttggtgatggtgcgtaacggacgcggatttttttgttcattttaatccaattctcctcattgatttcttcacttcttttttatcagaaatgaatctttattggttttaaatagtaattactactctaacaatcacatctattttaccacaaattaaagaagcttgcgtcagtgaaatttatctaatctttaatttgaagaaaacgtccctgccaaagatgattttcgtaataatcaatcatttctcttgctgtcagccaatgattatcaaaagttgaacttgcccttttttgcataaaatttcgatagcccaaaccatgggcaaaaacgaccgttgtattcacgcaaaattcagtttgtgccccgcaaaattcaatcgcttttactgacagcttttccaaaagcatttgcagtttagtttgatagaatccattagcatgtgttttttccacatagctgtcagtagattccgtcagtaattctggaagaagttgccaaccctcgctttcttttatcagttcatcatcatgatgttggataaagataattggctttttctcctttcgataaataagaatgcgttgattaatttgctcaatgaattcatttcgccgataaatgccgtcacataccccattttgcgtatcaatcacaattaagacatcacttgttttcattgtttatcctttcaagaattggtcagctgtcagtacttgcgcaaaattttgtaaggctgaaagaaaactaatctgaacattttctgccaaaacttttttattttcaaaaatcaaatcttttgttgctgttgcatccgaaatcaatactggctgaaaaccgagttcttttgccgctcgagttgttgaatcaacacacatttgtgtcatcattccgcagatgaccagctgctcaatctctattttttttagtgtttcaagtaactctgtctctaaaaagctattaggaaaatgtttttcaatgataattgactgctcctgcagcttgagatttgggtgtaattcacagccaattgtccctgcttcaaaaaaatctgcattcagctgatgcttgatgtgttgaatataaatgattggcttttgttcagacaaaaagctgttttccagttgattgacctttagcaaagccttgtcagcttcatgcaactcatttttgccttctggaaaataatcattttgaatatcgattataagtaatgcttgtttcattttcgtcctcttttttaagttactgaacagtttgttaataattatttctctgacagagtcgctcactctatgttaaaattagtataactcaaatttaagaaaaaggaaatggctgtttttgcaagatggccttgtgatttttacatgacctttcaacatctttcaatcgaaaatatgcagctttttgtgactgttgcagacaatagctctatttcacgtgcggccgaacaactttttattgacgcgtcttctgttagtcgcaagatatctctcattgaagaagaactttccaatcaattatttattcgctcaaatcaaggggttgccctaacagatactggaattctcttctacaatttttgccaggaaacactgaaaaatctgtcagaactttttgaacatctgtcagtaaaccctagtctctctcaactaaaaataggaacttatgattccgtcagtgtaggtctttataaagatttttttagtgaaaatttttcaaaactcggagcagttaaaatttctaaccagattgataatttaatccaatcattcaataataatcaattaaatactttgataattgacgacgaattttcaaaatttctgacaggaaatttctacgaaaaatccttagccaaagaagcattttatctcgtcagtcatcaaaagtttgctaatagttttgacagtaaaaattggaaacagcttgaattatttttaaatcccaaaagctgtcccattcaccaaaaattattagccttatgccctaaagagaacttgcccaaaattcatgaaatagaatatactgcttctgctctttcatttttggtttcttcaaaccaagcgaccatcttacaaagcagtctaaaaaaatattcatcagaaaatttttattttcaaaaacttccagaaaatttcaatcgtaaccttgttatattatcaagaaccttgtctgaccaagaattatttttaagaaaaaataacactcaatagaatgttatccttgtagtaatctttttatttctctagttgagagaatcctcttcaataaatgagtaaccaatggcttttgtcgccacaaaggtaactaaagcagcaattattaaggacatcgttgtatctgacaagaaatgtgccccaattcggacacgagcagccatcattaaaagagtgaaaatcaagccactgtaagccaaaatcttttggcctttaagattttttctgtcagcaaaaaatggtaaaaagagtgctgctgccgctgcaatcgtatgtcctgacgggaatgactgatgtcctgttgcaccatttaaatgccagaaattagtgaatgttcctttagtagaagacacaatttctttgatctcataaggacgaaaacgcccccagttaactttcatggtattgacaatcgagttactgacataaacgaccgcaattccagcaatagccacaataatcaattgactcaactcctcataagtttttttgcttagccatttataaattaaaaatgtcccaatgaccaagataataaatgtaaaaagtgcttcaagaccgaaagaataagtcgctgtggcgccgatactattatttgccgcaccgagcgcttgatgagttttgatattattgagtgtcgtcacaccataaaacatccagccatcaacccaaccccaagctgaccaataggaaaaacccagagccgataatgacaaaatctatttgctaatttgatttttttgacgcaaaccgtaaataaagataatttccgctgaaataaaagggataagtgatgacggaaacattccaaaaatctgaaaaatattaccaaaaattgaattttgattcaggaccgcttttgaaatttgcaaatccccaaaagatgcaataattaataaaagagctgaaattccaattaaaatgcttaggaattttttcccgcttgtgttcataaaacctccaataagttgattactacccttttattttatcccattctcaaacccccaatgtaaatctttggtaaattttccgtaaaccctttgttaatcacttctttttatttataaggccaaactatataatcttttaatgacaaatggtagttttggattttccttctggatagtctatgttagaattaaatatatgaatgaaattacttataatcaaattatgccaaatgatatagatgatgtcatccgtattgaaagactcactttctcagaaaatgaagctctgtcagttgagtcaatgcttgaaagaattaacttaattcctgacacctttatcgctgcaagaaatagtgaaggaactatcgtcggttacgtttctggcccagttacagaaggccgctatttagacgatgaatcttttgaacggactgacgccaaccctgaacaaggtggttttcaaaaaatcatcagtttgaccgtcgaccccgattatcaaggcttaggaattgcaacaaatttacttcttttacttgaaaaagaagcgagagctaaaaaacgtttaggaattagcttaacttgtcatgattacttagttccctactatgaaaaacatggttttactgatgaagggctttcagagtcaacattcggtggcgaaacctggtacaacatggtcatggaattttaaaataaaaaagttactgataggattttgtcagtaactttttttataagcacctttcaaacttactgacagttttgttagtaagtttttttaatttttatagtaatttaatgcatcagttatcgattaaaaaattatcaaactttttaatcaataattgataataaaaatattatagcaccaccttatctttatttcaattattttagcatatatttataaatagactcaaaatatataaaaaaagccccaaaaatgagcttccttttttgaaataaaaaaaatctgtccaaagacagattttaaaattcttatttagccactactggataaactgatacgtgttttttaccacgtttcatttcgaatttaacagttccttcgattttagcgaagagagtatcgtcgccaccacggccaacgttagtacctggatggatatgtgtaccacgttgacggaaaaggattgaaccgccgcttacaagttcaccgtcagatgctttagcaccgagacgtttagcttgtgagtcacgtccattggaagtagaacccccaccttttttgtgggcgaagagttgcagattaagttcaagcatgttattgccctccattttcaaatttaagtgtaatgtactgaccatagcttttctcaactgctttcatcgaatttgcaaaagcttcgagcaaagtttgagccaatacgccttgtttttcaggtatgctcaaaggaatttcaacatacaagtaaccatcttccgtttgagtcacaggtttaatgtgagccatttcgtagatattatttgcagtcgtaattgatagaacgctgaccgccgcacagactacatcgtgtccgtactcgccagattcagcatgtcctgagatttcataagaaacaatcttgtctctttttgtcctgatacaagcttcaatcataattaagcgttaactgatttgataacaactttagtgtatggttgacggtgaccttgtttacggtgtgagtgttttttaggtttgtattggaaagtaacaactttcttttgcttgccatgtttttcgacttcaccaacaacagttgcgccttcaacgagcggtgcaccaactttagttgtttcgcctccgacaaagataacttcgtcgaaagtaacggtttgaccagcttcaacattgagtttttcaacgtagattactgaaccttcttcaactttaacttgtttaccaccagttttgatgattgcatagtttgacattgtgattcctccttgttagatttcatcgcttttaagtcaagcgactgttagactcgcctttgttcgtgggcttacgccacttattacgaaacttcgtgcggttgcactttatgagatttcacaaagacaactatattattatactacttctttttctacttttcaagtcttatttttcacttttttctttgataccattaagtgagacctgatatattttttttgtattccaaagcatattaataagtgtattaaccaataagagtaaccaagcaaaagaaaggctaaacgataatatttcaaatgcagtcaatgtcaaataatgtattggatgccataatacataagaaattaaaataagagcaacaataaaataggacattcgatataaattagggtcggcatttggtaaaaaccaacgaattcctagtattgaaatagccataaataagacaattaattgagcaacaatatcatgagcaatatgcatccaacctgggtcattgggaatcaatcccactaaagcaatagaaattgcgcagagtgttagtaagacttgtaaaatattttgacgataatgacttcctgctttttgacgaagagcaacaaaaatataatcaattaatgccgcaaagagagccgcagaaacaatcaaagtcagattaaattgccaactcgaacgagaggcctgagttccaagtaaactaaagtttctttgccaccaatattgattcccattagtagccatacttgaaacaaatccgccgactgatacaactaaaagcatcgtcaccatcatattaatcgaaaaagtatccacaacaaaaatcatgacataattaatgattccagaaaaaattgtaaaaagtaaggttgatgtaaataatccaaaacttacaccataaaaaatttgtcctaaaaaccaaaacagccccattgtcgctaagattacaatcaataaaactgatagggtaactgtggcaaaagtacgccaataacttcttttggtcatttgtttataaaactctttacgtcttgaaaaatatgccgaaataaaggtcagcattcctaccgcattcgcaacggtaattactgcggttgccagtgattcattacctgagagtgcaataacgtgtggatgttttaaaacaaaggcaaagataataaatattagagccgaagtaatggtagggataataaaccattttgcggccttatctgattttcgagcattgactttacgaatcgtgaagctgtctgctgctaaatcaacgatttcaatttcttcattttcctgaaggtctaatcgctcatatatttctttggggagatgtatcttatccattttttcttcctttcgcttcttctgtccaatcaattctaaggtgataatctgcaattttttgggcaccttgcgaaagctgataattaattttgataatttttctttcttgatcaatactcaaagtatttgtaaaaagagaaagctcacccaacccctcgtattcggttaatgtcgtacctttcggttgaaaatgcattttgattggtcgcttggcaaaacgagtcataataacttcatcttcttcaattttgagaagcaccttctcatttgccgcgttctcgtatttaagcagagtttgtaaattaacttttttaaactctccttgatatatttccttgaccaattcttcttgctggtcaattttaattctattcctaattataatttccataataacattttactatatttcgatgaataataaaaacatagtagtaagggaaaaaatcccgatgataagggtctgcattttaatataaaatagggtataattaagataaaataaggaaaaatttatttattttaatttaaaattgaccttaaaatttagagggggttttgttttggaaaaagtctttcgcgacccagttcatgattatattacagtgacacatccagtaatttctgaactgattgatactgctgaatttcagcgtttaagacgaattaaacagcttggaacgtcaagtttcacttttcacggagctgaacacacgcgcttctcccactgtctgggtgtttatcatatcgccaaacgtatcacagattatttcagcttaaattttcctttggaatggaatcctgacgaaaatcttttaacacaatgtgccgctcttttacacgatgtcggacatggagcttattcacatacttttgaaggtttatttaatacagaccatgaagcggtcactcgtgaaatcattacttcaccagatacagaaattaatgccattttacgcaaggtatctgctgatttccctgaaaaggtagcatctgtcatttcacatgaatatcctaatcctcaagttgttcaattgatttccagtcaaattgatgctgacagaatggattatctcctgcgagatgcttattttactggtgcagtttatggacaatttgatttgacctggattttaagggtcatcgttccaaccgaaaatggaattgcttttaaatattcgggaatgcatgcggtcgaagattatattgtcagccgttatcaaatgtatatgcaggtttattttcatgctgcctcacgttcaatggaagttttactgcaaaaattactagcccgtgctaaatttttatacaatcttcatcctgattatttcgcaatgagcagtccttgcctcgtcccattttttgaaaaaaaccataatttaaagtattatttacgacttgatgacggggtgatgaatacctattttcaagtttggatgagccacgaggatgaaattcttgctgatttagcttctgcttatgtcaatcgtcatttgctgaaatcaattacttttgaccctaaagccgtggagcttaaagatttagattttttatcttctttagtagaagaggctggatttaatcctgactattacactgggattcatagtaattatgatttaccttatgacttttatcgaccaagttctgaaaaaccacgtactgaaataaaaattctaaaaaaaaacggttcgctgacagagctgtcagtactctctccacttattaaaagtttgacaggaacaattcacggaaacagtcgtttttattttccaaaagtaatgcttgaaaatcctgaatttacaaaatacatcgtcaatgacagcttaattactgacagcattcagcctaccgaaattgctgacaaggctgtcagtcaacaattatcacttgatgataatctttaagtactgacccaaaatttattatattatatagaaatagaaagagatactcttatgattaaactcgttgctattgaccttgacggaactttacttgacccaaatcgccaaattactgccgaagtaaaatctgctgtaaaaaaagccaaagcggctggtgttaaaattgttatcacaaccggtcgtcctttaccaggtgtagttgatatccttaaagcactcgaattaactgaccaaagtgattatgtcattacttacaatggtggattggtccaacgtgcaacaggtgaagaatttatcaaagaaacattaagttccgaagattggttagaccttgatgcggccgcccgcaagattggtctccctatccatgcgataacccgcgaaggaatctatactccgaatcatgatgttggaagatataccgttcaagaagctcaaatggtaaaaatgccactttatattcgtcagccagaagatatcgctgctttagaaattgctaaggtaatgatggttgatgaacaagaggcacttgatgatggaattgcttatctcccctttgaatttttcgagcgttataatgtggtcaaatcaacaccctactatttagaatttatgaataaaaaagctagtaaagggtctgcggttaaacacttagctgaaaaactttctttttatttagatgaagtcatggccatcggtgatgaagaaaatgaccgttcaatgcttgaagttgctggttgtcccgttgtaatggagaacggaaaaaccgaactgaaaaaaatcgctaagcacatcacaaaatcaaatgccaaatctggtgttgctcatgccataaatgaatgggttttaaaagattaccaagcttaattagcaaatttataagcattattgttttctcatcaaccttgaaaggttataataagattatagaaagatatcacaagatatcagatagataagtttatcttctatcctattcttttcattatctagggaggtaataaaatgaaaattacatttgatgaaaaaacagctgctaaaattaaagcacttggcgatgttgatttagtttttgattttgaccatactttgagtgaagtgaatactgaggtagatgcttgtgctggtggaatttctcgttatcgtattgtagcggtagaaaaagggaatgttccagaagaatttgatgcaagtattgattctgaatttggcccaatttattataaaggttatggttcttatttcttccaagatgaaatgtcaaccaaaatcaacacttcttataatttgattgagttacgcagtactgctgaattactcagtcccaacttgttaattgttgacttccgtggaaaacaaaaagcgagttgataattaaaaaaaagaccctccaagagggtcttttttatatatcataaaatggatttgtcttttctttactttcataaatcttgacatctgtaccaaaagaccgaagtttatcagcgactaaaccgataaatttctgctcaatatagtgtccagggtctattccaatcagaccggctgacagcatatcatgaccgatatgataataaatatctcctgtcagatatacatcagctcctttagctaaagctttcggccataatttcccaccagagccgccacaaattgccactcgttcaattttttgagtcaaatcatgattataagtgacaagtcgtagtctatctaattcaaaaacttctttcactttttctgtcagcactgacaaatctgtaccttcaatatttccgacacggcccaatccttcatcatcatccagcacctcaacatcagtaagtccaagtaattgagcaaaataatcgttcaatccccccttgacaacatcaatattggtatgactagtataaacggcaataccagcttgagccaaatctaatactaatttttcttggttatccattgaagttagagcagtcaatggccgaaaaatcaaaggatgtttagcaataatcaaatctacacccagtgattttgcttctgccactgtttgctcgcgaatatccaaggtcaccaaaacttttgtcagttcttgttcgggattaccaacttgtaatccaactgggtctccttcaactgccagctcttttggacaaaagctttcatatttagacataaattcagaaatcttcattgaagaacctcctttattttggcaatttctgtcaaaacttcttcgcgtttttcagtttgttcatcaggtagacggtcaatgattttattcaaagtattcaattctttttgccatttttgttggaaaataaccgatttttctttggataaaaatggaccaaacagtaaatcatttgctgataagaccggattttcatttgtagtaggttctgcaacaataatttcgtagaacttgcctgcctctaataaaatttgttccgcctttatgacaaattgatgctctgtcagccactgacgcaaggtatcctcatgattatttgcttgtaatatcaaacgcttaacagaacttaacttacctttacccgcttccaagatttcagaaattaaaataccgcccataccagcaattacaatcgtatcaatcttatcaacattctcgatggccgctaaaccattagccaacctcacttgaatattctcttttaaatttgcttgtgcaacatggtttttagcaatttcaaaaggacccttgactacttcaccagccactgcaaattcaacttcatttttttgtacaagatatgtcggtaaataggcatggtctgaaccgatatcagccaatttcgcccctttatcgacatagtcagcaactgctttcaaacgttttgaaagtttaatttcattcattttctaaatatttctttccaaatttacaataatctaatacggggcaacctgcacacttaggctttttcgctgtacaatgatagcgaccaaagaaaatcaagtgatgatgagattgaacccatttatcttcaggaatcaacttcatcagtttttcttcaacttctaaaacagtcgctttttgcgcaacaatatccaatcgcttagaaactcgctcaacatgtgtatcaaccgcaatccctgggattccataagcttccgctagaacaacattagccgtttttcgcccgactccaggtagagtctgtaaaagctttttatctttcggcaagtccggtaaaatccctccgaagtccgccactaacatttgtgaagttcgcagaatatttttagctttagttttataaagaccgattgttcgaatcaacgcttcaatctcttctactttagcttgtgacatggtttgagcatccggaaaagcagcaaaaagtgccggcgtcgccttattgactcctttgtcagttgcttgagcagataaaattgtcgcaatcaatagttgaaaaggcgtctcccaaaccagttctccatgtgcttggggaaacatttcttcaatgattgctaaagcttcaagatatctttttttacttaacataatgtttgtccattatctattttatccattccaaggtccgtctaaaggaatgtaaaaatcttcttgcggtttctttcttttagcttcttcacgttccatttgacgactttcaatcgcttgaactgaattaaccccatcgtttttccaattgcgcaaaatagcttttatgtagtttaatgatactttgcgatttaaaaccgcttctcgtaaggcttgttttatcaaagacaagtcataaccatcctcaaaaagccaagcacgcaattcttccatttgaacaggagaaatcatccccatttccgcctcaaacatgctaatcaactctttaagttgaccttcatcttgaacttttttatcctctgctttaagatttatcgctggagaacccactagttcatctaaatgcttgaaggctggactaatatcaaagaaagtttccatttctccatcaatctcaatcaatgtaactttcattgccccaaatttggacaaactatcaatcgcctgattaacctcagacatttttttcccagtcttatccgcaatctcgctgggcgcaatttctcgattttcaaaaaagtataaccatactaaaaaatcaaaagccgaagggaaaagttcactaaaatgtgacaaaatcaccgttggtaaaactaaatgccctttgctatattcatcgtaataattcatagaactattatagcataccgtatcattatggttcaaatggagtcattaatcaataaaattgaatcttattattatcctttattaaagaaaaaacggcatcattatcaggtaaattattaaccaatacaaatgcactcattgatattccgactaactaaaagtctcgttcatcaaaaaacaagaaaagagttaagaaactcttttcttattttttatgtctaatttattaaatcatagtagatagattgagtaattacttataaatcaatgttgaggatttgaaaaattttggtttttcaaaatcaaatgaatagtatcaatgctttcttgagtaatcgttttttgagaccatgaatatccactatctttatcatatactaatatagcgttcatgacatcttcatccgtattcattcgataaccatctggcattccactatattgtgcattggaggtatgattcaaccctaaagaatgtcccaactcatgtcgaataactagaaaaagtggattcaagtcataattaggatttgtagtatcaagtgccaatttgatgtcttttatttcaattcccgtttttccaattgatgtcgcactaccagtaccttttgggttaggtgcaatcaataaagttgttggttcagttgtttctcccgacttaataatagttggttcattgggattgatagcagcattccaactttccgcagcccggtcaatttctttattaaatgctgcaagtgcagcttccggatctgcttctgctgcaaaatcttctattttcgctcttgactcatagatgatttttccttgtgaattatacgcattggaaatcatttgagaatttgaaaccgcagggttatttccataagttaacgttgaacctaaaaacatcccatcaaccaatttctgtcccaaaccatttacacttggataagtcgcagccaagtccaaattcaaagcatgttcatctacccaataccaattatcaccttctaggctaacattcacaaagtttgtagtttgaccttttttgtcccctgaggtataagtaacaggcatggtttctttattataaagtgtctttccttttaagtcgcccagcgaagtgatattctccgtatccagttgtccattttctaatttcgagtagaattgatagttattgtttagaacaacattataacgataaggattcagaggtattgaagctgctgggaaaatgctagaaagtagtgtatcattactgtaatcagtcgattctcctaattccatttcactaccagataatttttgccatacataagtatctgccatcgttggtgcatcaaaattcgccataaactcacttgaagtccaaatatgctctcctgctggattatcaactgtaccagaaccaacatttcgccacttccctgtgtagccatccgtgactggtacatttgctaaattcatatcagtattcaattgactggtcaaacctaattttaaattttttaggttacttgctccctcaaacattccagttgtaatagaaacaccatttgtactaaaattagaaagatttaattgttctagttttgtcatgccagcaaacatacgggccatgtcggtcactttatcagtgttaaagtttgagatatctaagttagttaggttactaactccctcaaacattccaggcatcctaacggtattattggtgttaaagttcgatacatctagttgttctaattttgtcatgccagcaaacataagagccatgtcagtcaccttatcagtattaaaatttgagatatctaagttagttagattactaactccctcaaacatcccagccatactagcggtattattggtgttaaagtttgatacatctagttgttccagatttgtcataccagcaaacataaggaccatgtcggtcactttatcagtattaaagtttgagatatctaagttagttagattactaactccctcaaacatcccagccatactagcgacattatttgtgttgaatttagatacatttagttgttctagctttgtcaaatttgcaaacataagagtcatgtcggtcactttatcagtgctaaattttgaaatatccaagtttgttagattaatggctccatcaaacatcccagccatattcctaacgttccgcgtatcaaattttgatacatctagtatatccgctttaattccagcaaacatattagccatgtttgtaatttcactcgtgtcaaaaccttctaaatcaattatttctaaattactgtcaccactaaacataccataggcacttccagaataagataaattccctaattttaacacttttttaagttgtggtaaatttgcaaatgtgttggcaatttcatttgccgttgttatctctgtaaattcaatgctcttcacatctgctgggtctacatttgcctcacgtaaaacctctgttaaagattggcttggatgtccaatatttcctcccaaaaatattaattctctatcattagctaaaacccaattagcctcaccccatttacctgtactcgctctaacatctgcagaaatactgacagcttgaggattaattattgttggtccatagcttacaataccaatcgaaaggctcgctagcgttgctccaagaagtagcatttgagtttttgacaagtttttttcataaatttctctccttttttcataagataattatatcatttgaattagaaataaattataaacacggtctttcgctaatatatttttaattaaaaacttttgtacacacttctcctaactgggacatactgataaataattcttttttgctctttacagtatttatttgctctcaattacatttttgtaagaatttaactagcaaatccttgatatactatatctataaacaaaaggatatttgaaagggaataaacaatgaaaatacaaacagaaaaaattactcaaaaaggagaaaatgaaaaatcaatcaaggataattgggaaattatccactcactcaatgatttactttatggcaattctttgttttaaaacaaagaaaaggaaaagaccagaggaaaaaaataatttcctttggtcttttctttctaatttttaactattaatagaaatattttattttaaatcacctctatagttgatttatatttgaaataaatgatggaagctatctacaaattcaagtcatttaatactccattttagttgtcattcgctcttctttgttttctctataagttgcggatttatatttgttaatatcagattctttcattatacttcggaaaagccaaaatgttttagtttctcctgcttttaaatctccagctgtccctagagcctgtgtttctatttcatttcctttttcatcatatgctaccacctcaacatctgcaataacgcgataatttgcagtattctttaaggtaataggaactccacctttttcattgtatatttcaccgtcaaaagcttcattatctgctgggtcaaaactgaacttacctatagaaacttttacggcattttgagtatctttaaaatcggatatgatttttttagagccactcaaaactttctcttgttccatggccattccaaattgtggtgctagaaaacaatatccaatataagaacttactagaataataccagacagagcagcgatagttgtaatcaaaaatgacttttttaattttatgctctcttttaagaatacaaaagctgaaaaagaaattaaaagaatacaaaaaattgttagtatcaccgataaaattagcgtagtatgaatcataaatctttccctgtcccttcttcattactttcaaaataactgtaggttccctctctacttacagaaaagcttaaagttgaaagtagtttggctgtttccctatcattaatatcttctagtccatagtaagttttcgtttcaccggtctttaaattaaaatcaatataattacttattccataatcaaattcgtgtcctgatttttcataagagttatcaaattttagcgtaccttcaacggatttttcattcttgttcgttaatgttattggtaatctggaattggaaactgaataatcatcatcattgtcatcgtaggtatagtctccaaattttactttaacattatcaattgaatttatagacttatgataatcttgtgttatttcagatttagcatctctataagttgttaatttcttatcataatcaagccctgttagtacaaagaatactaatgtaataactgatagtacaaatgttgtaagtgcaaaccattttcttcttctatttttaggtaacaaactcaatatacaaaaaactaatgcaattattagcaaagcaattgatatataaatctcattaactagcaattcgggtattggataaataattttatgagtttctttgaactcatcagcgatttcggcaattccatcaaaaatttcttctaaatcattcaaattttctcgacgatgtgccgtgaccaaaatcatctttttatccgcttgccaagtcaaggcttcattttcataattatctttcaaagtctattgaaacatatcaatggcactatttccaacaacaaacacttgttttctgttttttccctcttttaagaggttgtctcttgtcatctcagttggggtaaaatgataatctgccagtaatccaacaatctgccgattcatttcttctggaaatggtgaaaacttattataggttcttaatccagcctcaatatgcgcaagctttatttgattaaaataggcgaccaaagctccagccaatgtagcagctgtatctccatgaacgagaataacatctggtttttcctgtttgacaatcggttcaagaccgctaagtgttccagatacgatttctgataaaccagaataagaatccataatcttcaagtcataatcaacttcaactgaaaattcatcaagaagttcatttaacatctccttgtgttgacccgtattaaccaaaacaattggatttccttgctttttggcctcttgaattaccggataaactttgataaattctggtcttgtcccaaaaataaagagtaattttttcatcttcacctcattcttatattttaaataataattgtgtttgctataaacaactcctttaataaatcaaaaacttatttacacatctgctatagactacatttattatgatttttaaaaataaataccaaatttaggtattataaaagcatggtacaacaggataccacacaattataaaacgtaatcttttacggacatttcttaatttcattctagcataagaccagctacttagtcagagtatttgaatgcaatttttggttaaaaacaacaactttttttatgaatttcccctcaaataaattacctatcttgtccatataaaagctacaaaaaaataagatatttttgactttgaatgcatgcatgcttgattaaacaaatccattctcaactaatcaaaaaaagcgaaccgaagttcactttttggtatctaatttcaactcattttcaggagtgacctttatagagcaaacagatttttttactaaaaccttatctttaataagtttaatccttgattccaagtaacgttttcatttgtgaaaccatgagttttgcataagcatctggattagaagttttcagcgctgccatttgagcttgcttttcttctgctaccgtttcgattgcttgtttttcttgtggcgtttttgccgctgcaatttcagcttctaattgcgctttttgttttgcttcaaactcaggagctaatttttgcaatttctgtgcttgttctggtgtgaggataagccatgtttcttttggtacttttgcagtaatctcttttttgattaactcgccagattccccatcaatgccaaacaagaatttcgcaaaattgttatcccattgataagttgtcgttttagtgactaattttgaatttttagcattcggcaccaactgataattggctttcttttttgatgattctacaacattttttgacatttcatcagaaatccaagttttcatcatacttgttgcagctttgtctaatgtattcatcattttgacgtttccaataaaattgacggttgttttactgtcattcgcttgtgctttatacattaagatatagtttccagaattagttccaaaagcttgtgtcagtaacattccaaaaggttgagtgctcccagcggcagaataaatcgtcgtttgcgtcgttttagtcacttctttcatcccccagtgattattatcatgataaatcaaaccaaacatggacaaaagtaaaagaagagttgcaatacttccaaggatatttcctgtggaacctttgatgtagaagaaacccacaatcatcaaaataacaactaatataataatgaaaagtatcatgaattttgacctccatcttctatcacttcttgtttattagcttctcgtacaggagctggtgcgaccttttcttcatgcaaaaagagtgctacgaagatccctaatacagcaaagccaaatgcgattccaaatgaaacatgaaatccattgagtgaagcttgaatcatcttatccgcatattgaagcggattcgtcgttgacagatggtgtgtgggtttcgtactattgatgacattagttgtaactgaagccaatatcgcaacaacaacagaggacgcgatcatccgtaccgtattgtttgaagcagaaccctgtgctgatttttcaactggcaaagcattcatacctgaagtgattaaaggcatcatgattaaaccaatcgcaacaaaacgcacccaataagtaatggtaataaaagcctctggtgttgttgccgtcaagaagagataaggcaaagttccgatggctaagagaataaaaccaataaaacttagtttcttcgcaccaaatttatcataaatccccccagcgataggcgacattaatgccatcatgaccgaaccaggtaaaagtaataatccagattgtaaagctgttaatccgtgaacattttggatgtaagttggtagcatcatctcaacgcccatcattgccattgtattaatcgctgctgcgattgtagtaaccgtaaattgtttgattttaaagacggacaaatcaaggaaaggatccgccatatgaagttgacgacgaataaagaaagcaataatgaccaatccaataataattggagcaataacgctctgagcgtctccccagccatcatttccgacattagtaaaaccgtataaaaataatccaaatccaagtagcgattctagtaatgaaataaaatcaagtttcatatttcggttaggcaggacatccgccattaaaaatggggtcaaaacggtcacaataatcagtaaaacaaagggagcaagaaaaagtgtgcgccaatcacccaattgtaaaattcctaaaaactttgtatttccagataaaatccagcccccataagtaggaccaatcgcaggagcaagtccaataacaagtccgcccattcccattggaactccgattttttcaggtggaaagatatttgtgatgacggtcatcatcaatggtaatgaaattccagcgcccatcgccatcactacacgacctaaaaggaaaatattgtagttggaagtgggtgcaatcatagcaatcaacgttccagcagctgtaaagccgtaggcaatcatgaataaccaacgagtcggaattttggtcgtcagataagctgatactggaaccataattccattagcaagcaggtaccatgtcgttgcccttgcgctgtggataggctgatgttaaatttgtccatcaaggttgggtaagctgtagacaaaaacgtttgtcctaacattccagcaaaggtcccaatcaaaatcattgcaaacatgacatttctaaaataatgattgccatgaatatcttttgaatagtcttttcccattagttcaggcacttttgttactccttttcttgttctaagattgacatgctcgtttgtataaagagcgcccaagcttcaatgaagtgttgagtcctctcttctcccatcgcttcaaaaacatttgagatgcgagtaatggtacgcgtacgtcgttcttttgtttcttttcgtcctttatccgtcagaaaaactaatatttttctacgatcctctcttgaaatttctcttgaaatcattcctttcgtgcggtgctggctccaatatatctcgcaatgtcactcgggacaattaaagtgccagcatttttataaagataaaccaaaaccagaggctcaccttgagcattctcattgagtttcagcaaaacttttttttcgtttttttgcttcatacatgagaaaaagtcttctgctacttttgtataatctatacgtttcctttctgaaaaaaatctttttttgctaactatacttcattgctaacgatattaacatttataggatattcttttatttgaagattgtcaattattttatttgatttacttatattttatttgtgtgtaatttataaattatttataacgccgattgttgttttttatggaatatcataacggttcccactctaagaacgtttcatcaacatattacacaaactgaatagaataaattaagaagcaaatcttacaaaaataacccccagtatttcataatactgagggttattttataaagaatcaattttattttattaaaaaaaacaaaaaaaccgccaaataactttggcagttttttcaaattgataacaattcttatttaagagtgattgaagcaccagctgcttcaagtttttctttgatttcgttagcttctgattcagaaagaccttctttaacaactgttggtgcaccatcaacgagttctttagcttctttaagtccaagaccagtgattccacgtacttctttgataactgcaacttttttgtcgccagctgctgtcaattcaacgtcgaatgaatctttagctgctgctgcttcaccagcacctgctgctgctgcaactggagctgctgctgttacgtcaaatttttcttcgattgcttttacaagttcagaaagttcaaggattgttgcgttttcaagttcagcaacgatgttttcaatgttcaatgccattttaatattctcctattaattttttagtttgttgcgtaaatccgccgatataagtgatgttgcttataattaagcagctgattcttctttttctgcaacagctttgactgcaagagccacgttgcggataggtgcttgaagcactgaaagaagcatagaaagaagtccatcgcggcttggaagagacgcaatagcttggatttcttctttagaagaaactttaccttcgatgacaccagctttgatttcaagattttcagcatcttttgcgaaatcagccaaaacttttgcaggtgctacaacatcttcgttagaaaatgctactgctgatgggccagagaaagcttctgataaaccttcaagaccagctttttcagctgcacgacgcaagattgagtttttaaccactttaaattcaacgcctgcttcacgaagttgtttacgaagttgagtatcttcatcaactgataaaccacgtgaatctgcaacaacgatagatgctgcttcagtcattttttgtgcgtaaacatcaaccaattctgctttcttagcaattgttgcttcatttactttgtaatcgctcatttttttacctccattttattttggttgtagaaacaaaaaatctctacacacaaaagacatagagagttcaattatcattttgatatttgtcctcggtaggaagtttatgactttcgtcccctactgtcttcggtcagttcttttagaaccgtaaataagtatatcaaagtttttttagaaatgcaaggataaacttactttgaaatctatttatcttttattaatctatatctactgaaaaatatcttctattttattgctttccttttgagattctagtataagcaagaccgaaacaaaaaatagaaaagaataaagtcatcatgtccagcagtaaccaaggaactgcctgtgtaatccaatttccaactatcaacaagataaatggataaaagatactagaaataaatagaattttcgcccatttattaacttttggagtgtctaaatttgcgattacaataatactaaggggcgtacaaagccatagtaaaataagatcaattaataaaaacattggacagtataaaatgataaaagctaacgatatcaacagccttccccaaaaatgagtctctggtatatttggcaaattaaatgtaactatcaataggaagaaaatagcaaataaccattgccctaataatcctagaagaatagtattcttactctttatcatgaaattatatccttaaaatgttttcttcctaaatcacataatttaatattcctaacggatttatttttaaaatatctcagtatagttcaatgaatattttgcattaaaaaactataccaagttatttataaaatccactattatctttcataaaagccttaaaaaagattataccactttaatatttatttcaaaagaaaaagccgaaccatttcgacttttattttattttattttttatctcagttcatgcaataatcttctgattttttgaaccgtaaaaaaatttcacgttaatgatctttttttcctttttttctttcactttgtcgtcattttctatcaatttttgtgaaagcaataggacaagttcataaacaactgcaaagattaatccaatccccagtattggcataatttctcttatccaattcattttaaaccctcatttaatctattatttgtgattcttcaatctcttcaaaattatcaaccactggcccaataatgcagaaattatcttcctttcctagataaaagtccttgtattgtgggtctggattgagtgaatgaattcggaaatttccgtcttcttcttcaaatacttgcttaatatataagcgttcttctcccaaatctccttcagcaatggcatagacatctccactccgtccaaaacctgtgtgtaagaatgttgcaatagaaaaatttggaaaatctggttccatggattcacctttaactctggcagcgccatcatatcgtccaagattttctgttgtatatgctctataatgtccgcctgtgttattggctgtttgaccaaaacctgctgaaagtgcttcgtcttcaacaacagcatactgtaatgaagaacgtctataagttttcaaatcaatgagatctgctttattctgttctataagaaaatcagtgaaattaatgacagattcctgttgttctcctgtcagcgaacgataattatcaattaattgtttttctgcaccattatcaggatttttgattaattcttgaatgggtaaatcatatatatctgctagcttttctaataattctaaagttgggttagttgccttttgctcccaaaggacgtaagcattttgtttcattcctagtttatctgctaattgactttgcgtaagtttagcttcttttctgagtttttttaaattctgaccaaaattcataactcctccttttccatcattttatcaaactttcttatattatatctcttatttcattttttgtcaatctttttatcagataatctgataaaaataaaaacaactgataacagtggtttcaaagttctttttgtaatgtttgaattcgatacatgtcagcatagtatccattaagctctaagagttcatcatgatttcctcgttcaataatttctcccttatttaagactaaaatctggtcagcgtctttgattgttgacaggcggtgagcaatcgccattgtcgttcgattttgacgcatatttgtcaacccgtcttggataagggcttctgtttcagtatcaatattagccgttgcttcatctaataagagtatctttggatttcggacgattgtccgagcaaagttaattaactgacgctcgccagctgaaaaagcagccccaccttcaatgacttttgtttcataaccattttctaaatccttgatgaaatggtcagcttgaacaaatctcgcagcttctttcgcagcttcgtcagtaatttgagaattcatcattttaatattgtcagtcacagaggccacaaacataaaggaatcctgtaaaactaaaccaattttatggcgaagttcttctttagtaaaggtccgaatatcttggtcatcaatcaaaacttggccctctgtaaattcataaaaacgcataaagacattgataatacttgatttaccagaaccagtgtgtccgacaaaagcaagcgtctctccaggatttacaatgaaagaaatatttttcaaaacttgatgttctccgtcataagaaaaactgacatttcgaaattcaatttttccttgttcaatcagtggagctttgctgacagaactttcgcttccttgttttggggcaaattcctgttcttccataattgttttaatacgactagaagccactaaaccatttgaaaagtttgacaaagaatccattagtcctgaaataggattaaagtaaatttgaacattactgataaaggcgtaaattaatcctgcttcaaccactgcatgtaaactccgattagaatacatcagtaagactactacaatagaaattgccatcaagaagtttaccagaggactcagcaaaataccattaatttgaatgactttttttctataaccatagtattcatcatttgttttttcaaattcatttcccaaacgactttcttgacgaaactgttgaatgatcctcataccagaaatgtattcatttaatttcgtgtttaactctgaacgtttagcaagcatggcttggtaaacttttgtactcactttttgataaatgataactgccaaaatcaataatggcaaaatcaacaacattaccagagcaattttgtggtcaataacaaacaaagcaacaaatgcaatgacaatcgaaagaacacttgtcaatgcattaaataaagtctgccagaaatcaaataaatcagtatcatttgtaattctggttatcagccagcctgttggcttctgatcaaaatatctcatacctagctgatgaatttttccataaactttcttacggatgtattgattgacaaaaattgaaccattctgaagataattccatttgaaaaagaaagcaattgaattaattattgctagaagcagataaagtcctgcaaaatagaaaataatctggtcagttgctttcattggagtcaaataagaatccataaaaactgataaaacaaaaggcatcagtgaagccagagctgttgtaatcacactaaaaacaaaagcccaaataaaataccttttgaatggaagtaagaatttaaaaatatatttaaaaacttgccaactttctctgacagacattttgtcagtagatttctccattttctccccctttcaaagttcctgacgagtctgtcagtaaattttcatctttatcagtggctgttaaatgactttcaatttgttgcatttgccacatttgagcataccagccccctgttttcaccaaatcttcatgcagaccacgctcaataatttttccttcgtctaaaacgagaatttcattggcttccattactgatgacaatctgtggctgacaaccagtgttgaactctcatgacgcagagccttcaagtttgacaaaatcaactgttcggtcttggcgtcaaccgctgataatgcatcatctaaaatcaataatttaggctgaataagcagtgccctcgcaatagataatctttgtttttgtccaccagaaagcgaaaccccacgctccccgaccaaagtgtcatatccttcaggaaaagtaataatgtcttcatgaattccagctgttttggctgcaatttcaacttcttcttgactcgctgacatcttggcaaagcgaatattgtctctgacagacatcgaaaatagaaaatgttcttgtggaacataaccaattgctggcaaatactcatctaactgataattcattatatcctgatcagcaaaagtaatttgtcctttgtaatggtcaaactctcgcattaaaagtttaatgattgttgatttacctgcaccagtccgcccaaccaaacctaaaacttgaccttcttttaaattaaattgaactttctccagatttcgtccttcattttcattcgggtaagtaaaactttcaatatcaaaagataaatcaccttctttgggcatttttaaagtcccctcagaaatcttagattctgctttttgagctaataatttatctactcgactataggaagctcgtccacgttcaataacattaaagaggacaccaattgcaaacatcggccaaactaaatttccgatataagtcacaaaagcaaccagctgaccaagggttaagacatgatgaacaacataatatccccctaaaagaattgtcaaagtgtaagataatccgacaatcagagtaattagagggtcatacattgaatcaatccaattgacccgaacaaaggctttatcaatattatccaatttatcttgaaaatcagccatatcttgttcttcttcgccaaaagatttgattgctttcattcctgtgattgattcttgaactttatcattcatttccgaaaatgtttcttgagcgtgttcaaaactcacatgaattttgtctcccaaaattttagatactaacgctaacaaaggtaaagggaggacagcaataatcgtcaaacgccagtcgataaataaaagcatggcgatgattgtcatcccacccgtcattaaggaatccgcccaagtcaaaaccccaagtccagcaacactctgtatcgcttgcaagtcattcgtcgcatgggccatcaaatcgcccgttcgatttctttgataaaaaagggtgtccatccgcaagaaatgtctaaaaagacgactacggataattttttctagtttaaaagcttcaccccaaatatttgttgaccaaagaaagcgaaagccatattcaacaaaagccgtcaacagtaaaattccagaaaagcttagaattaaagataaagtcaagtttcgcttaacaatatggtcaataatttttccaataattaaaggtggaatcaagtgtgtcaaagagacaataaaaagggccaatagaccaacgccataaccttttctctctgccttaaaaaaccaccacaaatctttaaaaattttcatacagtttattccaatttattatataatattctaaatattagtataccataaagagagcgattaaaacagcttatttggttggcttttttgggaaataaaaagggttatgtaggcacaaaatcctttataattaatatctaaagtccataccaactaatttgctcatatctccaaccaatcttcacaagtgaatctcgttctgcgcaacttgatgtataaaaatgactgatttgtttacctttggcattaggattaaaaagccgataaattggcgtgtgttttgctgtgtccgaataaaaagcgatttgttcaaaacgccaacctgctttgactagtggatcacgctcaaaggaagacgtcttataaaaatgttcccctgaattagggttataaagtcggtaaactgcattacctgtcgctggttgttgcgaattgacaccctcataattccagcttgtttttgataaagtcgtcgtttcatacaaactttttgtatagagatgttcgccattgtttgggttataaacacgatataatgctgttgattttagtgctggtacattattttgaatccaattaatgttgcttgcggtgagttgaacaccgtagttgggatattgcgaagcgagggatgaggggacatagtgagtagggttagtattattaggatagttcgcgtcagcaacattaatccctacaatattattacttgtattgaagatagggctaccactttgtccggggaactcactgatattagagtagttaaacaagggattgctaatttgagaaacattaccagacattccccacatttgacccgcatggtctcctggaaaaccgaccaaagagatagtctgattagttgaaagagtcgatgtcattcccatccaacctgtagataaccctatattttttgaaagattaagaattcctaaatcatctgcattattgcttggatatccattagtaatcaatgaatcttttgccaaccaatctgggtttgcaacttttcccgttactgtagcagctgtattagaattgtatgtcccgtttgcgttggcttgataaaccgttgcagatttaatataaccaccattgggtctattgtaaattacatgacccgctgttaatactgtattaggagcaataattactccactgctataatagactgttccatttccaccaactgttacaatatatacaattgtattgtaaggaaattgattagcacttgttatcatttttcgtccatctggctgataaacattgctagcggaaataccacctgcaggtataaatggttggctatctgctagaacatttggagaaaataaaagtaacgctgaggtaagtagatagaatttaattgttttattcatcataaaggtttcctttctaagctggactaagtggaccagattgtggtggtactggtgaactaaagcaaaatgcaaccccttcatcattccaacctatttttgttaaaaatgctgtttcttcaatacttttagtataaaaatgttgaccgctatttgggttatagagtctattgataatttccccatgtggatagccataatgagaggcatcatagaagacaatcccctcattgacccaaccataatttttaagctgatttacttcattcgtatttatggtgtaaagatgttccccactatttttactgtacaaacgataaacaggaattttatcataactttgaccgttcatcgtgtagtatgaagttccaagaattccctcatagccccatccaagactgacaagattatttttctcggtaagctccattgtatagacatgctcgcccgaattaggattgtaaaggcgataaactggtccattgaagtttgccgtaacagcttttgctggtgtcgcctctttaaacgataaacctatgccgagcaagagcgctccaaataagagtccgtttttgaaaagttttttatgagttctgtatgtgttcataacaaacacctccttattgtttataatattaatttttattctctcttcactaattaaagtataagagacagggagaaattaatatgaaaaaagcactttcgctttctgcagcaacacttgcccttctcgtagtaggagccacagcaatttcaacagcatcagctgattcagttaaggctgaacaatggacttcaacaggaacaattgggttcacagcaaatacaacaacaccacctgatgttacaaacccagaagttccaggagaacctggacctggaggtactgcgggggctcttgcaattgactatgcatctgatttggattttggtacgcatgaaatttcagcctcacaagctacttactatgcaagtgcagactcaaaagcattttctaaaccggttggagcatttgtacaaatgcacgatcttcgtggtttgggtactgggaatggaactacattaacagtaactcaattggctcaatttacaaatggttcaaaaggtcttacaggcgcagccttgagcttttcttctggagctggagtgaatgctgatgcttcaggttcatatgttccaaaaagtactgctagttacacattgactcctgggactgctcaagaagtaatgtcaacagatggaacagttggacaatatttgacaagctatggtaaagctgcagattatcaaggtaacgaagcaggaggtccaatctctctcagcgttccttcaggatcagccgtggcaggtaactacacagcaactctccaatgggatttgacaactgcgccttaattaggaataaaaaagttgtctcttcttatatgaagaaacaacttttttataattttaaaggtacagtataattttaacggtacagttaacgaaagtgaaaacaacaatgggaaaaataaaaaacttacttaaaaaatctacaaaaattggcgcaagtgctttgcttttggtaagtaccttgttgccaagtttagcccttcaaggtcagttgatagtatcagcaaccaatgcatccacaactttagcccctggcggggccgttgatacagggaatcacacttggggcttaaaagattttcagacagctaacaattatactccagtcggaaagaataccagtggtgcgggttggagttcttcgtcaacttatgacttcggaaccaatcaagcaaatacaggttcttggcttccttttaatggcgctgttgacatgactcagtcaatcagaattgttgggacaacccttgctaactcaaaaggcctttttggttctgggaaaattctgggagatgcaaatggtattttacttactaacctgtcttcatctcagctctcgggaggagcaactggtgggaacttaggagtaggtaatctaggttcgggcacttactttataggaaataattattcttataaaaagacatcaattattgtcggaagtgactacaatactgcaacggtaattgctcaaggtaatggtccgggagcaaaaatacttagtgccagctctgattatacagcaaataataattctacaaatctttttatcatggaatggagtaatcctgtcttaaattcagatggaacagtaactggaacaattagttatctatctagaaatggggggactaactacgttagctcagcggatattacagttcaaaagagcatgtcaattggttttatggccgcaactggtgggaactactcacagatgtctgtgacagttaatgaagttacggcaggaaaaggagttcagccagtcaatgttaactatctcaatagtttaactgggagccaattagcaccaaaaggtaccgcttggaagaactctactatcacggcaaacgtaggtgataaaattggagttgtagctcaaggaaatacagtacagacgtcagataactacgattattttgtaccagtagcaccaacgggatataactttaaatcattcactccggcggttactgtacagaatttcccagtgggaacagcaaatcctaatcagattaatgtttcttacacacctctagcacaaagtgcaggctttacatttaattatgatccggcggctcaaagaactccgacagtaccgcctttatattcagtctctggggttactgatcagactatcgtggctgcttctcctaattttcaaaagaatttagcggctcaagtacctgctggatactatatttctaaaatcactaattcagctggtggaagctcaacagggagtacaacagattcaacgattaaatcatttttagcaggcaatccaacttttgatgcaacagtttcaaaaaatcagtatcaaatcatgttatcagctgttaaccaaacgggaacagtaaattttgcttataagtcaaatgttccagcaggagctccaacgttaccaaatgatattcaattatctggattaactggttctgatttgaattttgtaatgccaaacatttctgctggttatgtggtctcaagcgttgtaggtccaaataatgtaacttactcttcgattgcggaagctttgcaagctaacaatcactttgttcctggatcaaataattttaaagtaacgatctcggctgtaacacaaaatgggacgataagttataattgggcttcaaatgttccgggacaaaatggagttgtaggcaaacttcaagctactttacctgcgactactgcaatttctggtcttgttggagaaacaatcaaattaagtccagatattccgactggctatggaattgacaaagtcgttgctcctgacggtaaaacctatacggatagtactactccgggaatgactgctcttcaagcagcacaagcggctaatcctaaatttattgttggtccaaataactttgttataactttgaaagcattagaacaagatgttacattgaaagttaatgttgatcaaaattcaggttctggtgctccaacagcacctcaaccttacacaatagctacattgttgacgggtgctcctattgatggaccatcgattgataaagcacaaaagtggctaaatgattggataactaataatgctgctggatggtcagttaaagactttttggaccctaatctcgtaagttatgttaactcaggattatcaagtgctgtcacaggagctgggggagtagcattttccaaaaataatgtttatcaagtaaatctgatatacagtggaagtattggctttagttcagtaccatcacaaattgattttgggaaaaatcctgtagtgcctgttgataaatcttaccaaggaatgttagataattctgttgtagtttcagataccagagcgccaaatctagcaacatcttggactgtcagtgtttctcaaagttctccaattcaagaagttataaataatggtgtggatactccggtgtcaggaggcatatcgtttatgaattatctttcatacgatgggaaagtgctcactaataatccacaagtcgtccattctaaatctgcaggggaagtaggagataccgtagtaattgataaggcttcgccgagtctctttgccttaaaagttccttcaagttttcagaaagtaaattctgagtttaaagggactttatcatggactttgacaagcgctccatagaaaatagaacaatgatgaaaatattttgggctggcatttatgatgaagtaaacattcaagggatactagggaaagagtacacaagtaacagtgtattgatggataagaaaaatggaaaatatattttatctacgtttgaaagctttgactcatgaatctggtaagtcatttaatcaaattgagagagaattaggctatactagaaatgctcttgcaaattataaaaatggtggagtgccttctggaataagattgatggagttagcaaactattttaaagttctgcccgattatttgattggaaaagttccttttgaaaatgtggaaagcattgaaaacacatttgtttctcttacaaataagcaaaaaattgaaatgtatcttctttgtcaaaaatggatattatcaagaataaaagaagattgattgtttattgagcttaggacaaataaaaaactactgaactaataattcagtagttttttattttatagattaagagataattttaggaaaaagtggaatgggataatgttttaaaagaaaaatccttatcgatagacaaggattttgaattagtgccgactataggaatcgaacctacgaccccttcgttacgagtgaagtgctctaccgactgagctaagtcggcacaaaataaaagtggttctccacttttattataatacaactttttaattgctttttcaagaactaaaaatctttggcattgggttgattgtagccataacgttcacaaaaatcttcacggaattctagaaggttatcgtccatgattgcttggcgaacatctttcatgaggtttactaggaaatgaagattatggtatgagcaaaggcgtaaaccaaaggtttcatcggctttaattaaatgacgtagataggcgcgtgtgtagttggtacaagtgtagcaatcacacattgggtcaagtggagtgaaatcatgctcatatttagcatttcgaatatttactcgaccaaaatgtgtcattagtgttccgttacgagcgattcgtgtaggaagaacacagtcaaacatgtccaccccgcgtataactccatcaatcaagctatctggagcaccaacacccattagatagcgtggtttatcttcaggaagcattggtgttgtaaagtcaagaacagcgttcatttctttatgtgattcaccaacggcaaggccaccgatcgaataaccagcgaaatccatagaagttaaatcgctagctgattgacgacgtaaatcttcaaagccagctccctgaacaattccaaacagtccttggtcatttggacggcggtgagcattgagcccacgttcagcccatcgtgaagttcgttcaacagaggctttaacgtaatcgtaaggttggtaaaaaggtgggcattcatcaaaggacatcatgatatctgaaccaagattgttttggatactaattgctttttctggattgaggaaaagttcacgtccatctaaatggcttttaaatttaacgccttcttctgtaatatttttcttattttgaacaagactataaacttggaaaccaccactatctgttaggatgggttggtcccaattcatgaatttgtgaagaccaccagcttcagcaacaagttcgtcaccagggcgtagccaaaggtggtaggtatttgagagaatgattccagagccgagagttttgagttcttctgggttcattgtttttacagtggcttgggtaccgactggcatgaacattggagttgggaaggtaccgtgaggggtaatgatttctcccaatcttgctccagtgtgtttttctttttttattaatctgtattttattgcgtgttctgtcataaaattcctttaatttacttgttttttttaattttcgagttgagctttcttgtggcttaaaaagcaagcacttataagtataacaaaaattaaatggattttatagacgattttaaaaaatcagtcgaaagtcttagagattttgcgtatttattggtacaatggagtaaatgtaggataaatgattgggaggtgttttatgtcaagatgggaattgaaaaatcaagccaagggagccttacgtgataatttcggctcgaaaatgttactttttattattccaataatcatgggaatactaggtggcggaaatggtatgaaacaatcaatggactacaatggttcttttgataatgtatcgagtagtgtctggatggcagttagttttgcgacattgcttattgtaattttgatgattgtggtcgctttgtttgtttcagtggtgacagtgggagcaatctttaactatattaaaattttccgtggtgagcgtaataatccgcaattcaaaaatgtttttggaccattttatgatggatcggctggaaaaataattctattgaatattgttaaaggaatcatttttgttattttaatgtttattccaatcattggttgggcatttggcatttatttggcacttggttggtcacagtcaacttacgttttgtttgatcagctagaagaagatcgttatagtggtgtgatgaatgtattgagcgaatcagcgaccatgatgaagggactacgtggagattatttcattttcaaatttagtttcttttggtggtatgtcctttatggtatttctgggggattagcaggattttggacaactccttacctcaatatggcttcaattgcttattatgaaaatattcgtaaataaaaaagctgtcagtaaattgacagcttttttatttactgacagcctgtcagtaaattaattttcagttttaacgtgacgtccgtggacaaaatgataaatgacagcaattagaagcgcaagaattgctgatgcaaaatagagattacgataacctaataagggcataaacattcctaaaataaagggtccaaaaccaacacccatatccataaaaccaaagaaggtagaagtagttactcctagacggtgtgcttcagagttacgaatggcaatcgcttgtccaaaaggagagaaagaaccatagcctaaaccaatgaagattgcggcgataaggagcatccaacctgattgagctaatccaattaataaaagtcctaaagcgaaaaagagataggtgggatacatgacaaagttatccccaaatccatcaaagatacgaccagtgattggacgtgataaaagaacagtaatcgcatagactaaaaagaagaatgaagcagcttctgagagatggatattaagagcgtaggcatccataaatgacagaatacttgaatacgaaattccgatgagaaaagcaattagggaaatgggtaaagcttctttttcaaaataatttgaccaagcaaattttttatgattttctgtaattgcagaactgtcagtaggtttttcgtttacgcgtaagaagaaaataccaatcagtgcaaggaataataataaagcggaaagccagatcaaagagtaaaagccagaagttcgataaaggaacattgataaaaatggcccgactgctgacgagagtgtcacagacagggcataatacccaattccttcaccacgacgagaagaaggcacgatagctcctgctagagtaccagaagctgttgcagcgataccaaaaccaacaccgtgtactagacggagaatgagcaagagagcaacactatgaacgataaagtagacaaaggttagtaagaaataaattaaggttccgatatatagaagctttttagcaccaaggcgcttcatattatttccagcccaaagccttgcgataaatccgccgacaataaaaataccagataaaataccagcaatactagcagaggcatgataacgatccatggccattgtcccgatgacaacggtagggagataaaaaacaagataaaaaataaaattaagtaacatattaacaacgaaagttgttgtccaaagtttttctttcataaagttcctttctttgagaaaaacttatgaatgcgtaaacatccgcctaaaaaacagataaaactcccgctttttagacgagagttttgtgtttgcgtaattcaactttattattgtatcaaaaaaatcaaataaaatgttgacagggaaacttaatgatacaagaccacatttttttattttattttcttcctaatcctgaataagcatattcgattttaatacagcgattcatcacgattttgctttttccagcagttcggagaatttgttcagcttcttgagattgaaggcccaattgagcccaaaatacgtcggcgtctgtctcaataaaatcgcgggccacatctgccaaaaattcacttcgacgaaaaatatcgacaatatcaatgtgaaaaggaatatctttgatagtagaaaatactttttcacctaacaattcagttcctgcaagtctgggattaactggaatgacacggtacccatttttttgtaatccttgagcgattaaataagatgagcggtctgttttatcactaattcctacaacggcaatcgttttagcttttttgaggtaatcaaacaggacctcttgttctggattttcaaattcgtacatcagatttcctcctcttgtctttgagtctattatacaatattgaaggaattggtgccttattttagcctttttatagggaggttcaaacttttttagaattacaaaatctttttaatttttttgctataattaagctatgaataagaaacaattaaaaacaataacaagcgtggttgcagttattattgcactagctgtgggatattttggttctggacgtttacatttagggcaaggaaatgattcatctactagtagtagtcaagtttccacaaaagccttggcaacatcagttaagcaagctcctttgccttttaaaaaccaaaaacaaatggtcatggcaaatactgatgctttaaggcgtgcagttgatgcgcacattcaacttaaagattcgcaagaacctaaagtaaaacgggaacctttaacttataatcctgttggctggcataattataatttctattacaagaaacccaatggttcgattggtaaaatgtggttgatggcgcgtggacatttggttggttatcaattttctggtttaaatgatgaagcaagaaatttagttccggaaactgcttggtttaacggtggaaatttcacgggaacgaatgatggaaatactgccagcatgctttattatgaaaatcggttagacagctggcttgctaatcatcctaactattatttggattatcaagtcactccactttacaaaggaaatgagctcttgccacgccaaattcgattggcttacgttggaatagataaaaacggtcaaagcttgccgattaaacttggcgggggacgtgaaaagtctgggaatggtggagcaactgttgttgttcttgataatgtcgctcctaatgctaaaattaattatgctgacgggactgcagtcaatacagtcaaaccttaaataattactgacagttctgtcagtaaaattaattcttaattcaataacagaaagcctgaaaaatcagtcaaaagactgagaattaaggctttttttcttgctataatgagaatagaaagacagcttcacaaatataataagaggttgttaattactggaggaaaaagaatgtttttattagtcatgttaattttagtcatgttacttttgataaagggtttctttaaatttgttttaccagcattgattatcttaatgattttaaaatttttgttcggtggtttaatgcttttgtttagccctcatttctggggtacattacttgtgattgctttcatagtatggcttgtaagagccagccgtagtcgttactactaaaaggagtgaatatgtttttaggaattttgtcaggaataatcgtacttggagcgcttttgtcaatattgttggtatttttgggggtcatagccttaagggtctttttacgctatattttcccgattttactcatcttgttggtcattcgtttgatggttttaggaatcttacttttgtttaatccacatttttggtttttcattgtcatagtcgccctagtcctttgggtacttggtaaaatgaaaaattaagcagctttttaaatgatgataattatagaattactgacagtttcgtcagtaatttttttgattataattttataatcatttttaattttattgagtgtttttaaaaaatttgatataattcttttactactgtgtatttaaaacaagcattttgtttataaaaaaagatttccgctaaggaaacatcggaggacgtcatgtcaaatgaatatggatcgtgctcatcgcgtcatgagcgtagaagctctcgtcgggcaaaaaaagattctgatgtcgtggaagcggcagcaaatcaagcgattaaacatttagaagaaacagaagatcaaacagccgaacgaacttcaagacaaaaattgacacatggaaaaacgctcagaatccccttagcaacctatggattactgacaggattatcaattcttttggcactaagtttttatgcttttcctttgtggaaacctgttgcgacagctagtcagtcacaaaatctctattctgggtttgcaatgcatcatggtttagttccttacaatgatttttatggaactggtggctcaattttttatctcatcaactggttaggtaataccggtggaagcacttggcttctttggctttttgaaattatcgccttattaatcagcggaattttaacttatcgtttgataagtcaacaaactagaaatcacacggcatcattgactgtatcggtctttacattggttattattgctggtttagctagaggaggcgatagtccaacactctttgctcttccttttgctctttggggcgctcaatttttgagtcaatatttccaagattcctcaacggatagaggatttatccgatttggaatggccgcggcttttgctctggtcatttctccagtgatgtctattttcttcagtttgtcagctttggccttggtgatttataatattagcattcgcagaattgggcatggtttttatcaaatgcttgcttcaattttgggagttttgttagttggttactcggtggcctactactctcttgaagcacaaaccgtctatacttctattgaacaatctgttttaatttcatttactcattttggaccgagcggagatttattagtcaccttagcgaaggcactagtactaactcttatctttgggattgttgcaggatttgtccaaggacttgtgcaattaaaaaaaggtggatcagccagaatttggtatgtgatgctactcattgggattgttggcgtaacaacaatagttgtttttgcgcaaacttttgatagttctaatcttttagcagttctaccatttacagtggtctttgctgggctgagtcttaaagatagtgatcaaatccttctgaagtatttacaaaatcgcttatttgcccctattctagcaattcttttcgttattttcactccaattagctaccattttatgaatcggacaattgcttcagaagagcaaaatgttgcacaatacattcaagctaatgctaaaagttctgaccgagtttatgtggtttcagacggtaaaaatattaataatttaacaaaaacaatttcgactttggacaatgtaccagcaaattatccagttaaatttacacaaaactatgatttgaaagttggaaaattaacagataagtatgttgttttgcaagctgctcaagaagttcctgctagtttgaaaaaagttttggataaagattataaagtaagcaattattctggtaagtatttccaagtctatcaaaagaaataaaaaaattgttaagcacaaggaaagaaaaaccaaagagtaaaggtgctataattacgtgagcaggctaaattactaagtctgctgctgagttttgaatgctaaacttcataacacttacggaggtcaattatgagaaagtttgaaaaatcgcataaacttgataatgtcagctatgatattcgtggtccagtgcttgatgaagcacagcgtatgcgagccaatggtgaaaaaattcttcggttgaatacaggaaatccagcggaatttggttttcttgccccagacgaagtgattagcgatttgattcagcatgctgtggatagcgaaggttattcagattctaaaggtattttctcggctcgtaaggcgattatgcaatactgtcaacttaaaggcttccctaatctggatatcaatgacattttcactggtaacggtgtttctgaattaatcgttatggctatgcaaggccttttggatacgggtgatgaggttttgatccctatgcctgattatccgctctggacggcttctgtcagcttagctgggggaacagcggttcactatctctgcgatgaacaagctggatggtttccggatattgatgatattcgctcaaaaattactagtaatactaaagccattgttttaattaatcctaataatccaacgggtgcgctgtattctaaagatttattacttgaaattgtccaagtggctagagaaaataatttaattatcttttcggatgagatttatgaccgtttggtcatggacggcgctgttcatgttccgattgccagcttagcacctgacctttttgtggtcacaatgaatggactttctaagtcacatcgtattgctggatttcgtgtgggctggatggttctgtcaggtgagaaatcgcatgtcaaaggctatatcgaaggcttgaacatgctcgcttcaatgagactttgttcaaatgttttagctcagtctgttgtgcaaacctcacttggtgggactcaatctgttgataagctgcttttgccagggggacgagtttatgaacaaagagaattcatttataaagccattaatgatattccaggattgtctgccgtgaagccacaagctgctttctatattttccctaaaattgacagagaaatgtataaaattgataatgatgaacaatttgttttagactttttaaaacaggaaaagatacttcttgttcatggtcgaggattcaattggaaagatcctgatcattttcggattgtctatctgcctcgtgtagatgaactggcggaaatacaggaaaaaatggaacgctttttatggcagtatcgtaaataataaatagaaaaagatgtatgaatagaaatctgtaatcttttttaaagaaagtctataatattttttgagaaacacatttgtgctgaaataaaaaaagactaatcattaagttagtctttttttatttcttataagttattatctattttttctaaaagccttaagaattcagcttgttctttctcagtcaaagcaccaatcaatttactttcagaggcttcaaatatttgattaatttgattaataattttaagtccttttggtaaaatatagatattttttttacgttcattatctttaggaattcgtcgttcgatatatccttttttttccaagccttggagcatacttgtaatacttgctcctcgtctattgaatacctctgctaaatctttttgaattaagcccttatcttggttctctgcaatataagcgatgaccctagcttgttgatgattaacttctaaatctttcatcatttgactagaagccatcattgatttttgtgagatagaacgaattaaattggaataaattgtattggccattctggtctccttttttatttactagttcttaactcttagtataatggtcttttatctaattgtcaattcaaaacaattagacttctaatagttagttcttgacttttcttttttttttactttatgatgaacactgttagttagagttctaactattaattttaaaaggagaatcaaatgtctgaaaatttaacaagagaatggattaatttctcagaccaaatgccttttgataaaaattatctatcaaaaagttttaatatccctgaagaatttttatcctatgcaacagataaagatgaaagtgctcgaatcgaaatggatgatgaaactaagagtttgctcattatttttgatattccttttgaggaccaaacggacgttgcctactactcttctggtcccatgagttttatcgtaaccaaagaggtgattatcacaaatgtagcagacaaaaagatggcaactattctaaagaattcaaaactggtggatcatttaaatccaaaatataaaacttcttttgtccttcatttcatattagccattgccaagctttatgtcgatagaattagaatccttaatcgtaaacgaatactgattgaacaagcacttggtaagactccaaaaaatgaagacctaattaatttaatgaaaattgaacgaagccttatttatttcattatgtccttaaaatcaaactcattggtaataaataaaattaaaagtggtaaatatttaaaactttatgatgaagaaaaggaacttcttgatgatttaatgattgaagttgaccaagcttttgacatgtctaacatttcaaataagatattgaatgagatgaccgattcttatgactctattatcaataataacacgaatagcgtcatgaaatttttgacatcctattctattattttaaccatccctaccataatttttagtttttatggcatgaatgttcctctaccattaacaaatttaccaaaagtctcttgggaaatcatttgtttgctggcccttctcttatcagtcttactgaccctcttttttgttaaaaaagattatttctctaaaagatagttttatgttgacaaaataaaaaataagtattaatatatataaacagttagatatctaacttttagttatctatcatttatttcagaaagaagaaaaaaatgagtaaaaaatccaactcttattatcttaaggaagcgcccatcagaaaagcaattgctcacttatcaattcccatgatgattggaatttccgcaacaacaatctataacttaatcaatgcctactttatcggccttgtccatgacaccaatatgatgtcaacaattactctaggtttaacaataaccattgtttttatggccatcggaaacctttttggcgtcggtggtggaaccttcattactcgcttgctaggttctggcgataaagaaaaaggaaagcaaatcgctggttactctttttatatgagtctaaccatcggtttgcttattggtcttgtttcacttttctttttaagcccaatcgctcatctactgggggcagacgctgcaactcttacctatactaaagaatacgccgcagtcttattaggtggtggctttagtatgattttaaactatggactggaacaattagttcgggctgaaggtgcctcaaaagaatcaatgtacggtatgttcgttggagtagcgactagtattgtcttagatgccctctttatcttagttttaaatcttcatgtcattggtgctggactttcaatggtaatcgcaaatctagcctctactgcttattatgtctggtttttagaaaataaaagtgaatctctcaaagggtttttgaaacattttaaaatcagcttaaaagaccaatttgaaatctataaaattgggattgcggaagtttttaaatcagcctttatgattgttacaaccctcttattaaaccgcttctccgttgaatatggagacaatgttcttgctagttttggtatcgcccttagaaattactcaactgccttaatttttgaccatgggactctttttaggggctattcctctctttgcctatagttttgcttctaaaaacacccaacgcttaaaagaagctctcaaagaattatctatttggattggtggaatttctatcctctttgccctcattgtctatctatttagagttccggtcatgcaactctttaccgatgatagtgcggtaataaaagttggattaatcgtgctcgccgcacaacttgtatcgtccgtctttaatggtttctctggtttatttactggtattttcgaagcctctggtctaggtggtcaaaccggtataatggctactatccaaggaattctttatattccaatcgtcattatcctacatcagttctatggtttaactggactgatttggtcaatgaccctaacagaaggaattgcctttgtagctggtctcatcatgcttattccttatctattaaaattaaacaatggtaaactaatggagaatcaacctgaattagccgttgctgaataagatataaaaaacgaggaactttgtagaacctcgtttttttatcttaaatcaccccactattaattaaatcagaatgatttcttcccaaataagtttcttttatttctccaaaatgaagcacaattttttgcaaaatcacatctggacttttagcataaaatagcagacgatgtttaccttgctccaacttggcaacagataaactcctgatgattaggtcagcttgccaatttcccaattctcccttatactttccattaaaattgatttttacttctgccccatcatcaatttgataaccataaataagcccactattattccaatttaaacttggcgagagaaaaacttcaacttgaaattctcctgaagatgatgtctcaaaatcatagcaaacaaaattttgtttacttggaataatattatttggaagaggggtaattgctgagaaagtttttcccatatcagctatctctgtccaaacaacttctccttgagatttttcgttaaagtcagctgcttcaatcacaactgattggtcaatttcttttgaaagatattcttctgatttaagacgacgaatctctggcatgatttggtactctggttcttgccagtcatggtaaccaatatgagtttgactcatcatatgttcccatttcccattatttaaagaattatagtgtgaagttaattcagcatcacgtttaaaacaccactccactttatctgctgcttgattcactattttggtatcgttagacttccagtttatggcttgagcataatacatttcataaagattggcagttgcaacaagtggaaaatatattaattgttcatagacttggcgatattcctctggcatcaatacaaaaagctgaccagcttgatttgataaatcccgatagtttgcaagaattcgctcaaactcatagtcaatttctaaactaaatgtatctttatcgagtaattcagggcttattgtcatatttaatttactataagcggcaagaagtttacttgcatcattgatataatttcctccaagttgtttttctacccaatttttagtgtagccttccatttcctcaagtgattgctcaggattccacgccaagtccataaaataagaaagaggatattcttgacctttcaaatctccaacattcactacccaaagttttctaactccatagttataagctaaagttatttgttcccatgttctttgaatttgagaaacattaatccacttactatttcgtggtccaccaacataatcataatgatagtaaattccaaagccaccttttctatctcgattttctaaacttggaagtttccgaagattgccccaattatcatcacataaaagtaagatgacatcatcaggcacgcgcattcctttatcataataatcttgcacttccttataaagcgcccaaatctgtggtgtctctttagcagaacgccctgtcacttcggaaataattttcctttgcttattgataatttgctctaaaagggaaatattttctccctctcccattgcttcgtccccattaccacgcattccaagagtaaaaatatcttcagtctgataagaacgctcaattccttgtcgaaaatatttttctaatccctcctgattactttcgtaatcccagtctccattgccatattgtccatgattacgaatccattcttgatgattacggcccattggttcatggtgtgatgttccaataatgactcccatcttttgggctaatttagaattctctgggtcatcagcataaaaggctgaatcccacatggcaggccaaatgaaatttccttttaaacgaagtagcaaatcaaataatttttcataataaaggtgattaaaagaattcattttttcgcctttttcattcattaaatgtccaaaatgcttagtcgcccaatttcctgcagctggccactcatcattgataaaaaagccacgcatttctacttttggagcatcaatcaaaaagaaaggctcatttaggtaaagctccgcttgctttttaattggcacatccatccagtaatgccatggtgaaacaccaatctgacttaaaaattcataaatcgcataaatcgttcctcttctatcattaccaatcaattgaagttgcccttcaaaaacggtaataatatattgctcttttttatttagtgcctctcttaagagctcataatttttttgcgattttgctaatgaagtatcgattgttgcaacgataatcttagaatttttgctctcagttgcaagaattgcttcttcgcctaaaacattcgttaaatcattttttagatttattaaagcatacttagttattgcttcatcatcttttttatcataagtaatctttacaactccgctaataagcattgaagtttttgtttgactaacaatttggcttttcatagataataatttctcctattttttagacttctgtactactcttaccttcctgcgtataatttttccagacccaatctagcattttagttgattcgtagcagataagataaagataagtgctgcttaaaacgaaaatcaaaaaaacactcacaaaaaacatgattcctaataatcctaggcttaatataataactttaatgatcgaacttagaaaagccattgtccaaaccagactgattttaaacatatctcgcattctaaatctgaacttaatattaatcaatccaacaaaaactgtgaagactaataaaacaaggagtaataagataaagaaccaagaaaatatcggagtcgaagatttttgcatcgaggcaatatcaatcagaatgattgaagcggctagaatcactggaattccaatttttagagcatctaaaaataattttctatattgtttccaaaaatatatccctaaatgctttacatcttcactttctaaaacataaagagtcgccaagcttaaagctgctaatgccggagccactagaaaaaataaaggagtcatgaaaataaaatttccaatctcatatttaacaaacaaaaatgggagagggattggaaaaatagaaattacaaacattaattgtaaaaatatgatatgtccaatttgtccagctagtttataataaaccgattcggtaacatcttttttaggattcatcttgctttcctttacatccagaatattttttaagaaagtctttaatcaaaaatgattaaagactatcctaaaaaattaagccattgaagttgccttctggcttaattgtctaataatacttattttgccgccttataggctttattaaccatatcaataagttttgccgaattcttagcttgtacgtctttcacgtaagaactccattgagacattggacgttgcccacttacaaaagcttgtgtttgagcggtaacgaagtctttcaaaggcgtatcaagtaaagaaaattgttcaaggtctgttgaactcattggataaacaggtgcagttgcaacaatttttgcattcttatccattgcttgtgaaaattctttagttacatcattatattgagagtaaatcaaagcttttgaaccagagccaacagcatagaagacaccattacggaaaccaaaatatttttgcaggtcttttgtaccacttgggttcaagcctaaggtattaacatcttttgccaaagtgtaagtgtctccagatttagtataagttgtaccttcaactccccagcgcgcaaaggtttgtccagagtctgaataaagtaaccagtcaataaattggagggtggcaaggaaatggtcactatttttcaatttagaagataacatcataccagcaacggctgcaatccggttatcttgaaccatcaaaccattttcccctgcaggaactgtcatcattgctactttttcatctgggtgttttgcttgtaagtttttttgtaaagttgtaaattcagaaccatttgtgccaatgacaaaggattgcccattgatgaattttgctgttgctgtatcatcagtttgagttaatgattctttatccatcaagcccttttggactaaattactatagtaacttacgaattttttataatctggtgtagtaccagtaaagacaaatttgttatctcctttgtcataagtggcatttgaataaccccaaccagcactagtattaaactgtggtgcaacaatatttggaatggcattaaactgccaacggtctgaatatggtgttacacttggatattttgctttgagtgtttcaagcgctttagtgaattcatccaaagttgttggggctttgataccagctttttcaaaaatgtctgaacgataggcaaaagtataatcgtaagttggaacttcaccaatttgaggtaagatataaactttgccatctttttgcttatgagaattaaataagtctgttaatttccattcttttaggcgtgcagaaagattgggcatatattttagataatctgatacagggaggatttgtccacctgcgacaaattgtgtttcttcaccaggggctactcctgttacgatgtctggcgtttgaccagccgcaatcaaagttgagcgtttttgtggataatcagataaaggaatgtctgttcttttaaaagtaacgttctggtttttctctagttcagaccacaacatccaactgtttttaactggataattaggggaatcacgatacatcattgaaagatttaatgccgaagtcgctttaaaagtttcatcagctttgaaatttttcatatagcctttttggcttgacatattaatcacaccagcttttgcatttgatgttgatttgctgttcgatgaacaagcgaccaacatcactgaagcgccaatcactgccgctccaaccaataaatttttccaagatttcattcttgtgctccttatgtatttatataatctgaactaaaacgtatcagttttaattcaagaaactgactaacttaacccttaacagaaccaatcatgattccattaacaaaatatttttgacaaaatggataaacgattagtacaggtaatactgttaagaccatggttactgccttaatgtttgaactcacctgactctgttcatcagcactttgcgcctcggcacccgttgctcctttgactagatttcgtagatatactgaaaccggaaagagattcttgttatccatgtagaggaaagctccataccaagcattccatgctccaaccgcatagaataagaccatggttgccaatattggtttagataatggcaagatgattcgcatcaaaatttgaaatggagttgctccatcaataatcgctgcttcttctaatgcatctggcattgattcaaagaaagacttcataatcaacatattgaaaatagaaagtgctcctggtactgtgactgcccacatcgtattcatccaacctaatgatttaatcaacaagtagtttggaatcaatcctccagcaaagaacatagtgaaaacagaaagtccaatgaaaaatttacgccctggaagatatttttttgaggtgacataagcaagtgtcgtcgtcaaaaataaagaaattgctgttccaacaactgtataaataatggtgtttttataattaatccagaaaatagggtcgctcataacgtatttataggtttctaaattaaaaccaacgggtgttagaacaacatttcctgctgtgattgcattttcacttgaaaatgactgaacaacaacattccaaaaggggtagactgttgcaatgacaatcaaaatcaaaataattgcattgatcactttgaaaattttataaccgatactatctttcattttatcctccttaccataatgaagtcttggtaatcttcgcagaaattctgttagaacccagtactagaactaaaccaataatcgcttcaaaaataccaatcgctgtcgcataagaaaagtttgacgaaagtatccctactcgatagaggtaagttgaaacaacatctcctgttgagtaaaccaacggattttgaaggaggagaactttttcaaaaccaactcctaaaacagaaccaacatttaaaacaagcatcgtgataattgtgggtaaaattccgggcaaggtgacatggagcatttgttgccaacgattggctccatccatcttagcagcttcataaagcgtatcatcaatatttgtcaatgctgccaaatacagaattgaaccccaacctaaggtttgccatacttgcgaaatgacataaatcggttggaaccattttgggtcttgcataaaaagaatacgagttccaccaaagaaatgaatggcgttattaataaaaccattgcttgaggtaaaatctaaaatcattcccgcaataatgacaattgataaaaaatagggaagataagaggctgtttgaatgaattttttaaagatcctgtttttaacttcattcagtaaaagagcgaagataataggtaaggggaaggtaaaaatcaatgtccaaatcccaatagaaagtgtgttaagaaaaacttgccaaaaggttgcatctccaataaacatctggaaatatcgaagtccaacccaatcctgtccaaagacagaacctcccggtaaataagttctaaaagcaatcacatttccaagcatcggaatatagcgaaaaactaaaagatagactgttgggatagccacaattaaatatagctgccaatattttttaatagatttcatattaaaaattttccttctaaggagatgaatcatctctaggttagttcaaaactttcattttctaaagataaattattttttcatccctgtatttattacaaaactaatatataagtatttcgttaatagaattatagcgcttgcatttttacttttttacctaatattatgatattctttaggaaatgttgtctatgttacttctaatgtacttacctccttcttaatatcttgcatgttcttgatagcaaaaagcgccagtttaaactaacgcttcttatttttaataacaaaaaaactgataacagtaagttgctatcagtttttttattctattgccactcaacagttgctggtggtttgctcgtaatatcgtagacgatacggttgacgtggtcaacctcattgacgatacgttttgagattttttggagaagatcccaaggaagttgggcaaagtctgctgtcatcccatcagttgaagtgatggcacggatggctaatgtatagtcatatgtccgttggtctcccatgacaccgactgatttcacgtctgtatttactgtgaaatattgccaaacatcacgttcaagtcctgaagcagcaatttcttcacgaagaattgcgtctgattcgcgaacagtttctaatttttcttctgttaaatcaccaaggacacgaatggcaagtcctggacctgggaaaggttgacgccaaacaatttcatcaggcattccaagttgtgttccaagcgcacgaacttcatctttgaaaagtgtgttcaatggttcaatcaattggaattgcatgtcttctggaagtccaccaacattatggtgtgacttaattgtttgagctgtatctgttcctgattcaatgacatcggtgtaaagtgttccttgagcaaggaagtcaacaccttctaatttgtttgcttcatcatcaaaaacataaacaaattcgttaccgataattttacgttttgtttctgggtctgaaaggccaacaagtttgtccatgaaacgtttttgagcatctactttgatgatattaagaccaaattttccgcccaatgtttccatgacttggtcagcttcgcctttacgaaggaaaccgtggtcaacaaagattgatgtcaattggtcaccgatggcacgttgtaaaagaacacccacaactgatgaatctacaccgcctgaaagtccaaggagtacttttttgtcgccaactttttcacgaatatctttgatttgcatatcaatgaagttttccattgaccagttccctttggctccacagatgttaagcgcaaagcttctgagcatttctgttccgtgaactgaatgacgaacttctgggtgaaattggatgccgtacaaattgcgttcagtgttttcaacggaagcaaatggactgtttggtgaagttccgacaacgtggaaaccttcaggaatagctgttacacggtcaccatggctcatcaaaacatcttgaacttctggagttcctgcaaacaatgctgatttttcagtgagttgaagtggtgcaacgccgtattcgcgttcgcctgctgcttctaccataccgccaagtttgtagctcatcaattgcatgccgtagcaaataccaagaactggcaaaccaagttcgaagatttcagggtcaatatcgaatgaaccttcatcataaactgaatttggaccgcctgaaagaataataccgattggattaatctcacgaatttctttggctgtgactttgtgactcatgagttctgagaaaacaccgatttctcggatacgacgcgcaataagttgattgtattgtgaaccatagtcgagtacaatgattttttcaagtgtagtgtcggacaagggaccctcctcttataaggtgcaaaagtccgaattcctattggaaagttcgaacttttgttcaaatattttattagacttattctaacatattttcttctattttgcagagatatttatgaataaataaaataatttttgggaaaacagtatgatagtgattacatttattttttactgacaaaaatgaaaaactactgacagacttgtcagtagtttttttcatctaattctttggccaaagcaaaattgcctactgtcgctgaaccattattagcaactgacggagtcataatataatctgtcagtaaatagggaacatggacgtaaccggccattagttttgtgaattctttgcgcacccgctcaatcatgtgcgtttgagtcatgacaccacccccaaaaacaattttctcaggtgcaagtgctaaggttgtattaacagcgatttgggcaatgtagaaagcttgaatctcccaaactttgctgtcagttggaatatcttctccacgaatacctaaacgggcttcaagtgatggcccagctgccactccttctagacaatcgccatgaaatggacaaactcctgtaaaatcgaggtcatctggatgacgtttcacatactgattacccatttctgcatgagaaaatccaccaataaatttcccatcttgcacggctcctccgccaattcctgttccgattgtgaaatatactaatgattttccaccagtcacaatcatttcaccataagttgaactattaacgtcagtagtgaaaaccatgggaatatcaagttcgcccttaagttttcctaagaggtcaacattggcccaaccagcttttggcgtggttgttatataaccataggtcgggctttcgggtttgatatcaatcggtccaaaagaaccaactgacaaagaactgacagtattttctttgaaaaattcaattgttttagaaattgtttcttcaggtgtcgttgttggaatttggtttgtttttaaaatgttaaaatgctcatcgccaatcgcaagaacaaattttgttccgcctgcttcaattgagccataatgttttgtcataatattttcctatattttggttactttttagcttttattaattcctcctttataatataataataaataactttcaaaaaaactttttgaacataattaaggtctgtcagtactgacagaattgaaacctcatcatttatttactttcgatgagtttaaatgaactccatggttttaggaaatcaagcaggaataattcatcatcagcaatgcgcccgaccacattcacccggccatcattttccatttcacgcaaagcaatctgagtttcacctttatattgaccatagccttcgttgtcgataatgatatcaccacgttggattttatcagtatcatgagctgggaagtcaaggtctttataagtgattcttgtcattgttgagcggagcatataagctgatttatcaccacgatagctatgtgtcgcttcaaaaagacattttcgttcattctcagtaattgtttcacgtggaacgactttgacttctggcatgcttgcattaaatgcttgactcatcgctttaagttcttcttcgctcgcataagcattagcaatggtaatatcatcaattccaccaagaagcttataatgcttcacttgagttgcgatttcaagtgctctgtggtcttcaagagtacaaaggccatcttgagttggccaaggaccaaaagtagcagcgtgtgaattgacaaaggccatggtgtttaagttataacctttgaatttttctgtacatttaagataatggttaaattccaatcctgtataacgatgaggatagaagttatggctacctaagagtttttctgtatctggagaatagtccattatcgaatcaacataagtcgttccttgactcatattgatttcaattttaattccgtaaggattgcgagtcattcgggcttcttcggctcctgtgaagccaatgtcaagtcgaacaccgtctgctcccattttatggaaaaagctcaggtcatcatagctgatattaagctgtgtaaagagacctggattgatatccaccatcacttccattcctaattgattggcataatttacaacttttttaaaagctgcaagtactccttctttatccccatcaatttcaagcaaggaagtaaacacacgtttgaatccgtattgatgcgccaaatcaagatatgttttatccgcctcaaagtttgaacgttctggatagatagatactcctaattttcccatttatttctctcctttttctaatttttatacttcatttttgatttctgaaatatagcttaactctatgataaggctttcaaaagatttttgcaagcgttatccctctaaaaaaacatgtttctcaaattgaaacaataacgacaaattcttatttttagataggtttagcgctttctttaaattaaatctttaaaataagcaaaagtgagctataccaattttcttagtaatattagtgtaataaatatattatctcttccacactcttctaatttttttaccgcggttcattatgccctttttatttttgcacaaaaaaagttactgacaaagctgtcagtaactttttaaaagtattcacgaagtatggcttgattttcttttaaaattttagtcgtaaattgaccaattgtcattttttctgcttttccttcgccaattgtcatattattttcagcaataatatcatcagtaatttggactgaaaaattcggctgaccatttacttttaaaaattcttttagattaacgatgcgagcttgcatataaggcacaagtttaatttctgctcgctgaggttcaatcatttcttcttctagtagtgtatccgcaggagcctgccaagcgatttctgaaaaagaacctgcatgacttgaaatgaagcgataaagggcttgtttggcctcatcagttaatgtaataagctctctaatcacaaatgtcatttctgaaaattcatagagtaaatatccaagagccttgccattttcacggtagattgctacatgaggttgtgatttatggatgaaaaaatatgaccaaagttcctctgaacgaacaagcgagccttggttgtaagccttctgatgaatgtctgtcagcactttaaaaatctcactacttttactgacagttttttcgtttgacatttcagcttcaaattcaaacttttcacggctaatttctccctttgttctttgaccttttggaaaattctgagcagggattttataatgcttttgattgaaagcatagtggtaaccaaatttttcgtaaaagccatacgaaaatggtgccaaatatgaaaaaattgtcccctcttcataatcttctcgcaggctctcggtcatcaactggcgaatagctccatttcctcgatactcaggatagcttgcaacataaccaataccagaaattttcacatttttatctccccaatagcccctgaaatgtgaatcaatcagcattgaagttaatttctcattttcataatgaccatatgcttttgaaaattccagaagtttatcaaaagctcttgcacgttctaatgtttttggcttatgaaaggcatatgttgctaaatttaaatattcttttttatcctttgtattcgtattcataaattcattttaacacaaaactgtagaaataagaaaacatttttgttagcgtttactttctaaaattattctcgaaaaataaaaataacagcctacaaaaggctgctatttcaaatggtaatttcgatttcattttcttcggggtctaagattacggcttcataatacccatctcccgtggttcttggcccagatttgacttcaaaaccatctgccaaaaatcgctgacagagttcatccactttttctttggaaccaacagaaatagctaaatgagcataacctgtccaaacagatttgtcagcacttttcaagttctctttagtcccaatttcaagtcgcgctccatcagaaaaagttaaaaagtaagattgaaaagtcgttttaggattatgatatttttgacccgcctgtccttcaaaataatgctcataaaagtgacgcattcctcccaaatcttgaaccattaggccaacatgttcaattttcatcacatttctctcttctttgattagtgcgctctacctccgttgtaggcacgattaacattatccaatatggcaaccatttgacgtttcttgaaacgaccaagaaaaaaaccaacggctttgtcattgaccatttgaataaaaccatttgagctttgattttcttcaataatgacctgagtgctgcggtcatcaattttatgcaattcccagcgtgtgctaaaggtattacgatttgttttagtcgtgaaagcataaatgcttggttctgtcagctcggtaattttaatggttcctctttgatttttaccaaagcttttattatattcatagccattaagacttctgactttaggccgttttcctgtatttttttcgatatcaaataaacacgaatcaactattttttcaaagataaattctcttggggcatcaactattttatcaattctcatctttttctcccttatcaagtttttttaactaagtttattctagcaagattaaagattctttgcaagcactttcatgttttcaatagcaaaacaaatttctatttaaaaaatggtaagccaataaaaagaaagaacaaaatgataaaggcgccaattgcaaatactcgatattgttttggaatggagggtacaaaagcctttggaggaagaatggctgacaacaaaattcctccaattgctcccccgatatgcgcccaaatacttacatttcctaaagaaaagaggttcatcactaagttggcaacaattaatactgtaaacattctaccgatttgttgtaaaaatggatgttttgtaaaataggctaatccaacaactgccgcgaacagtccaaatagagaagtcgaagcacctgcagaaaccacttgaggcgtcaatagaaataccatcgcatttccaaaaatacctgacaaaaggtaaatcagcgtaaaacgtagccaaccaaaaacattttcaatttgtcgcccaatgaaaaagagcgttgccacatttaataatacatgcgcccaaccaatatggataaagttcgccgtaagtaaacgccacatttggcttgggtcaaagaccattacttgaccgagtatggctccgcttttaaaaagattaaatgctgaggtcgctgatgttccataagtgaaaaattgccataaccatactaaaagagtgattattgataaaacataagtggctttgtaacgtgtaaaatctcgtttaatttcattaaaattcattattttttctccctataaaaagtttttttactgcaatatcatgtgcttcagcagcgaaatccattttttgaaaatcataaagaactgaagcagtcatgccttcaaaattagctagataacggtcataatagccgccaccaaatccaattcgatgaccttcatcattccaaattaaaccgggaactaagataaaatctggttcaattgctaaatctgattttggctcgagtaagccaaattttgagcgaacaagattttccttgtcatatttagcaaagatcatttgacgctgaggtagacatttgggaatcaaaatttctttgtcgtcagattggtcaaaaagttctgtcaaattaaattcaattggcattgacatataaagcgctattttttttgcagatttccaatctgaggaagcggttaactgctctaaaacttccttgttctgacgccctttctcgtagtctgaaaatttttttaacatttgtaatatttttttgcgattttctactttactttccatattaactatgataacatgaaagtgtaagtttttgttttacgattagttctgtgcttttgggttcattcctattcaagaaattagatttacaaatttataaaataaggaagtaccaaaaatggcacaaggaactgttaaatggtttaacgcaactaaaggcttcggctttatcactactgaagaaggaaacgacgttttcgcacacttctcagctatccaaactgatggattcaaaacacttgacgaaggtcaaaaagttacttttgacgttgaagaaggccctcgtggacctcaagctgttaacatccaaaaataattaaagctttgagagtcactgacaaatttgtcagtgacttttttttgcgccattttttttactgacaaactttttatatgaaagccttaacaaaaaaatgctttttttaaagaaatagccttgtaaaaacaagtaaaatgggctaaaataaaggaatcaatttagtttatttagggaaaaaatgaaagatctaacaaaaggaaatatcttaacaggactcattgcgttcactttacctttactcatgggtaacttttttcaagtcctctataacacggcagatacactcattgtcggacagacattaggaaaagatgcgctagcttctgttggggcgactggctccatcaactttttaattgtcggttttgctcaaggaatgacagcgggcctaaccattttaacggctcagcgttttggggcgaaagataaattggccatcaaaaaatcatatgtgaccggtctttattttaccgttgccgtttctatcatacttagcattttatcacttatatttgttggacctcttttgcaagctatgcaaacgccaagccaaatttttgagggtgccaaaactttcctaagcatcatgttgggtgggatgattgccactaatctctatgcttacctctctaatgctcttcgggctttaggcgattcaaaaacacctttatatgccttaattgctgcctcaattttaaatattgcttttgaatattttgcgatattagttttgaaattaggaatcgcaggagcaagtggagcgacaatcttagcccaaatgatttctgttttattccttttttggcacattagaagaaaagttcctgaatttcaaatcagtaaaaatttatggcggttggaccgggcagaaattgctcaccatgctagactcggaattccaatgggatttcaatcaagcatcattgcaattggctctatcacgctacaagttgccttaaataaaatgggaaccagtgcggtggctacacaagcaattgtttcaaaaattgaccaatttgctatgcttccgatgatttcaatcgggcttgccatggctactttcggcgcacaaaactatggagccaaacaatacaaacgaattaatcagggcttgatgcgcgcccttgccattgcggttggttggtccattgtctttgcaattatcttgaatctggcgcatttctatttcacaacggcctttatctcaagtagccaaacggctgttatcgagatgtccagtcattattatctggtcaatggtagtttttattggctcttagcaattttatttgtcacacgctcaaccattcaaggtcttggaaatgcgaaaatcccaacactttgtggctttgctgagctatttatgcgggccggtgtcgcaattatcggggtacttttgctgaactatacggtaatcatttcaagtaatcctgccgcttggcttggctcgacatccattttaattccaaccaccattcgtatgattaaacgttttagacaaaaccaagatttagcataaaaccgtctctaagacggttttttattttactgacagttttttagcaaataagccatcagtaatttttactgatagaattttggcaaaataaactgatcagcattttcaaattctttagctacttttagtaattcaatttcagaatttttaggtccccagagttgaatccccaatggaagatttgtttctttattgacataaatcggtagtgaaagagctggttgtcccgtcaaattactgatgaaattatagggtgtaaaggccaatgaacgctcaaaagccgcctcaataattgctatttgttgttcaaaatcatattgactgatttctgacattttggtcaatatttcctctgtcattaattcttcaccaattttaggcgctgtttttgccgtagttggggtcaaaaataaatcataatcagcataaatcttgtcagcaaaggtttcggctgcctgatcccattgagccaaagcattaatataagtagtgacgggcgcttttcgtccagcttctaaaagggcataagtcaaaagttcaacatcttgacttgtcaattggcgacccgctgatttttcccaaggttcaagcatagccaccgtttccgctgcattcatctgataataagattgaattaaaggacgggcattcaatggaaaatcaatttccacaagttcatgtccctgtccttttaagaattcaacagcttttttgaccgcttttagagcatcatcagaaagttcaattccagaaatcggactttgcaaagaataagcaatttttaattttactgacaaatttttactgacaaaactgtcagtagattcacagacttctaaaagttctttttcatctaacaagcgagcctgataaggcgctgcctcttgcaaagtttgcatttccaaaataaatcttgccgtatctcgcaccgatactgttaatgcccctgaaatagatgcaccttgccaacctcgataagagcccggcccttgtggcattcgtccacgcgtcatctttagaccaatcaaacctgaaaatgagactggaatccgaattgaccctccgccatcagaagctccagcaatcgcaaacatcccagaagccacggctgaagccgcaccaccagatgacccacccgaataataatcagaattccaaacatttcgtgtatcaccgtagagttttgaatccgaaatatttttaaaaccaaactctggcgaattcgtctgcccataaggcgtcaatcctgcccttatcagcgctttaacataattatcatcctcagatgccacattctctgaaaagagctgagagctagctgtatcaggcaatcctttatgcgtttgccccaacattttcaacgcaaatggcagtcctgcaaaaaaaccttgacctgtcaaagctaaatcttcttttgcgaccgctaaatcctctgccacaatcgcattgtagagtggattgagctggtcaattttttgctttgtcatttctaataattctttggcagaaagatttcttgatttcaattgctccgcccaataagttgcatctttaatttcaagcatgattctcctttaaaagttgagttttatatctttgctgacaaactcattctgccaacattttaccatacttatcaagcataataaaaaatatccgttccaaattaggacggatatttatatttattaaaaattatctaattcttgatacaaaagtttttgagcgactgttggattagcttgccctttagttgctttcatcaattgaccaaccaaagctttggctgcattttgtttcccaccgcgataatcggccacagattgttcattcttagcaaagacctcatgaatgattggcaaaagaaggtcaggatcagaaatttggaccaaaccagctttcttgacaaattcttctgcagaaccaccatttttcgctaattcaataaagacttttttagcaatttttgaagaaattgttccatctgaaatcaaacgaatcatctctgtcagattttctggggtcaatccaatctcatgaagttcttttttctcgctattcaaatattgagcgacctcgccttgcaaccagtttgaaaccaatttagggtcagtatcaaatttaatcgcttgatcaaagaaatctgaaacttctttagttgcggtcaattgacgcgcatcatagtcagataagcccaaatcattaatataatgtgcacgtcttgcagttgctgtcattggaaggctctcgcgcatttgttcaatccattcgtcagaaatctcaaaacgaggaacatctggctctgggaagtaacgataatcagacgccccttctttgacacgcatcaaaattgtttcaccggttttgtcattaaaacgacgcgtttcttgacggatttcgccacccgcacgcaaaattttagcttgacgtgccacttcaaagtccaaagcttttttgacattgctaaaagagttcatatttttaacttctgtcttcacaccgaaagcttcttgcccataaggacgaagcgaaacattggcgtcacaacgcattgaaccttcttccatcttcacatcagaaattcctgtgtaaagaatagcttctttgagcgctgtcaaataagcataagcttcttctggagtgcgcatatcagcttctgaaacaatctcaatcaatggcacaccttgacgattcaagtcaacataagagtaaccatctgttccgtgagtatttttcccagcatcttcttccaagtgagcacgctcaatacgaatcgttgctttatgaccatcttcaagttcaatctcgattgaaccattgtaaccaattggctcatcaaattgtgaaatttggtaagctttgggattatcaggatagaaataatttttgcggtcaaagtgcattgatttgtgaatatccatattcaaagcaagagccgctttaatcccgctatcaatcacacctttattcatgactggtaaaacaccaggaagtgaccagtcaatcacatttgtattgctattagggtcgccaccaaattttgtagaggcgggactgaaaatttttgagtttgtacttaactcaacgtggacttcaagcccaattactgtttcaaagttcattattttctccgatactttccatttttattttccaaaaataatcggttgttttttgtggaaatcagtcgttgcttcaaaagcagccgctacttgataaatcgtttcttcatcgtaacgtttaccaatcaattgcattcccacaggtagtccatcggcaaaaccagcaggaatcgaaattcctggaagaccagctaagttgactggaatagtcaataaatctgccaaatacattgagattgggtcatcaacacgtgctcctaaatcccaagctgctgttggagttgttggtcctaaaatcaaatcatatttttcaaaaactttagcaaaatcattgatgattaaagtacgaacttgtcctgcttttttgaaatgtttatcataagaaccggctgacagactgaaagttcccaacataattcgacgttgaacctcaggtccgaatccttcagaacgtgatttcacatacaaatcttcaaggtttttgatgtcttgtgcgcgataaccataacgaattccatcgaaacgttggaggttcgagctagcttcagaagaggcgataatataataaactgcgacaccatatttactatgaggaagactgacttcttcaacgatggcacctagtttttctaaatgtttagctgctgccaaaatttgttctttgactttttcatcaattccttcaccaaaatattctttaggtaaagcaattttcattcctttaatgtcttgaccaattttacttgtaaagtcaggaaccgcaacatttgatgacgtactatcatttttatcaaagccagaaatgacatttaaaagttgagcattttcttcaactgttggtgtcaatggaccgatttggtctaatgatgaagcaaaagcaatcaagccaaaacggctgacacgaccataagttggttttaaaccaacaattccattgaaagcagctggctgacggattgagccaccagtatctgaaccgagtgataaacgaacctcaccagaagcaactgaagctgcggaacctgatgaagagccaccaggtacttttgtttggtcccaggcgtttttggttggcttaatcgaagaattttcaccagacccacccatggcgaattcatccatgttgagtttaccaattgtaattaacccagattggctcaatttattagcaactgttgcattataaggaggaatccaaccaccaagaatcttagaagctgctgttgtttcgataccttctgtaacaatattatctttgacaccaatcgaaattccatcagtcacaacatctggattaattccacgagcatcaattgctgcggcttctttcaaagctttttcttctgtgactttcaaaaaagcgtcaatttgtggttcacgtgcttgaatgtcagaaagcgtcgcctttgtcaattcaagagccgaaatttctttatttacaagaagctcatgtagttctttgattgatttattattgtatgacattaggcatctcctccatcagaaagcattgctggaactttgataaagccgtcttctttttcaggaacagccgccatgagtttttcacgatcaagtcctttttccgccacatcttcacgcataaagttgaggttatctgccacattcatagtaaatggtacaccatcagtatcgacttcatccaacatttcaaccatatcaatgatttttccgaaagtgtcggtgaatgattttacttcattttccgagaattcaagctttgacaaaagtgccacgtgcttgacttgctcctctgtaatttgactcatattttcaatctccattttttagagtgtattcttgttaattataacaaaatatcagcattttcgcagtctgtcagcaattttaaaaggcttcttaacatattttttaatgattgctcttagcttaaaataaaacttactgacagaagcaattaaaacacgagaacctcccatcagcgataggaggttcttgtgaagtcgaaagctaaacgcaatctagctgtccatttatctacctgcaaaaacaaatgataaaagaacaagcgttaagctctgacttttagaaattacgtccagcaagtttatcaaacaaaccagtattaagaactttaagataagttcctttcataccaagtgaacgtgattcaataataccagcagattccagtttacgtaaagcattaacaatcactgaacgtgtaataccaatcttgtcagcaatgacagaggcaataacatgcccttcttcaccatcaagttcttcaataattgctttgacagctttcatttctgagtaagaaagtgtattaacagccattgttgccatagtgtctttacggatattttcttccatttgttcaagtttaaggtttgagagttgtacaccgattactgttgttgcaagctcaaccaaaacaagatcgtcatctgtaaattcaccatcttcgcgccacataataaatgttccaagacgcattccagaaccatagataggcgctaaagttgttacaccttttggaaaatcgctaagactttcttctgggaaaattgctaaaggacgatcaacaggaacgtttgccattgtatcgtaaatacgtactgctgcacgaacgtattcgtcaggcaatttacgatcgtagaaaaattggtcaacgcgatcattgtttgtattgtaaggcaatgagtaaccaagcaactcgcccttcgtattaatcacgcaggcgttgcaatcaatgacgtttgccaagcgttcagtcatactgttgtatggcaactcttgttgcaaatcggtcactccatcttgcaaaatcgcggtgattttacgtgttttttcaagtaatgtagccactttgttctcctatttttttatattcttgtttttatacaaaatttttcataatcagtataacataaaaaagcatgaaaaacaataaaaattgtcagaaaattactctcaacaaaaaaagatgtacgaattatttgtagtgacccccaaaagatagacttttcaaaaatatgaaaggtcttttattatgaaatgacttggaaagaagatataatagtagctattgttttatttctattatcatttttaattggttggttgcaatcttcgaaagttgaatttaaagatgaaggaaaaaaagataagtatgaacgtccaattatcttaatgaaaaagaattggacttatattattggctggattattttatttttagtaattattggtgcacatttctacgccaattcgcatttagagttggaagagattgtaacagaattttggaaagaaatggtcaaagaaattttaatatttgctagattcaatgctaagaatggttgggaaacgtggctaataacaggaatttccagtttaacttttacttgttttataaaaagtaaaaacaaaaaattagtcgaaactttagccagaagaagacaaaatagttcttttaataagtagattttttgtgattaacaaaagttatcaacaaatggtattgaaagctcacttgaaaatagatagaattatcttatccaatatctcttagatttatcaattttccaagattttgatataaaggatataataaccgataaatgatctctgttataagaggtcattttttaattgaaaatatgatataataatggtcagaaatagagagatgtaaggataataatgatggaaaatagtttaaatatcattgagaaaatgaatcctaatcaaaaaataaattatgatcgtgtttttcaaagagttcgtgaaagttgggaacgagaatcagttcgcccccaaattttacttcactcttgttgcgccccttgtagtacttattctttagaatatctcactcaatcggctgatgttacaatttattttgccaattcaaacattcatccttcaacggaatatacaagaagaaagatggtacaagaacagtttgtaacagattttaatgagcgaacaggaaataacgttcaattcatcgcggctgaatatgaaccaaatgtctttttacaaatggtgcgtcaaaaacatttagaaaatgaacccgagggtgggaaacgttgtagctcttgctttgaaatgcgtttggatattgttgctgaaaaagctttggaacttggttttgattattttggtagtgctttaacgctatcgcccaaaaaagacagtcaattgattaatgaaattgggcttgatattcaaaaaatttatgatgtgaattatcttccgagtgattttaagaagaataatggctataagcgttccattgagatgtgtaaagaatacgatgtttatcgtcaatgttactgtggttgtatctttgcggccaaagcccaaggaattgatttaaaagaacaaaatcgagaagcgattaaatttattagaagtcagtcttgagcagaaaaattgtagttaaaaaataagaaaactgcttgacaaaatagtccttttttaataaaatgagggtaacttaaatattccaaaggggagtagcgtcggtaagaccgaaacaaagtcgtcaattcgtgagattctcaccggctttgttgacatactatgtatgtttagcaagacctttgccagttttgatatctggcagaggtcttttttgtaagacctctcatgatatcagttagaaataaaggagaatcattatgcagcgttacaatcagtccgtcaatgaagttttggaggagactaaaagtcaacttgaaggtttgaaacccaaagaagttgaacttcgtcaagccgagaatggtttcaacgaattaaaagagaagaaaaaaacttcaacttgggaactttttattgatacattgaaagacccgatggtgattattttacttttagtcgcttttgtccaacttttcttaggcgaattcgttgaatcattggttatcttcattgttttgatgattaattcagtggtggctgttgttcaaacgaaaagggcagagagttctttagatgctttgagacagatgtcggtaccatcagccaaagttttacgtaatggggaaaaaacatcaattcctgcgcgtgagcttgtcgttggagatattgtttcattggaagctggtgatttcattccagcggatggccgtttaattgacgttcaaaacttacgcgttgaagaaggaatgctgacaggtgagtctgagccagttgaaaaattttcagatcttattgagggagaagcagcacttggtgaccgtaagaatatggtcttcagttcaagtcttgttgtttatggacgagcagattttgtcgtgacagccattgctgagcaaacggaaattggtaagattgctcaaatgttggaaactgctgaggccaaacaaacacctctccaacaaaaactggaaaagtttgggaaacaattgggctgggcaattttggcgctttgtgctttgatttttgccgtgcaaattcttcgcctctttacgacaaatcaaacggctgatatgcaaaaagctattcttgattcgttcatgtttgcagttgcagttgcggtagcagcaattcctgaagctctttcatcagttgttacgattgttctgtcagttggaacaaataaaatggcgaaacaacatgcgattatgcgtaatttgcctgccgtagaaactttaggttcaacttcaatcatttgtactgacaaaacgggaactttgactcaaaacaaaatgacagttgttgattcttacttaccaaccgaaagtagcaaagaactgacagacttgtcacaagtagaccaaaagctcttacttaatgcaatggtactctgtaatgattcatcattttcacaagaaggacaagcattgggtgaccctaccgaagtggctttgattgcttatagtgataaaattggtcatccctatcaagaattaagagaaaaatcaccgcgtttggctgagtttccctttgactcagaacgtaaattaatgagtacaatcaatgattttgaaggtcagaaaacgatttttgttaaaggtggcccagatgtactttttaatcgctgcaaccaagttttcttagatggaaaagtacaagagtttactccagaattaaaagaaaaattccaagctcaaaatgaagcatttagtcaaaaagcacttcgtgtcttggcttacgcttacaaacctgccagtgatgataagaaagagctcacacttactgacgaaaatgatttgattcttattggtttgtcagcaatgattgacccacctcgtgaagctgtttatgattcaattgccgaagccaaaaaagccggcattaaaacaattatgattacgggtgaccataaaacgacggcgcaagccattgctaaagatattggtttgatgaatgaaggggacatggctcttacgggtcaagaactggatgcgctgactgaagatgaacttcgtgacaatttgcaaaagatttctgtttatgcgcgtgtttcgcctgaaaataaaatccgaattgtccgcgcttggcaaaatgaacatcaagtgactgccatgacaggtgatggggtcaatgatgctccagcccttaaacaagctaatattgggattgccatgggttcaggaacggatgtagcaaaagatgcgtcaagtatgattttgactgatgataatttcgtatcaattgtttctgctgtatcaattggtcgtgtggtttatgataatatcaaaaaatcaattagttatcttttctctggaaacttaggagcgattattgcgattgtttttgctttaattgtgggttgggttaatccatttactgctttgcaactattgtttattaacctagtcaatgactctgttccagccattgccttaggaatggaaaaagcagaaccagatgttatggaaaaagctcctcgccaattaaatgaaggaatctttgccaatggtttgatgaggattattttgattcgtggttcattgattgggattgcggctattatctctcaatatgttggacaaaaaacttcacctgaaatgggtgtggctatggcctttacaactttgattttggctcggactttgcaaacttttgctgcacgttcaaattcacaaaatattttcaaacttggttttacaacgaataaatatgttttgatggctgtaactttctgtcttgctttgtacagtttgaccacactaccattccttagagaaatcttttcaattccagcaagttttggttggtctgaatgggctgtagctgcgggtcttgccgtaatcgctgtgatttgtatggaaattcttaaatcaattaaaggcatctttgaaaaataattaaattttagaaaaaatcactgacaaatctgtcagtgatttttaaatggttgaacttttatcatattgattcaaatgataagtttcaatcatattgataagtttatcagcatatgtggggtcagtcgcatagccagagctttggaccgccttagcagcagttttgtagtctgttgcgctaagaacagaagcgtattgtttagcgttccaagttgtgctatagaggaaaagttgtgtatgagccgaaacggaatcagcaaagttaggataaacgcgaaaaacaccttggatggtaatccattgaccgttctcgtactcttgagtctcaagtgagactttaggaacatcgcctgaggctttcacaccaaatagattatgatatttactagcgagttcacttttaccaaagttagattcaaggcaggcttgagcaatggtaatagaagctagaacttgactttctttttgtgattttgagccaagggggcaatttctttgatgaatttatgttcacggatttcttcaagttgggcttcggagggcttttctacttgattattaaaatttctattataagcaaatattcctaaaatgattaggaaaataaaaatgagctgttttaacaaagattgacgtcgatttggttttcttcgtcgagttttatatttcataaaaatagtttaacataaaaatcaagttcttggcttaaaaatcaatatttgatatactaaaactagttaagaaaagtagatgatgagttttggaattcttgtcagtaaaatagttactgacagcaatcaatttttatgctgagccatctgtcagtaaaactaaatctataaattatttctgatggaataacttatataagcaaaatttaccaggaggtaaacaaataatgaatttttatgattttagtgccgttaaaatgaacggtgaaactgtttcaatgtctgactacaaaggaaaagtcgtaatcgtagtcaatacagccagtaaatgtggttttactccacaatttgagggacttgaaaaattgtatgaaacatataaggaccaaggattagagattctaggatttccttgtaatcagtttgctaatcaagatgctggtgaaaatacggaaattaatgaattctgtcagttgaattatggcgttacattcaccatgtttcaaaaaattaaagtaaatggaaaagaagctcatccactttatcaatttttgaaaaaggaagccaaaggggcgcttagtggaactattaaatggaatttcacaaagtttttaattgaccaagatggacaagtcattgaacgatttgcgcccaaaacagagcctgaagaaatggaagaagaaatcaaaaaattactttaaaagtcataaatgctctgagacttgtaaaaggtcaattattttgctaaactaataaacaataaaacttttaatctagtccagagaggctagcaaggttgtgaacaggaaatattatccttaaaagttactgacaaaagagcggtgtagcttggtccataagtaccaaagcggacagggctagttctgtcagtaaactgtcagggcatattaggacacatctgctaggtttctggcagatgtttttgctttatttttaactttttatgattgaaaataaagggcgcaaggagcgaagcggcttgtaagtaattacaacgaagttatgctttactacaaaggagaaaaacaaatgccaaaacgtaatgatatcaaaaaaatcatgattatcggttcaggtccaatcattatcggtcaagccgctgaatttgattacgctggaacgcaagcctgtcttgctcttaaagaagaaggctatgaagtagttttggtcaattcaaatccagcaacaattatgactgaccgagaaattgctgacacggtctatattgaacctataactttagagtttgtcagtaaaattttacgtaaagaacgtcctgacgcactcttaccaacacttggcgggcaaacaggactcaacatggcaatggaattatcaaaaacaggaattcttgaggagcttaatgttgaacttttaggaacaaaattaagtgccattgaccaagcagaagaccgtgaacttttcaaagagctctgtgaatcaatcaatgagcctctttgtgccagcgatattgcaaccacagttgaagaagcaattaacattgctgacaaaattggctatccaatcattgttcgcccagcatttactatgggaggaacaggaggcggaatttgtgacacagaagaagaactccgtgaaattgtagcaaatggtttgaaactttcacctgtgacacaatgtttgattgaagaatcaatcgcaggttataaagaaatcgaatatgaagttatgcgtgattctgctgacaatgctatcgttgtctgcaacatggaaaactttgatccagtaggtgtccacacgggcgattctatcgtttttgccccaagtcaaaccctgtctgacaatgaatatcaaatgctccgtgatgcttcgctcaatatcattcatgctcttaaaattgaaggtggctgtaatgttcaattggcccttgatccgaacagctatgaataccgcgtcattgaagtcaatccacgggtcagccgttcatcagctttggcttcaaaagcaactggctatccgattgccaaaatgtcagctaaaattgcaatcggaatgactctggacgaaatcatcaatccagtaaccaacaaaacttatgccatgtttgaaccagcccttgactatgttgtggcaaaaatcgcccgtttcccatttgataagtttgaaaatggtgaccgccatttaggaacacaaatgaaggcaacaggtgaagttatggcaattggacgcaacatcgaagaaagtcttctaaaagctgttcgttcgcttgaaattggtgttttccataatgaaatgactgaagcgattgaagctgatgacgaaaaactctatgaaaaaatggttaaaacacaagatgaccgacttttctatgtatcagaagcgattcgtcgcggaattccaatcgaagaaattgctgatttgacaaaaatcgatattttcttccttgataagctccttcatatcgttgaaattgaaaatcaattaaaggtaaatatttttgagccagaacttctaaaaacagccaagaaaaatggattttctgacagagaaattgccaagttatggaatgtgacgccagaagaagttagacgtcgtagacaagaaaacaagattattcctgtttataaaatggtcgatacttgtgcagccgagtttgaaagttcaaccccttatttctattcaacttatgaatgggaaaatgaatctaaacgctcagataaagaaaaaataatcgttctagggtcaggtcctatccgtatcggacaaggggttgagttcgactacgcaacggtacattgtgtgaaagctatccaagcattgggtaaagaagccattgtcatcaattcgaatcccgaaacagtttcaacagacttctctatttctgataaactctactttgagccattgacttttgaagatgttatgaatgtcattgaccttgaagaaccgctaggtgtcattgttcagtttggtggacaaacggccatcaatttggcagagccattatcaaaagcaggagtcaaaatcttaggaactcaagtcgaagatttagaccgagctgaagaccgtgatttatttgagaaagcactgcaagatttagatattccacaaccaccaggggcgacagcaacaaatgaagaagaagcggtcgctaatgccaacaaaattggttatccagtccttattcgtccctcatttgttttgggtggtcgggccatggaaattattaataatgaaaaagatttgcgtgattatatgaatcgtgcggttaaagcttcaccagaacatccagttttagttgacagctatttgcaaggtcaagaatgtgaagttgatgccatctgtgatggaaaagaagttcttcttccaggaattatggaacatattgagcgtgctggagtccactcgggcgattcgatggcagtttacccaccacaaaatctctctcaagctatcattgatacaatcgttgattataccaaacgccttgcgattggattaaattgcataggaatgatgaatattcagttcgttatctatgaagaacaagtatatgtgattgaagttaatcctcgcgcttcacgtactgttccctttttatcaaaagttaccaatatcccaatggcacaattggcaacccaaatgattttaggtgaaaacttgaaagacttaggttatgaagcaggacttgcccctacacctgatatggttcacgttaaagcacccgtctttagtttcacaaaattggcaaaagtagatagcctacttggtccagaaatgaaatcaaccggtgaagcaatgggttcagatgtgacacttgaaaaagcgctctataaatcatttgaagcagcaaaacttcatatggctgattatggttcagttttgttcacagtcgctgatgaggataaagaagaaaccttagcgtttgctaaagattttgccgaaattggttattcattagttgctaccgcaggaacagcagcctttcttaaagaaaacggactttatgtgcgcgaagtggaaaaacttgctggtggagaagatgaggaaggaacgcttgttgaagatattcgtcagggacgagttcaagccgttgtcaataccatgggtaatacgcgagcttcattaacaacagccactgatggtttccgcattcgacaagaagcaatcagccgaggaattcctctctttacttcgctagatacagttgcagcaattcttaaggtgatgcaaagtcgtagttttacaacaaaaaatatataaaaaaataaacagtcccaaatggggcttttttttatttttgaataaaagttaataagtatttgaagggagtgtattattattcgtacaaaggaggcgtaagaaagcgttttattagacttaagttaggaaataggttataaatgatatatagactacagagtaatttataaacgacaacatattgaaagagggtaggtgaatgactgacataaataaagcaaaaatattcatatttagtttaatttttattagtatcccctttctaatttttgttgagaaccctgtgtcatcagatacagcaattgacagccaaaattctacagcaaatggctatataaatgttaccgctccaacaacaaatatttggagtttgactgctccaaactttaattttgggacccaaacatcaagtgcatcagtaattaatagcaatgcaacaggagatggaccaattagaattgttaatttgtctggaagctcaacaagtttttctcttcaacaatcgatttctgactttaccttagtttctagctctatcgttttgccaaccacagctttctatatttcggtagcaaacagtactgatgaaaaacttatcggaagctctaatattaatatttttaaacaaaatggtgttgttctaagaagtgggacaggagctaatggagcattaactagtggtgctgtgacggcgcaacttacagtagatggaacaaataaagtaattgtcacaggttcataccaagcaacgattatctcgacactcgtgacaggtccatagaagggggaaacagtgaaataaaaaaaagaaattatttttctcataagtttaggatttctaattattctatttggtttgactcccaaaactaaggctgctgttcttacaggaacaattgatagcacaggtgcagtaactggagtaactggagcaacttactataatacgaatagctggcaagatatgattgatacctataagtcagtcactcccaatacggcatcaaaagctacagtattcttcaatgtgacagcaaatgttccgggaaatagtgttttgaactctgggaatgccgtttctagtggtaaatctttatcaatcaacggaaataattatactctttatcttgataatgatactacttatacgacagctcaaagtatcggtgggagtgatgggacagcgagagcattcgggtctaacggaacagtttcagcggatactacactgacagttaagaatgcaacaattgtcaacaatattacgagtgggatttttcaaatgaaagggaacaatgccaaggcgaccgctgtttatgaaaatgtgactgtaagcaatggggacggaatatatggggcacaaccaattagaaatgataatggaaaagttgtttttcgagggacgaacaccttcaatattctgcaaaaccataatatgaatgacatcagttcagctggtgcagataatcaaggggagtggattcaagtggcagcctatacggaagtagaaactggaacaactaccttgaatgagagttggggcaacgatcaacctttctatgtctattactcaaatagtgggtcgacattgcaagtcgatgctggagcagcaatggtttggaatttaaataagacatatacgatgtattatgatgatggtgctcttttagtagttggagccttgaactggaatatcaatgggagctttgtcattaacggaacggttaatacttcatctacctatgctggaggttggtttatggccttaaatacactaaatagttggaacttaaatgttgggcaaaatgcaacttttaaggcgacgacaggtggagtcattagtttggatgcatttttgactggggcagtaaaatggaattttgcgcagggttcaagtgttctatttaataacttaaatccaaaccaaaatgtggtttcacttgctccaggattaggaagtggaataacaatgacagaccctaaagttgtaagttttaatacggcaggtggttccgttttttctacaaccgtcttaacttttcccgttactatatcaggaagtggattgcgaacccattcatcatcaacaggttatacttttgattcaacttatgatttgataacacccaataaaggaacaattactcctacgagttcagatatttggtatcggatgaatacaggaactctaacaacttttaaccctactttacaggtgataaatttaagtcctaataattatggaagtgatgcgccaaacattgcagcgggtaaatatatttcatggtatcaacctttaggatttcaattaaatgctgcagtatctaatatgaatcggatatttaatatttctttagatccatcagcaacaaaaggaactcccatagacggttcttggtcttcactaataaatgggacgagtgctgaaagtctagttgttggagatgaccgagcacagaaccctaatatacatattcttgtcaaaatgacacaaaataattttccgaatggtctacagtattattgggttgacccaacgactaaagcgcagacacaattaaatcttaattcgtctttgcagattgcaagtataaccattgatagcaaattaccttcttggattaaaatgacaggggctggtatgtggtacacaatgacttttcctacggatactggattaaatattaaggccaataatagcttactcagtcaaacaaattcaaatgcgggaactttccaatataccgttgctaatggaccgtcttaaaaaggaggaaaattaataaaattaataaaatacttttcctatctctaataagtttatttttagttagtctatttgaaactgttcatgtagaaagttcaacaggtgattttagtatagaagcggtacttgaaggacaccaaaaagatgaaaacatttcttattggtggttgaaagtaaaaaaaggtgagtcaatcaaactaaatttaataatcaacaatggaaatgaagagaataattttgaaatagcagcaaatcaggcggttaataacaataattttacgctagattatagtttatctgatgagaaagtaaagcaatacctagtagagaaagaaccaactttcaacttttataaagatatcttttttgaaaaagaagcaaaagcaggtcccttaaaactcattctagctcctaatgaagttagagagattgcgattgcttttaaagttccgaaagcaggcatcagagggcaggctattggaggaattaatgtaaccaaaatacccaaagaatctgatcgtcaacaagggattttaaatgtttatagtaacgttgtcgctcttcttatggaggatataaattactccaataaaaaagaaaaaaatttagaatttgacttgggaaaatcaaatgaaactgagcaaataatagaagttaaaaaccctaattcatcacttctaagacaggtaagcctagaagcaagaatcacagataacaacggaaaaattatttccgaatttcaaagctcgcagacagcagttgttccaaatgcttcagttagtcttaaactattttccactatgttcaatgatattatgtttatcctccttatatataatctttttaaatagtattttcagaataacataataacctgtaacaaggtaggtaattaagatgccaataaaagctcgttattagtgcagtttttgaaacaatataaaatgactacctaataactgtgatacttatttgagtaaaatattttgaagggaaatttactgatgaaagtggttaagaaaagttactttaattcatatttattagtacttattgcaccatgttgagtaactatgatacaatagataaatatactacttcaaggagaagattatgacaactattgattttaaagctgaagttgaaaagcgtaaggacgctttgatggaagatttgtttagccttttgcgcattgattctgcaatggatatggaacatgcagatgctgaaaatccatttggccctggtccaagaaaagctttggatgctttcttgaaaattgccgaacgtgatggttatacaactaaaaattatgataactatgttggacattttgaatatgaaaacggagcaaatgctgatgccgaagttctcggaattattggtcacttagatgttgttcctgctggttccggttgggattcaaatccatttgagccagaaatccgtaatgggaatctctatgctcgtggtgcttctgatgataaaggaccaacagttgcatgttactatgcactcaaaattttgaaagaacttaatcttccattatctaaaaaaatccgtttcatcgttggtacaaacgaagaaacaggttgggcagatatggattactactttgagcactgtgaattgccgttgcctgattttggtttctcacctgatgctgagttcccaattatcaatggtgaaaaagggaatatcacagaatatctccatttctcaggtaaaaatgctggtcaagttgttcttcacagctttaaagcaggtcttgcagaaaatatggttccagaatcagcaactgcagtgatttcaggtgctaaagatttagaagctgcacttgaaaaatttgtagctgaacatgcaagcaaaaatcttcgttttgaccttgaagaggctgatggaaaagcaacaattacgctttatggtaaatcagcgcatggtgcgatgccagaaaaagggattaatggagcaacttatcttactttgttcttgaatcaatttgactttgctgacggtgctgctgccttcattaaagttggggctgaaaaacttcttgaagatcatgaaggtgaaaaattaggtacagcttttgttgatgaattgatgggaaatacctcaatgaatgctggtgtttggtcatttgatgaaaatggtgaaggtaaaatcgccctcaatttccgtttcccacaagggaacagcccagagcgtatgcaagaaattcttgctaaacttgatggggttgttgaagttgaactttcaaaacacctccacacacctcactatgttccaatgtcagacccacttgtatcaacattgattgatgtttatgaaaaacacactggtcttaaaggatatgaaacaatcattggtggtggaactttcggtcgtctgttggaacgtggtgttgcttatggagcaatgtttgaaggagaaccagattcaatgcaccaagcgaatgaaatgaaacctgttgaaaatatctacaaagcggcagtgatttatgctgaagcaatttatgaacttgcaaaataagttataaaaatttagagattctctcttttaagaaaatttataactaaaaaaaatttgttttcaaaaggtgaaaaatctggcagtctttgccagattttagcctttattctagaaatagaggtgaaaggatggtttttgggacaggtgttgataatgttgaactttctcgaattcaaaaagcattaacacgctcagagcgttttgtggaacaagttcttacaacaatggagctagaaaagtacaataattttcaatccactgctcgtaaaacagaatttctcgctggacgctgggcggcaaaggaggctttttctaaggcttatggtaccggatttggtaaagctttaggaatgcatgatcttgaaataaaaaatgatgaattgggaaaaccttatttttcaaaacatccttttgagggtcaagttcatttatctatttcgcatagtaatttagaagcagttgcttttgttgttttagaaaaaaaattaagaagtaataaaaattttacttaaactagagaaaggtttaaaagatgaaaacttcaccacatcgtaatacttcagctattgttgatttaaaagcgattagaaataatattgaaaaatttaaaaagcatattaaccctaatgcagagatttggccagcagtgaaagcagatgcttatggtcatggctcggttgaggtttctaaagcggtgagcgatttggtaggtggtttttgtgtatcaaacctagatgaggcaattgaattacgaaatcatctggtgactaaaccgattttagttttatccggaattgttccagaagatgttgatattgcagctgcccttaatattagtcttactgccccgagtttagaatggttgaaattggttgttcaagaagaagcagaactttcagatttaaaaattcatattggtgtagattctggtatgggtcggattggtattcgtgatgttgaagaagctaatcagatgattgaacttgctgataaatatgcgattaattttgaaggaattttcactcattttgcgactgcggatatggctgatgaaacaaaatttaaaaatcaacaggcaagatttaacaaaattatggccggattatcacgtcaaccaaaatttatacactcaactaatacggccgctgctttatggcataaggaacaagttcaagctattgaacgtttagggatttcaatgtatggcttgaatccaagtggtaaaactttggaacttccttttgaaattgaacccgctctctctttagtttctgaattgactcatataaaaaaaatagctgcaggtgaaacggttggttatggtgcaacttatgagacgagtgaagaaacttggattggaactgttccaattggttacgctgacgggtggacccgtcaaatgcaaggtttcaaagtgcttgttgatggaaagttttgtgagattgttggtcgagtttgtatggatcaaatgatgataaaacttgataagtcttaccctttgggaacgaaggtcactttgattggtcgagataaggctaatgaaatcacgacaacagacgttgctgattggcgtggaacgattaattatgaagtgctttgcttactttctgatagaatcaaaagaatctataaataaaattaaaaaaactgtatttttacatttttttgttttctgttaaaagcagatgataacctcatttttatctcataaaagcctttacaaattatctttttatggtagaatataattaagagataaatgagaatgtgataagaaatagatgaggtgaacactatgataaaaatctacacggtagcatcttgcagctcttgtaaaaaagcgaaagaatggttggaaaaacatcaacttgcctatcaggaaataaatttagttacaaatcatattggaagagaggatttattagaaatattatccctaacagaaggtgggacagtagatattatttataagaggagtcaagcttacgaacgtttaaatattgattttgaatcaattaaattaaatgatttagttgagctgattgaaatgaatccaacaatcttacgtcgtccattgattattgataataaacggctgcaagtcggctataatgacgatgaaatcagaaaatttttgcctagaaaaatgagaaaaatccaaattgaagcagctacagagcgcttatatcaatttgatttggaagaacaatttcaagaaggataattcagtagtaattactactgaatttttttatattaaaggctaaatagtttgatattttggagaaaaaaagtagaattaatctaaagccttgtaagttattacattaaaagtttaatttgaaaattagaaggagaaagattgtttgattatattattattggagcaggacctgggggacttggcttagcttatcgccttaaaacgaaagataataaaattgcaatgattgaaaatgataagtggggtggaacttgtccaaattatggttgtgacccaactaaaatgatgatggcagtgattgaggctaaaagtcatgttgaacatttaaaaggtcaaggaatttcgggtgatttaaagattgattggaaaggtttgcgaagtcgtaagttaaatattaccgatccttacgaaaaatcgacttttgaagggttaaaaaatgctgatattgaaacgatatatggtagcgcaagttttactgagcaaggagaactgcaagttgcaggagagatttatcaggccaaaacttatattattgcgacaggaagtcgtccacgtcgtctagaacttgatggtgacgaatttctaaaaacaagtaatgattttttagctcttgaagaattacctgctaagattagtttcatggggagtgggccaatatcattagaattagctcaaattgctaaagctgctggaagtgatgtaacgattatttctcgtaagaaaagtaatgttgctcattttgatgaagaaatgggacaagaatttatcaattacctcaaaaatcagggcattaattttattgaaaatatttctgtaagcaaagttgaaaaatttactgacggttttttgttgactgatggagctggttttgaacataaaacggatttagtgattgccggagttggtcgtcagccaaatagcgatcagcttaatttagataaagttggcgttgaaacagaccacaaagggattaaagtaaacgactatctacaaacaagcaatcctaaaatttatgccatgggagatgtcctctctaaagcggagcctcatttaactcctgtttcttcatttgaaggaaattatttgggtcaaaatttgccaaatgctaataaagtaccaatccattatccacagattccgacaattatttttggaacggcaaaattagctgaggtggggattttgacagggactggaattcgcacaaaaagtttgaatttaaaatcttggtatacttataagagaattaatgaccccttagcaaaactaaaagttgccatcaatgaaaatcaagaaattgtcggtgcttcaacagtaagttcagtagctgatgaagtgattaatttaatcagtattttaattcaacaaaaaatgacattggctgatgttgaaaaaatgatttttacttatccaacagtagctagtgacttagaatatttttactgacagtttgcttggctgatgtgtaacattataatagaagaaaccataagtcaaagctgaagaaaattttttactgacagaatatattttcaagtggtcagtaaattttaatgatagaaatgaggacattcatgattgaattccagaatgtgtccaaggctttcgctagtaaaaaaattcttgatcatgctaattttactattaaagaccaagagttttttgtgctagtagggccgagtggaagtggaaaaacgaccactttaaagatgattaatcaattagtcactcacagtgaggggaaaattttaatcaacaatgaagaagtaagtacaacaaatctgaggaaattaagattatctgtgggttatgtcttacaacaaatcgctttatttcccaatctaaccgtttcagagaacattgctttgattcctgaaatgaaaggttgggataaaacaaaaattactgacagaaccaatgaactcctagatttagttggcctggatgctaaagattatgctcaccgccaacccagtgaattatcaggaggggagcaacaaagggtcggaattttgcgggcaattgccgccaatcctaaaattgttttgatggatgagcctttttcagcacttgacccaatttcacgtcgtcagttgcaaatatttattaaagatttacaaaagaaaatgaatttgacgattgtctttgttactcatgatttagatgaagccttatatttggctgaccgtgtggccgttatgaatgatggcttaatccagcaaattgctgagccggctgatatttatcaacatccagcaaatgatttcgttaaaacatttttcaaagaatatcatcagaacttatcaacggtttctgttgaaaatttattactgacagagctgtcagtaaatccagaagcacaagaagttgctgaaaatacaacgatatctgaaataatcaatcgtctatctgaaaaagaagttttgaaatacaggggcaaaagcatcacctcagatgatattatttgttatattgcaggaggtgaaaaatgagccaattaatttcaacttttcaaaatcagcaaggacaattttggcaggcacttttggaacatattcaaatctcactcatttcaatttttattgcgattttgatttcgattcccttagccctcttacttcgacgttttccgaaaattgccgaaccgattttgcaagtcacaggaatttttcaaaccattcctagtttagctcttttgggattattaattccatttatcggaattggaagtttaccagccattgttgcacttgttgtttatgcgatttttccaattgttcaaaatacatatacgggtttagagcaaattgaaccttccttgattgaggccgcaacggcatttgggatgaatcgcagggaacgactgatgaaatttgaactctcattggcaatgccctttatcatggcaggaattcggacgagtacagttatggtcattggtaccgcgacactcgctgccctgattggcgctggaggtttaggaaactttattcttcttggaataaatatgaatgatgtttcattgattttgattggagccatttcgtcagccttgttggcgatcattttcagtagtcttttgaaatttttagagaaggcaaagataagaacaattctcattagttttttcattggtttactcgtgttgggaggttcttactatcgccctcaaacttctgaccatccacaaattacaattgcaggtaaattaggagctgaacctgatgtattgattaacatgtacaagttacttattgagaaggatagtaatattcgtgtcaatttaaaatcaaattttggtgatacgactttcctctataatgccttaaaagcaggaaaaattgatatctatcctgaatacacagggacgattacttctacatttttaaaagacccagttaattctactgacccggctgtagtttggcaaaaagcagaagaaggcattaaaaaactcaatcaatttacctacctatcaccaatgaaatttcaagatacttatgctcttgctgtcaaatctgattttgctaaagaacatcagctcacgaaaatttctgatttgcctaacgtttcaggattaactgcaggttttgatgttgaatttgctaatcgttcagatggaaatattggcttgaaaaaactatatggacttgatttaaatgtcaaaaccatgcaaagtagtctgatttataatgccttaaactctggggctgtgaatgtcgctgaagtatattctactgacagccaaattaaacaatataatcttactgttttaaaagatgataagaacctttttccaccttatcaagcagcaccactgatgaaagaaagtttattaaaaaaatatcctgaactcaagaagattctcaataaactgtcaggaaaaattactgaccaagagatgattgagatgaactatgatgttaatgttaagcaggaagacgcttcaaaagtagcagaaagatatttaaaagctaaaggattaatttaaaagaaaaagaccattgtataatggtctttttgatttagaggaggagaaaatataaatgcgcgagtaagaacacaacataagatatttcagccttctattgaaatagatacctaccacttttggtaggtttttttgtattctaaaagtcttgtttttaaattgagttaaaatcattactttatatttaccaaagtttctaattaagcgtataatattaaacaatcagaaaacaaaaaatattcactaaaaggaggttttacattggaaaatcagaaaaaacgatttcagatgaagtcaccaagcaaattttggttgcttagcactggaattcttttaagtttgttagttactagtttgcctctagcagtaaaagcagatgaaaatctagctgtttcacaaacaaaccaagctgaagatgtcaacaatccaactgtaaattcttcccttgtcgtgtctgattcgacaaccgaaggaaatacaggaacttcacaggcagaaattcaaactaaagaggtgacctcgcaaccttcacaggcaagcacagccccaagtccaagtaccagttcagattcaccagctttggcaagttcggctcagggtccaattgccaattcagattcatcttcttcaaccagttcagattcaccagttttggtaggttcggctcagggtccaattgccaattcagattcgtcttcttcaaccagttcagctcaggttctaaatgccagttcggctcaggctttaagtgtagaagcaagctctaattcatcagagactgtaagttcgaccagttcaggatcgaaaacaaacgcctcgacttcaaaagtcccaagtgttcctcttgattcatcaaaagcaaaagtcacaattgcatcaagtctttcgacaagtggaacagttaccaatgctaccctaacaaatggttcaattgccagtcaagctaatggtcaagaccctgcaatcaagcagtattgaagcgaccggttcagtcgccaatgacatcacagggccagccacgctagatgatatcaatattacaatcaaagctaacaaccttgttcccaataattttctgactccggatgggttacattggtctgcaaatacgcaggttataccaatcaaaggtcaaacaacaggtcaaattagtgttgaaaactttggacaaacggacggtccaaccatacctgcgaccacttatactatgaatgctggagattctggacgaattaccaatgttggaacaaccctagccggaacgaatctagatttgatatacaaagtcatctcgacagatgaatcaagctggcaagcccctgcagaaagtacgtctgactgtccgattggattggcttttacaggcgagcaaaacatcgctaactcagacggaaactcgattgttgctctttattttggggcaaacaatgtcaatattaactatcaaatcgtcgcacataatacagactttcaagtcccggtcctcgcttcgtttatcacaacggatattgatatggcacaaggagtcaagaccaatcttgccaatctcttaaccgtcattccaaagacaaccaaccttgcgatagacactaatagtattatttttgataccacagctcctgacaccgatttgaatggacaggccagcttgccttatggcggttatctgggtgttggttttctgtcaaactttgactatgatttttacagtccagcgccagctcgtagtggaaattcttatcaatattcgcaaggggttcgctatgacctctttggttcggccttacaagcacatttggcgacacaagtcagagatgttgtctatctcaactactatgatgccgatgaaaacaatcggctcattgttccgcaacaccaatttatctggttcccaggaatgacatgaacggttccagccagcaaattcccacattatgcttatggtcaagaaagtcagcacagaaatgggaacacaataatagtcggtgattattatcatatccaaaataccgtcacttatgattactatggtacggacggtacctatctaggacaagaatcaaccacaggcctttatgggcatgcttattcagtgaacgtcccttataactttggcaattactatatcgaagatagcaccacagagtcaggcacttatcccaaagatgatgaaacactagatgtttactacaaatatgtgccaccaattgtttattacaacacaagtaatccttatgcgacgatttactatgccaatggctatgagtatgtgccgaattatattccacctgtggtttattatgcaccaacttatggtgattacagttatgatggaggttattcatattctagtggctatggttattcatcaggtggatatagtagttctaacggagcttactatccaaattatgttccgaaatctgcttactattctaaagaaacggacttggttgcggaggataattattcttcaagtactccaaagaaaaaatcatctggtggggtcttagggtggttatcaaaccagtggaatttggcaatggaaagtgaaaaacattttgattggggaagtacatctagtactctaacaacgctctttgtttttggtcttgcaactgccccgggagatgctgcaggagttgatgagacctatgtgaaatcatatggtggacaagatagtgtgagaccagaagtgggagaaggaattggagaaagcctatctgattatggagaagttgaagaaaatgaccgcgaagaacgtggagaaggagaaacaccaaatgacccagaataaagaaccagaaagaaaaccagaaagaaaaccgatagacccaaaagatttaaataaatttgttaatgggcttaatgattatcgtgataactggatgtctgaaattaatggtaaagactatctaacaccaaatcgaaaaattgaggaaaataaaaaaagtaaaaaagaacaaaacaatagtacgaaagctttacaaaaaattgaggaccttttaaatgattcgaataaatctgtcgattcagagatgattctgcaaatagctaaaaagaaattagaaagtggagagtttaattcagaggatgcagaggattttattgtacatgatttattgttattgactacaacaccgggaaaacaaggaataacgaatagggagagagattatagtaatagtcgacgaaaaagaggcggtatgagaacagccttgatttctgtaattggtactatcataatttttctagcatgggcaattaaaatgggtttcttcaaataggagggagaaatgaaatcaattacttccaaacaaacagcttttgtcggaaatattttaactactgttatggtagcatttatgggcacgataaatatcataaataatttgtattctttcgctggctattctccttttgtaatagcactaatgggaatagttgcaatgtcagtttaccctgcattagaatgggtggcatatagtcgtattggaaaaaggggagggaaatggtggaaattatttctgcttgtgatggggatattatctatatttcatagttatagtagtttaggaaatattttagtattttcatttagaatcattataggaatttgctacatctttacattttttctaaaggatactaagctttcaagtaacagtaactaagaaaggagggagctaatgagtcaaaataaagagattgaaaatttggatgatatttttttaactaaagataaaaataaatctaaaaaaaataaagaaaaaacggctgaagaaaaagccagagaaactgagcagattgtggctaaccttaaagaaatgcaagagcgcgggaagaagtggaatgaagaacataaaagtgaagtttattatgataggcgagggctagtcagatttgaaagtcttactaagcaaaaaccaagaactattaaaagaggaagaaagtatcaagtatttatggaaaatatcgatagctatcttgattctaatgagattagattagaaataaaaaaactgcttcaagatactaaagattatttacttcaaggaatctttgatatttttgacgctaatcgttatcttagaggtaatattaattttctagttcatcaagggagtcaattaaatgattatgaacgaaagattcttaaatcatttaaaaataaatcatatataaaaaatatcatcacaatcataagcatctgtgtgataatatatttaataaaaaaactatttatatcctaaaaaagtattaaattttaaagatcactaaagccaagtatcgtcaaatattaataatactgtatatagtaaataaaagcccctagattcagttaggggcttttaacatcaagaaattagcgaccaatttttttagccgaaatgataagcatcatcggacgcctcatttcatttttcatttcctcaagttctctcatttcaatcggaggtttaggttcaataacattagtaagttcaaatcctgcatttaataaagtcatcaaataggttgtcactgttctatgatatttaatcactgactctcctagaaaattgacttccctcgcaccttcataataataataataatcaactggaaaatggcggatattaccgttctcatcataagaccaatcttgttctccagaagaagtaaacaaggggtgttcgactgaaaaaattaattcaccattctttttaagagattttgaaatcttcttcactagctcctcaaaatttgaaatataatgaagggctaaagaactaaaaacaatatcaaaagaatcagttgaaaaatctatctcttctattgcagactgtcgatatttaattcgggcatcatgattcactttgtttgccacttcgagcatcttatgagaaaggtctattcctactacttctagcgctccatggttagccgcatatttacaatgccaaccatagccacatcctaaatctaaaactttctttccttgaaagtttggtagtattttttctaattcataccactctccagcggctttcaaaccttctttagaccttggcattgctgcataatttttaaaaaactggtcatcgtcatatttattttgttgcattttttcttctccatgtaaatatagttagtgattttatagatatttacatggaaaatacaattttttgagcaataattccttgattcatttgtctccttttataattgtttaagtgagattttgtaatttataaacacattctatcacatgccttataaaaagtcactcaaaattcaaaataaagtttaataaaaaaagtagggtttcctacttttaagaataactattccttttcttcaacttctttgagcgcttttgaagcttcgccaaatagttcttctgctttacttgttgtcttctcaaatgtatcttgaattcctgtttgagttccgacagttgcatttcgaagggcttcttcttcgagttccttcatttgctcatcactcaattttggattcatttcaggcataggcattcctccttcttaaaatcattatattacaaaccaatttaaagcgctaacattatgcttaataaaaaaaatccagatacaactggatttttttattaagcatcaatcgttgagtattgagcattattttcaataaattcacggcgaggttcaacacggtctcccatgagcatatcaaatattttatctgcttctgctgcatcttcaacagaaacacgtgccatcaaacgatgttcaggatccattgttgtttcccatagctgatggtcatccatttcaccaagacctttataacgttggaccgtaggttttgttctcccttgtgcccagcgtgctaaagcttcttgtaaatctttttcttgattttcacctggttgaatgtattctttagtttcagaacctacttttataccataaattggtggttgagcaatataaacgtagcctgcttctacaactggacgcatgtaacgatagaatagtgtgagtagtagtgttcggatatgagccccatcaacgtcggcatcggtcatgatgacgagtttatgataacgtgctttggacaaatcataatctcccccaaaacctgttcccatggcagtaaataatgaacggatttcttcattggctaaaattttatccattgttgctttttcaacgttcaaaatcttaccacgaattgggagaatggcttggaattcacgattacgtcccgatttagcagaccctccggctgaatctccttcgacaataaataattctgtttgttcaggattattcgatgaacagtctgctaatttaccaggaagatttgaaatttcaagacctgattttttacgtgtcacttcacgcgcacgtttagctgcaattctggctttacttgctaaaatccctttttctacaattttacgagcaacttgtggattttccaacataaatgttgtcagtgcttcggcaaaaagtttgttgacaattcctgttacttctgagtttccaagttttgttttggtttgtccttcaaactgtggattagggtgtttaactgagataacggcagtcaatccttcacgcacatcgtcaccagtcaaattgtcttcattttctttaagaattttattttgtttggcgtagttgttaatgacacgagttagggcagttctaaacccttgttcatgtgttccaccttcatgagtattgatattattcgcaaaagacatcactactgaatgataagtatctgtatattgcatggcaacttcaacagcgattccatccatttcaccttcggtaaaaatagctggttcaaaaataactgtcttattttcattcaaatattcaacataagactgaatcccaccttcataatggaagtgaacttcatttttttcatttccttcacgtttatctgttaaggaaatacgaagaccacgattcaagaaggcaagttcacgaacacgcgttgcgagtttgtcaaagtcaaattcaacagtttctgtaaaaatttctgggtctggtacaaagtgaacagttgtccctctaagatcagtttcaccaataattttcaaatcatctctaacgagaccgcggtgatactcttgaaaatatttttgaccatctttatggacggtaacatctaaagtcgttgacaaggcgttaacaacagaagaacctacaccgtgtaatccaccagaaaccttataaccgcctccgccaaatttacctccggcatgtagaacggtaaagacggtttctaccgctggacgacctgttttttcctgaatatcaacaggaattccccgtccatcatcaacaactgtaattgaattatcaggttcaataaaaacctcaatatggcttgcaaatccagcaagtgcttcgtcaattgaattgtcaacaatctcccagaccaaatggtgcaaaccttcttttgatgttgaaccgatatacatcccagggcgcatacgtacagcttcaagaccttcaaggacctgaatctggctggcatcatattcgtctgcaagcatttctaaatttttattttcttcgttcaaagttaactctcatttctatgaaaaacttattaccattataccacaaatcggcgattttagcacttttctaaggtattttcatctctaactcttcagatataaataagcaaatttccactgaaatttgcttataatcaaatgattttttaaagattacaaaaggatttctgtcagttcatgaataatatgggtcggttcattagtaagtaagacattctttgtagtgtcagatgtttttactgactgaattgaatcattagagctatcaaaataaatggtttctactccagcagcatttccagcttcaatatctaatgagcggtccccaatcatcactgtcttctttggattaagcttatacttgctcaacaaatagttaattgattctggcgccggttttcgtttaaaaccattatcagctgtgacaacttctgtaaaatatgagccaatctctgctgctgacagaattgtcagtacttgatgattacgatgtgaaatcataaaatttttcttaccatttactgacagacttgtcagtactttttttgcaccagaaaagagaattggcttttctaattcttcggcctctaattttttatattcctctaaaaatcccggtaaatcactcgcaaatttttcaacagcataagccgttgaaactttcagtgcatcatatacgtcagtacgcaaaacaacacgctctgccatcgaccatagtgtggcagcaaaggcatggctagaactttcataattgtctagcaaagttccgcctaaatcccagatataattttcgtagtccatgtaaaatattataccacacctatcgaactgatgtatctgttaaataaatatatttattattgaattcattctaatttaacaattatttcattgccactcaaatcttcgataataagtttattttcgtcagcagattgtaaacgcgccatctgcttagcatgctcttttatctgattaaagaatgcttcatcatcaacatatatgatgaattctagcaatccaggtaaatctgtcgtgcggttattcaaattgcccccagcccaattattgaaggcaaaatgatgatgatagttccccgaagaaatccaacttgccgaatgaaccgcaaacttctctgtcatttcaaaaagctgctgataaaaatttgtcgcctttacgacattttcaacagtcaaatgaagatgacccattctagtttgagctggaagcttatatttgttttcactttctgtagctatcgtcaaaagactttctgcatcaaggttttccgttataccgataattttatctgcctgtttatcccaaagcttctcatcattatcctgataaacttcgattccatttccctctaggtcttctaaataaattgcctcgctgtaatcgtgatttgcagcaccaacaattggaaattcattctctagcaggtgctttaaaaaatttcccaaatcagagcggctcggtaaaactaaagccaaatgatataaaccataagcttttgtatcatcactcttgactttttctaaacgaataagtttagtctgggctttttcactccctaaatcaacacctgtttcatcttgatttaaaatatccattcccaaaacttcttgataatattgtgcttctaattctaaattaacaacatttaatgtgactgaacctaatcttacttttgattgatattggtacatagagcctcttttctattgttatttcacgttcaaatatacgtttacattcgtaaaccctaattatattataactttatttattaatctgaacaagaaaacacacttatttcctttcttaattttttttataaaaaaattactcctaaagcagagtaattttattgttaatttttatcagagattattccaaaaatttttctgataaaaatgaagtatcactcctaccgaaaatcctaaaaggaggactagggcaaggttaacaactaaaggatatggaataaagataatcagggcaataattgctccaatgagtgctcctgctcccaaaagcgtagcaaagaaaatgataaaaacccgaaatcccccagaacctcttgtaaaaagttgagtcaacgcagtccaatttaaatttaagagatgccaatctctgacaaaataatgaagtgaaatcagatataccccaataacattcccaattaacagcccaaagagcaaggtaacagggactttcagtaaaataccaatcactaaagataagattaaatcaagaactagttgaataaaaacggcaaaatgaaatttcactctgagatagaaattcaacttcatgggtaagcttttaaaataattaaaattttcccgatcaagtgagataatcattgaaggaagagaactattgttaatggtcagaaaagctaaactaattccgatgataggaaaaatagcaaaaaatttcaaatccaattttgacaaatttagaccactagataaaagaccaggcagcatagcaagcggaaaaataaaggatcctgtcagcatttgaatccataaggtaggatttttaattagtcctagattataaattcttaattgtgaggtaaaatttctcgttcttcttattttccttttttgaacaattctcgtttcttttgactcttccaagagaattttaaacatttttggaaccactagaagtgtaaaaacatagtaaagagcaatcaataagattataaaaaagagaaaactaaataaactataaaaagagaacggatttactaaccatttccaaaaaggtaaaaatggcagaaaagttcctctatccaacaacttacctgtcgcactaatcgtcgtttgagcattatttagatacataatcccagcaaaaattccaaccattgaaatcaataatagtatggtctgagaaacttttttatagcgttgaaatattttagattgaaccaaaaaagtaatcaaccatgtactaagcagtaagaataatagagcaaacagaaaaaatccaactaatccgagaaagaggccaatcactccgtttgccctaaaacctgttattccaaaaagcactaaaagaggcattaaataaggtaatataacaaaaattacgactaaaaatttagcagcaaaaatattaacattttcaaaagggagaggcagataatctcgaaagtctttgctctcataaaaaatatttaaaattgctgacaaggcttgagaaaaagtcatcagggcaaacagagcacaataaaaagtaaaaaatcccggatattttggaaagtcaattgctaacatcatcagtccgaaaaatggcaacatgatgagcgagacaagcccatattgaatcaaaagtgatttggttaaattttttgttttacctttttctctttgacgttgggtagcttgaggattggcataaaggaggttgacactaaaaagacttttaatttgttgaagattcatcatcgtctcctctattaagctcttcttgctgacgacctaccattttgagataaaccgattccaaagattgatcttctgctgaatctaataaagcatcaactgttcccgaataaattagttcgccagcttttaaaatggctagttgatcacatagctgttgcgctacttctaaagcatgtgtagaaaaaataaccgtttttccttgggcagcgtgtgctttcatcagatttttcaaatcaaatgctgcttgagggtccaatccttgcaagggttcgtcaagtatccaaatatcaggagtcgataagagagccccaatgacaattactttttgacgcattccatgagaaaaactttcaattgtttgatattctttcccttcaatatcgaaaagtcgtgtaagagtttctagttgtctttccttttcagaggtttcaagtgcaaaagctgaggcaattaaattccaatattctttaggagataattgtaaaaagatatccggagtatcaggaacatagccaattctttttttgatttctgaatgatgttcagcaagatttaaaccatcaactaaaacttgtccacttgtcggttcaataatactcgtcagacattttattgttgtggatttccctgccccattatgccctaaaaaaccgaatatttgaccttctggaattgttaaacttagatgatttagagcatactgcttgccatacatctttgttaattctctaatctcaatcataaattttcctcaattcattttatttttgatgttaaatgctatctttgcatttattatatcatagaatattctgaaaaaagtcaaaatcttgtatataagaaaaagaaacctactggtttcttttaagcttgttctgattttgataaaagaataactgaaacaataaccatcacaatccccaccatttctagtagtgttaattttaagccaaataagggaatacttaaaaagacagaggtcagtggttcagtggctgttgcaaccgaaacaacaagaggtgatattagctggaatgctcttaaaagcaataaaaaagccaatgctgttcccacaatagaaatcgtcaaaacgtaaaaaattgagaggggttcaattcggaaattaatccgccagactggataaaagatattacaagcaattcccgcaagcatcattccccatccagtcatatttaacgccccatacttatccaataaaggacgtggaatgatagaatagattacgaccgcaacacccgcaagaaggcctgttacaagggcaagtggactaattgaaagatgtttgatatttccgttcgtaatcaacaaaaaaatacctatcattgctaaaatgacgaataagaccgatttgggttttggtacttgacgttgaaaaatgagtaaataaagcataataaaaacgggtgctgtatattgtaaaattgtcgctgtagcactatttgaaagttgaatggccacataataaaaatattgaacagaaaataccccaccaaaaacatacaaaaagagggttggcatattcttttttgatttccagacatcaaaaaaacgcttatggtctcgcgaaaaagacatggccaataaaataataccagcaatcgttaaacgtgttgatgtaatccaaagcgggctaccatgataatcacggaaaaaaagctgaccaaaaatgccagaaattccaaacatacaaccggcaactactgcataaagtgtgcctttaaaaatttgtttttttacattcatttttatattataccatacatcaagagggtttcacggggttcaatcatcattatatttttatatattacattgttaactctaaaggagtttcaagcaaaactaagttaaatacaaactaaatattatggtgaaaatatataaaaaaaacattttaaataaaatgtttttttaggttatggttattttaataaaagaatcggataagaattccaccgaatattaggacaattgcaccacagagtctattagccatctgagcaaaagcaatcatttccattcgatctgaagcagacaagacagcaatgttacctgtcccccccatagaattattgatcatccctgcaccaatggcagtttcgaccggataaagtccaaagagacgagccaagaaccaactagcaagtcccattacaacgacactagtcaagcctagtactacaaattgccatgtaaatgctgaagcaagagtattcaagtcaatcaaagcaagaccaatccctgccaaaatagcatgagtaaggtttgtcataatcacttggttaaacattacaacagattcttctaaatctttaggaacagtatttgtagcttttaagataaatacaataataatcataaatgcatattgatgaatattagggaagaatttgttcaagatgtcaccagtcatcagaagggcaaaggcaaagagcattcctgttccgatttgttgagcatctaattttattttaggtttagctaattcttctttagttgctgcaacaagggtaccatgtccgttatatttagatttgttgaatactttagcgatagataaggcaccaataatcgcaaggatgttaccaaaagtaactgctggagcaagttgagagaagatagctgcctgatttccatgagccaaaccagccgcatagatttgagaaagcggagtaattccggctcccataccacctgacatcattggcatagaaacatacattacagaatctgaaaaaccattaccaatgagcattcctacgagacctactgagaaaaagccaataaccattgtgattaacgcaattggaataaattttttcgaagctttcactaacagatttctgttcatgcctaaaatagatccacaaataagtgcagctatatagaaatcaagaaaaccaaattttccacccataaaatttgaaactgctccaataacattagatggaacaatatggaagaaagataataaagtggcaccaatcaatgtgaaaacagagcccccacctaagtatgaattcataataggtagtttttctcctatgaagtacaataggtgacctaatgttacaagtaggagagtcaatcctaccatatcaagtggaagttttcccaatagtgttacgactatgatgacagctacgaaaaaggcatacaagggaagactaattcccgatattttcgtttctttaagttttttcatttaagatattccccttagtactctggataccatttaagatcacgaaccgctttagccatatcagtttctttagattcagtaagaccttgttcttgtgctttcttagcaactgcttctgcaactttaattgatacatcggcaacaaattcaaaaggaggaagaacaggagcaccaggtttacctgggtctactaaaccgctcaatgagtgtgcagcagctccgatcatttcatctgtcaaaagttttgcttcagatgccaacattcctaagcccaaacctgggtagataagtgagttatttgcttgaccgatttgataatcaacacctttgtagttgattgttcctgaaggaacaccagtagcgacaaaagcttttccatcagaccactcaataacttgttcagcagtagcttccatttttttagttggatttgagatagggaagattactgggcgctctgtattagcacacatagcttcaacaacttcttttgtaaaggcacctggattagttgaagttcctaccaaaatagttggttttactgtcttaacaatattaagaagatcagtcatatctccagcatctttataatcagcacgttttttagcaaatggtttttgagctggtgtaaggtcatccatatcatcaaaaagtagaccttgttgatcaatcatgaagaaatgtttgtaagcttcttcttcagaaaggccttcactaaccatttccgcatgaacacgaccagcaatacctgcaccggctgaaccaccaccatagcaaaggtatacttggtcagttaatttttcacctgtaatgtcaagtgatccaaaaataccacctaaaacaacaataccagttccttgaatgtcatcattgaatgtagggatttttgttttgtagttatttaaaattgtggcagcatttgaacgaccgaaatcttcccagtgaaggtacaatttagggaaaattgattctgcagtttctacaaattgatcaacgaaactgtagtattggtcaccataaatacgttcttggtgatttccaagatacaaatgatcttccaaaagttcttttctatttgttcctgcatcaataacaactggaagtacagaagctggatcaatacctgctgcagctgtataaatcattaatttaccaactgagatatcaacaccttgagttccccagtctccgataccaagaattccttcagcatcagttacaacaataaggcgaatatctctatcacctgctgcatttttcaatgtttcagtaatattttcagggtggttaatatcaagataagcagcatattgtggatctacaaataaatgactgtagttttcaattgtatcagcaattgttggatcataaacaactgggttaaattctacaatatgtttattaaataagtagtaaaacaaagtacggtttgtattgaaaatttccatcaaaaaatgtcgtttttctaaatcagatggttttgtcaaatattgttcgtaagtttgttcagcttgttcttaaattgtttgaacatttggtggaagaagaccaatcaaacccaattcttgacgttctttcatagtaaaagctgttcctttatttaaaaaaggattgtttaaaatttcatgtgcacgcatcgtacaacctccataaaaattataattaatgttattactttattactataaacttcttttatcgttatagtcaaatatccaagtgttgataaatttcatttataacaaaccaataatgtaactgactacataaaaagttctatgaaaaaatatttgattcctagtcaaagtttttagtaatactcagcttataatcgttaaattatgatttcctcctaaccgctttatcatcaggttttatgggcatcaaacggaagttaactaacaatttttgtcaagaaaatgtttgtttatctgaagtacctatttttttaattaaagaaaaatcgtcctattttatgaattactatttcctattatatgatagtattctaaaaaagtagagtaaaataccattcttttcaaaagaagtaaaaacgagaagtaaaaagcttatcttactcatttcttgcttgctcttagtttcagggttctcttttacaaagttaagacagtatagcgtgagagcaatgactgatagtcctcaatacaaaaaaatattagtaaataattgggaaaagtcacagctcaataaagaaaatacaaacgagaaataaaaaaacattatcagttagataatgtttttttatttactctaattttatattcttgccttaatgattttatagataagtgattatagtttttcaactgattcaactgcttgaacaaaacgagacgcgatttcaagaggtctagtaattgcaccaccaataaccattccgtctactccaattttttggacatactgtgcctgttcgggactgtgaatccttccttcagcgataacgggaatttttgcctcaactaacttttcaagtaattcaaagtcaggttcatcttgttttttactttcttctgtatagccactgagagtagttccaacaaagtctactccagcagaataagcattttcacactctttaaaatttgagcagtcagccattaaaagttgagttggatatttttctttgatttttttgataaattgattaatagttagcccatcatgacgttctctcagagtacaatctaaggctattacctcacaagaagtagcaactaattcatcaatctctttcatagtcgctgtaatgaaggacttttgaggcaaataatcttttttaataatacctatgatgggtaaacttaccgctttttgaatttcttttatatctctgaccgagtttgctctgatagcgacagctccagcttgttcagcagcttttgccatcaaaggcataactcctccattttcagaatataatggttcaccgggtaaggcttgacaagatacgattattccaccctttattttttctaaaaattgttctttattcattctccgtttatcctccataaaatatgtttttggataattactccataattaatatagcatacgcttacatttttgtcaattatgataaaataaatgtaagatacaagaaattatgagttaattaccaaaggaaaattatgaaaattgaaacagtcattaaagaaaaatatgaattacttactaaatcagaaaagaagattgcaaattatgtattagcttcaaaggagcgtattgtttatggaacaatgaatgatatcaaaaaagcaatcaaggttggcgatgcaaccatagtaagattttgtcaaaaattgggttattcaggattttcagatcttaaaatagaagttgctaaggaaagttattctcaaaagtcttctaatagaacagatctgaccttattttttgatgagaatgaaaatagtattattgagattcttcatgaaacaaaatcaaaattagatttagaacaatttgaaaaaagttcaaaattaatttctgaagcttcggctatttatatttttggggtaggtttaagcggcaatactgcgaaagatttagaagcgatgtttcttcgtattggagttccagttaaagcaattagtgactctcattttcaattgcaaacagctgccctattaaaaaagacagatttaatcattggcatttcattatccggtaagacattagaattatttgaatccattaagattgccaaagaacaaaaagctcagattattacaattactagctcagactattcaccacttgcccaactttctgatattaatttgcaaacagtgaatgaagagttttttgatggtggctcactcactggaaaaatctcacaattatatatttgtgaaattttggttaaaaatcacgagcgactttataaagataaatcaattcagagtagagaagcgattatcagagcagttatggataagacagttgagtaacttctttattattcagcttttagtgatgtttgttgaaccttattgaaatactatgttataatatggacatgacaaatttcaagaaaaacgatatatttgaagcagaagtccttgatttgacacatgaagggcaaggagtggttaaagttgattcttacccattttttgtagacaatgccttacctggtgaacggataaaaatgcgtgttcttaaagttggaaaatcatttggttttgggcgtgtggatgaatttataagccaaagtgagcatcgcacgactcagttaaatcttgattatttaagaactgggattgctgactttggtcatctgacttataatgaacaagtaaaatttaaacaaaagcaagtcgttgatattttaagaaaaacggctgggaaggaagatttccctgtttctccagttatcgaatctattaaaacgataaaatatcgaaataaggcacagattcctattcaaatggttaatgggattttaactactggattttatagaaaaaattctcactcattaattccagtcgaagatttttatattcaacatcctgaaattgatgcagttgtcctttttttgcgtgatgagtttcggaaaattaatttacaagcttacgatgaaaaaacgcgcaaaggttggctacgaaatattgtggttagaagaggttttcatacaagtgaaatgatggttagccttgttgtaaccagtaaaaaactcccagaaaatgttgatttggtaattgacaaattagtggagcattttactaatattaaatctgttcaactcaatattaataatggaactggctcatttattttaggtaaagagttcgttttattgtatggaaaagattttattacagatttgatgttggacaaaacttatcaaatttctgcaccggctttttatcaagtcaacactccacaagctgaaaaactttatgaaacagcctttgaattcgcagaattaaaaccaggagatattgttatcgatgcttattctggtattggaacaatcggaatcagcatggctgatcgagtcgctgaggtttatgggatggaagttgttccggctgctgttgaaaatgcaaaacgtaatgctcaattaaatgaacttgagaacacacattatgaagtaggaacagcagaaaaaattatgcccaagtggcttgatgaaggaataaaacctgatgttatttttgttgacccaccaagaaaagggctcgatgaaacttttattaaatcagcaacagcaactaatcctcggagaatcgtttatatttcatgtaatcctgcaacctttgctcgagatgttgtacgttttgaaaacgaaggctatattttagataaagttcaaccagttgatttattcccacaaacgcatcatattgaacttgttgctcgctttaataaaaaataaaagaggatagtattttagaaaatcctaaccatagaaagaaaatcatgattcgcataacacaaatcaaaatttcaattgacgaacctgtcagtaaagttaaaagtcttgttttaaaaaaattaaggcttcaagaagctgacctgctcgattatcgaatttataaagaatcaattgatgcaagacacagaggcgaaattgattttatctatactgttgacattaaacttaaagatgaatccaaaatactgtctaaaaaaattaaaaatgtttctttagcaccagaactagactatgttaatccgcaacttggaactaaaaaaatggtcaaccgcccagtcgtcattggatttggccctgctggaatgtttgctgctttacttttggctcaaaatggttatcgtccaattgttttagaacgaggccaagcagttgatgaacgtgtaaaatcaattgacaagttttggcttgaggggaaacttaatccaaaatcgaatgttcaatttggtgaaggtggagcagggactttttctgatggaaaattaaccagtcgtgttcgtgatttacgtggacgcaaggttttagaagagtttgttgaagctggtgccccagaagatatcctttataaggcacatcctcatgtcgggacagatttattacgtgatattgttaaaaatatccgaaaacaaattatcgagttgggtggggaagtctattttgatgctcaagttgaagaatttttaattgaagatgaacaattacaagcagtaaaacttgctgacggaaaaatcgttaaaacaaatcatgcaattttagccattggtcattcagctcgtgatactttttcagaactttatgataaaggggtaacaattaccgctaaaccctttgctgttggagttagaattgaacattctcagtcattgattaacaaggctcaatataaaggatttgctgaccatccacggttaggtgcggcagaatatcgtttaactcacaagtcatcatcaggtcgaggcgtttatactttctgtatgtgtccgggaggactcgttgttccggctgcctcagaagaaggtggacttgtcacaaacggaatgtctgaacatgccagagaccaaaaaaatgcaaattccggacttttagtccaagtcttccctgaagatttctcaagtaatcatccacttgctggagttgaatttcaaaaagaattagaacataaagcttttgaattaggcggctctaattatcaggctcctgcacaacttgttggagatttccttgacggaaaagcttccaaagcaatgggttcggttgaaccaagttatgctctaggagtaaaaccaacaaatcttgaatcattattcccagactatgttacacaatctatgcgagaagcgattgttggtttagataaaaaaatgcacggttttgcactttctgatgcagtgatgactggtgttgaatctcgttcatcttcgcccgtcagaattaaccgtgatgaagaaaattttcaatcagtttcaactaaaggaatctatccttcaggagaaggagcaggctttgccggaggaattgtatcggctgggattgatggtttaaaatgtgctgaagcactaatttctgattttgcaaaaccactgacggaggtgtaaaatggttcctaaatttcatgattacgaaagagaatcagaaaatttttatgaccgtattgctagccaatttgaccatagttttgatggatttttggccagcttttttaaaagattaatccttaaaaatctaaaatttgaacaaaattctaagattttggatgtcggttgtgctaacggaaagcttctggcgatgttaaatgataaaaagaaaattgtcggtagtggcttggatatttcgtcagaaatgattaaagttgccaaagcccagtatcctaattttacttttgaacaaggttctgctcaagaaattccctttaataacgagagctttgatttaattatttgttcggctagcttccatcattttccaaaacctgagcgttttttgataaaagctgaatgcctgctcagacccaatggaagattagtgattgcagaaattcacattccatttatcacaaaaatttataattggtggattaaccgtttctcgacagaaggagacgtgaaagtctatcagccaaaagaactgacagaacttttcaatcaaaatggttggaaaattaataaaaaaaagatttttttacagattcaatattatgaacttgaaaaaaattactgacaggctcctcttggaacttattgacaagtctgtcagtaattctaaaataagaattaggaaaaattatggaacaagaacaacatcgcagttttaaagcctcttggtttttcaagtggttcattaataataaagtcgttgcaagtttagcgattgtccttctctttttattgaatattttattactcaataaagttggattcatttttaaacctgtcggagaatttattacagtcatttctctgccagttattttagcagcagtattttactatttacttaatccgatagttgattttttggaaaaaagacgagttccgcgtgtcctgacaattattgtccttttcttaattatcgcagctttgattgcttggggcttaattgttgctattccaaatgtcatcagcggagtagacaatttcgcgtcatcggtccctcattatgttaacactgcccaaaaagagattaatgctttagcaaaaaatccacactttgagcaattccgaccacaagttgaccaatttgccaaatcaattgggaatcaattgattgattggtcaaaaactttctctgttaatgccgtaacgactctttcacatctcatcagtaaaactacaagtattttgatttctttgattgtcttcccatttgttcttttttacttgttaagagatggtcaaagattaaatggctttgtcactcatttgttgcccaatgattggcgtaaagaaacatcaaaagtcttgcatgaaattaatagtcaactttcaaattatgtgcgtggtcaagtcttagttgccattgctgttgccattatgttcatgattgggttaccaattattggattgcgctatgcagtagccttggcaattacagcaggtttcttgaacttagttccatttttaggatcatttttagccgctattccaatggtaatcgttggtttggcgattggtggacctttgatgcttgtaaaagtaatcattgttcttatcattgagcaaactcttgaagggcgctttatttctcctttggttcttggaaaacaaatgtcaatccatccgattacgattttatttgttttactgacagctggtcaaatcttaggagtttggggagttctacttgcgattccattttatgcaacactcaaagtgattattgttcacgtttatgaatggtatcgtgaaatttcagtcctttatcgtgaagaaacagctacagaagaagctaaagagtaattaatagaataaaaaataaggagaaaaatgtcatattcagaagatacaattgactttttacatcagggagacctgattggaatgcaaaattcacttgcaaaagcattaaaaaatgataataatgaaatgttggctgaccttgccgaatatctgcaaatgatgggttttattgatgaaagtcaaaaaatttatgaccaaatcatgtctgaacacccagagtcaacggattatctgattaatttagcagagatagctgaagataatggtaatttagatgaagctctgaactatctttatcaaattccagtagacgatgaaaactatattgctgcactcgttaaaattgctgatttatatcagtatgaaggtgattttgaaacagcaatttcaaaattagaagaagcacgagaattatcagattctccgcttatcacctttgctttagctgaatctttttttgaacaaggtgattattcagccgcaattacagaatatgccaaactttcagaacgtaaaattttgcatgaaacaaaaatatctatttaccaaagaattggcgattcttatgctcaattaggtaattttgagaatgccatttcatttcttgaaaaatcatttgaatttgatgaaaaacctgaaactttatataaaatcgctcttctttatggagaaattcataacgaaacaagagctattgctaatttcaaacgattagagaaaatggatgttgatttcctgaattatgagttagcttatgctcaaacattggaagccaatcaagaatttgaagctgcactagaaatggcacagaaaggtttgaataaaaatccaaatgccgttcctttacttcatttcgcctcaaaaattagtttcaaattaaaagataaatcagcagcagaacgttacctcatggatgccttgaacttaccagagttacatgatgaaacagtctttctacttgctaacttgtactttaatgaagaagattttgaagcggtcagtaatcttgaagaacttttagaagatgaacatttattagctaaatggctttttgcaggagcacataaagctttagaaaatgattctgaagcgactgctctgtatgaagaactcatccaaaccaacttgtcagagaatccagagtttttagaagactatattgattttcttaaagaaattggtcaaatttctaaaacagaaccaattattgaacaatatttggaactcgatccagatgatgaaaatatgagaaatttgctgacagacttaaaaaataattactgacaaagctgtcagtaattatttttattgtaagctagaaaattcacaaacttgcgtcaaaataattgtaaaagggtctattatctgataaaatgattgtgaagtaatccaagagattatgaaatatgaattagaacaaatagaggtaaaataaaaaatgtctgagaaacaatttggggcgaacttggttgtcgatagtttgattaaccataaagtgaagtatgtatttgggattccaggagcaaaaattgaccgggtttttgatttattagaaaatgaagaaggccctcaaatggtcgtgactcgtcatgagcaaggagctgctttcatggctcaagcagttggccgtttgactggcgaacctggtgtagtagttgttacgagtggtccaggggtatcaaatcttgcaactccacttttgactgcaacatcagaaggtgacgctattttggctattggtggacaagttaaacgaagtgaccgtcttaaacgtgcgcaccaatcaatggataatgccggaatgatgcaatcagcaacaaaatattcagcagaagtacttgatcctgatacactttctgaatcaattgccaacgcttatcgtattgccaaatcaggacatccaggtgcaactttcttatcaatcccccaagatgtaacggatgccgaagtatcaatcaaagccattcaaccactttcagaccctaaaatggggaatgcctctattgatgacatcaattacctagcgcaagccattaaaaatgccgttttgccagtaattttggttggagctggtgcttcagatgtcaaagttgcttcatcattgcgtaatctattgactcatgttaatattcctgtcgtggaaacattccaaggtgctggcgttatttcacatgatttagagcatactttttacggacgtatcggtcttttccgcaaccaaccaggagatatgcttttgaagcgttctgaccttgttattgctgttggttacgacccaatcgaatacgaagctcgcaactggaatgccgaaattgatagccgcatcatcgttattgataatgccattgctgaaattgatacttactaccaaccagaacgtgaattaattggggacatagcagcaacattggataatcttttaccagccgttcgtggttataaaattccaaaaggaacaaaagaatatcttgatggccttcatgaagttgctgaacaacacgaattcgatactgaaaacaccgaagaaggcagaatgcacccacttgatttggtcagcactttccaagaaatcgtcaaagatgatgaaacagtcaccgttgacgtaggttcactatacatttggatggcacgtcatttcaaatcatacgaaccacgtcaccttctattctcaaacggaatgcaaacacttggtgttgcactaccttgggcaatcacagccgcattgttgcgcccaggtaagaaagtttattctcactcaggtgatggaggtttcctcttcacaggtcaagaactcgaaaccgccgttcgtttaaatcttccaatcgttcaaatcatctggaatgatggtcattacgacatggtaaaattccaagaagaaatgaaatatggacgttcagcagccgttgatttcggttatgttgattacgtaaaatatgctgaagcaatgggagcaacaggctaccgtgcccacagcaaagaagaacttgccgaaattctaaaatcaattccaaatactacaggtcctgtagtaattgatgtacctttggactactctgataatattaagttagcagaaaaattattgccagaagagttttactgataaaaaacaagcaaattgtgaaataacaaaaataaaagaagaagtccttgaaccattgtgtgttcagggattttttcatttattattaatcaaaaaacaatttaatttaatggagtcctttaatgagtaaaatcacgatggcataggaaaaacttgaaataatgccaaatatccaaaaaccaagtccttgataaataagaccaccgactataaacgcgagagtcagtccgagataaagagcagatgaattaaagctcatcaaagttgagcgattttgagtagataaagtcacaagataggcagaaatcgcggttaccccccagcccatagaaaaggcgagcaaaattagaaatataatgagacctaaaatactgttgctaaacagtcctaaagccaatgtaaagctaagtgaagcacaagcattgaataaaattgactttactcgtcctaatttgttcataatcacaccaccagttgaagcagcaataaaatttgcggtgccgtaaattagaaaaactagaccagctttcccactactaaaattgaaatgctctgctaaaaaacttccaaggaaagtatagactaggtaaaatccaaacatccaaaagaaatctagaagaagtgtatgaatcacatttttagctttaaaaacatttctaaaattgaccaaatagctaattttttgattttgagcagtagtatttgggataatggctattataagaatgagcgagaatactgtaagaacggccgatgcccaaaaggcactatgccaattgcttagttgagagagaaaagatccaagtgggacaccgactgccacagaaagtgaaagacccgccattgaaattcccataattttattcatcaattgcccattaaaataactaccaatgaatgcccagacatttgggagaaatagagcagcacctagtcccgcagctgcacgatagatgtaaaaagttgcaagatttgtagcaattgcgcaaagaagagtagcccctaaaaaaagactcatgccggtgattaaaagtttacgtttactaaaacggtcgcctaaagggccaaacaatggagcaccaatcatttcacaaagggcatacgttgtgacaccaagggcagtttgactaattgttgcatgaaagtcttgagcaatttgtgggagtaatgggctgatgataaaactatcaaccccgacgacaaagacaccaaggaaaagtccagtgacggtagaaaaatttttaatgttcataaagtcagattacgctttgtttattgaactttcaagtgaacttttgggaactaagttacaaagttgatactacttgtgggattttagaaaagtggtaaaatgagcttatggaacttgaaacagaaaatacttttataaaacatagtcaaattcatggagaattttgtcctttagatacaacaatcaaaattttgtcgggtcgttggaaaacaattattttaaatcgtttgatgaaagaggaattgcattttaatgagcttgcaagacagattcccgattgtacgagaagaatgctagatttacaacttcatgaactagttgaggcacaaatcattagaaaaaatataaactttgaattgttacctgtacagatttcttatgaattaacaaatttgggaaaatcacttttaccgattgtttggacaatgaacgactggggaatacaatatattaaagaagtgacaggaattaccgatgtggacccatcttgtgaaggaaaaaaataagaattaattctgaacaacaattagattttatgatatatatgtattccaaataaaaataagaaacgtatcaaaaattaatcgtctaaaacaaacagaaatttttagaattttttattaaatacagcaaaagttcaaactattatgaccggtagaccggtcattttttttagacatttcttactcaaaacatcgagttagtagaaatttaaaaataaatcatttcagttaattatttataattaaccccctaaagacagctttaaatctgtggaaattatacaaaatagttaatttattagaagaggtactttttttataaatttaattaccagattttaagacgtttttctggtgcacgatacatttggtctgtttctttgacatcaaaagtttcataaaattcttcaagatttgttggtggaatattggcacggagtttagcaggagcatggacatccattgataaaagcatttgttggaattctgtgcttgctttcatacgccaaattttagcccattggctaaagaaggctttcaaatcaacatcatcttcctctttggctgcggttagcgcagcagtgattccaccttggtcagcaatattttctgacacaatgagttttccgtttgctggaccagcttcagtttcaacgccatcaaagagctcaatcatttctttttgtttttcttcaaaggcttcgtagtctttatccaaccaccacttgttcaaattcccttctttatcgaattgggcaccgttattatcgaaagcatgagagatttcatgggcgataactgcaccaattccaccatagttttgtgatgatgattggtcaagagaatagaatggggcttggaggatagcggcaggaaaaacaattgtattactatctggactgtaataagcattgaccatatgagctggcatatgccaagttgttttatccacatcttctgagaatttttcaaaggttcgagcagtcaaaatttcatcaaatttaacggcatcttcgtaaagagaaccagaagtcgtttttaagcgacgataaatttcaggtaatttgtcagggaaaccaataaaaggtgtgatggcatctaatttttcaattgctttttcagcagtttcttgactgagccaatcatttttacgtaatcgttcttggtaaactttaatcattgccgcaaccatccgtttgacatcggccttaccagcttcaccaaaatattttttaccatagaataaaccaatcacttggctaaaataagactcagtcaaatcaagttgatgtttttcttgacttcttgcttcttgaacatttgaaaggaaacgtccataagctccaccaagaattctaaggtcttcattgaagaaagaagtagcgccacgtgcaattttagtcagcatccaagctttaatcagtgaccagttttcttcatttacaagtgaatcgaagttttcataaaagcggtcttcgtacacgatgattttatcaggttctgtttttactaaatcattaattagacttttaaagtttagattggtaatttcactgacaaagctgtcagtagcaattggatgataaagctcagcatattttgcccactcttcagaagtatttgctgacggaactaaaagctcatcgaatttgacggcattttgggcaatttcttcagcattttccacttcaaagcgagctaaaatttctgcagtatttttcgtccaaaaatcaagtaattttttctttcgaggatgtttttcatcataataactagtatcaggtaaaagtaagcctggtccagaaaatccaagagagtagtgaatcgcgtctttcatatctggttcaacactaaaagagaaaggaacagaattaacagtagcaaataaatcatcttgaactctagtcatattcgacctcctaagattatggatattttttacattatatcacacttgcataaaaagcactgacgattctatcagtactttttaaagccatgaaaattaatggaaaaaatcaaattaagaacttccaaaacgataaattttggtaattttacaagataaatcaggtacttcagcaagttttccgccatcacgacttaaacaaaccagtttattttctgtaactaataatttggcaaagtggtcgtgttgtaataagaaattacgaacagaatccgtataatcagtatcagtaaatttaacgaagagtaaatctccatttccaggggcttcatcatctaaaggaccaccgattagttcaaaaacagcatcgtaactttcaggaagttgtttagtgagtaatttaatcgtttttttactgtcttgaagagcccacgtgttatcgccgcaaaaaacaaattgcccagcactcaaagagattggttctctttcaagaagttcaagctcatcaatacgattttgaatataattaagcagatgctgtttattgtctaaggttagatactcaaacaagagttttgctttattataactgtacttgtcatctttaccaagaagatactcggtcgtgacattaaaataatcagcaatttctgtcaatcttttggcagagggttcttttcccaagcgatagttggctagggcatttctgggatatctcaattctctctcgacttggttgaaagatttctgagaatcaataactaaagtttttaaacggtcatagaacattaaaatcacctcaatatgtattgaataaatatttttaatatttgtaacacatatatgatatcacatagtcattagatataaaatagcaaatacttaaaaaaacagcaatatctaagctggaaaattaattattgaaaattagttaagaaaatcgacatcttaaacgttatatggtagtataaaagtaatcataggaatactcattgccttttatgggtagagaaagggagagaagttgaaggaaatttatgacaaaataaaagagattaatgtcactttgaaaagatcatttatcgatctcgaaaaatcattaccttatcaagatgttgcggagaaaagtgctaaaattttagaatgtacactttttatgatagatacaaaacgcaattttcttggttacggtttttctgaaaaattctatcagtctgatatgaacctccagaacttttttacttatcaaaaaatttccaaagaactatctacagaaattttaaatcaatatgaaatgagtgaaagcgaacaaatgactcattcaattttgaaatcagtaaaagaactctcaggaaaatttgctaatcaatatttgactcttattcctattgaagggaatcatctaagattaggaactgtttttctcttgactgatgcaccattaaatcaagaagaagcaatcttggcagattttctatcaacatttatcggaaatcaaatgtcttatattatgctgtcagagctggaaaccaaacggcgaaatgaaacctttgtttcattggttcaatccttatctcgttcagaattagaagcctttaaaagtattattgaaaaaattgaatgataagctagataagccttgaaaatttctacaataaatagtataatagaaataatggtttgtcagcaaaatctgtgggatatattgtccccataggctttgtaagcaacgaaacactactgttttcgttgcttttttggcgtcttttatattgaataaaccagaaaagttattaaaaagacaaactactgacttttcggtttttttaattaaaaattcatcaaaaacacagacttttttaatcaaatctaaaaaatagaggagaaaacacttggcaggacatgacataaaatacggtaaacaccgtacaagacggagtttttcacgtattaaagaagtaatcggtttgccaaacctcatcgaagttcaaacattaagttataaaaacttcctcgatgaaggtcttgcaaatgtcttcaaagaaatgtttccaatcgacaactttgcgggtacaatggaactcgaatttgttggttatgaaatgaaaaccccaaaatacactgttgaagaagctcgcgcacatgacgcaaactattcagcacctatctatgtaaccttccgtcttgtaaataaagaaactggtgaattaaaaacacaagaagtcttctttggtgacttcccactcatgactgaaatggggacatttatcaataatggttcagaacgtttgatcgtcagtcagttggtacgtagtccaggttcatatttccaccttaaaacggataaaaatggtcttgaaagttttggacataccacaattcctaaccgtggagcttggtttgagttggatacagatgctaaaggcattggttatgttcgtattgatcgtactcgtaaattaactttcacaacaatgcttcgtgcgcttggatttggttcagatgacgaaatccttgaattgttgggtgaaactcaacttttgacagacacaattgcaaaagatgttcataaaaatccagctgacactcgtgtagaagaagccctcaaagacatctatgaccgcttgcgtccaggagaaccaaaaacagcagacagctcacgtggcttacttgttgcgcgtttcttcgatccaaaacgttatgattttgctcctgttggacgttataaatttaacaaaaaactagctcttaaaaatcgtttgcttggtttgactttggctgagccaattgttgatccagaaactggcgaaattcttgttaatacagatacacttgtgactcgtgacgtgctcgatttaatcgaaccattgcttgataatggtcttggaaacttcgttgttgaaccttctgacgatgcagtaattccagaaccaatcactttgcaaagtattaaagtttattctcctaaagattcagaacgtgttgtgacattgctctcaaatggtaatccagattcagaatgtcgtgtcttgacaccagccgatgttatttcaaacatcagctactggcttggacttgctgaaggaattggtaaagtagacgatattgaccacttaggtaaccgtcgtattcgttcagttggtgaattacttcaaaaccaagtacgtatcggactttcacgtatggaacgtgtcattcgtgaacgtatgtcatcttcagaaaacgaaaatatcacaccgcaaggtttgattaacattcgtcctgtaacagcttcaatcaaagaattctttggttcatcacagttgtcacaatttatggaccaacataatcctttgtctgagctttcacacaaacgtcgtttctctgccttaggacctggtggtatctctcgtgaccgtgcttcatatgaagtgcgtgacgttcactacactcactatggccgtatgtgtcctattgaaacacctgaaggaccaaacatcggtttgattaacaacttgtcatcatatgccaaagttaatgaatatggtttcatcatgtcaccatatcgtcgtgttgaccgtgtgaatggaattgttactgacgaagttgaatatttgactgccgatgaagaagataactacactgtagcccaagcgaactcaccattgactgatgacagtcgttttgctaacgaaacagttatggctcgtcatacaggtaacaatattgaagttgaagcttcaacagctgactatatggatgtttcacctaaacaggttatcgccgtcgctgctgcttgtattcctttcttggaaaacgatgactccaaccgtgccctcatgggtgccaacatgcaacgtcaagcagttccattgattgacccacatgcaccttggattggtactggtatggaacatcaaaccgctcgcgactcaggagctgcccttcttgctaagcatgcaggtgtagttgaatatgttgacggtaatgaaatccgtgttcgccgtacatctggtgaacttgatatttacaatattacaaaatatcgtcgttctaactcaggaacttcttataatcaacgtccattggctcgtcttggcgaaaaagttgaaaaaaacgacatcatcgctgacggtccatctatggaaaatggagaaatggcccttggtcaaaatccactcgttgcctatatgacttgggaaggttataactttgaggatgccgtaatcatgtctgaacgtttgattaaagatgacgtttatacatcaatcgcaatcgaagaatatgaatcagagactcgcgatacaaaacttggccctgaagaaattacacgcgaaattccaaacgtcggggatgaagcactcaaaaaccttgatgaatcaggaattatccgtattggtgccgaagttaaagatggtgatttgcttgttggtaaagtaacacctaagggtgaaactgacccaacaccagaagaacgtttgcttcgtgcaatcttcggtgaaaaagctcgtgaagttcgtgatacttcacttcgtgttcctcacggtggaggcggtatcgttcatgacgttcgcgtatttacccgtgaaaatggtgatgaattaccatcaggtgtgaataaactcgttcgtgtcttcattgctcaaaaacgtaagattcacgttggggataaaatggccggtcgtcacggtaacaaaggggttgtttcaaatatcgttcccgtggaagatatgccttacttaccagatggaacaccgattgatatcatgttgaacccacttggggtaccatcacggatgaatattggacaagttatggagctccatttaggtatggctgctcgtacacttggtattcacattgcgacaccagtgtttgatggagcctctgatgaagatatctgggatactgttaaagaagctggtatggctgctgatgcgaaaacagttctctatgacggacgtactggtgaaccatttgataaccgaatttcagtcggtgtcatgtacatgattaaacttcaccacatggttgatgataaactccatgcacgttcagttggtccttactcactcgttacacaacaaccgctcggtggtaaagcacagttcggtggacaacgtttcggggaaatggaagtttgggcgcttgaagcttatggtgctgccaatgttcttcaagaaatcttaacttacaaatcagatgacgtaattggacgtacgcgcgcctatgaagctatcgttaagggtgaacgtattcctaaaccaggtcttcctgaatcattccgcgtattggttaaagaattacaatcacttggtcttgatatgaaagtcttcgatgctgatcgtaatgttcttgacttgcgtgaattggatgaagatgaagtaatgactcgtccagataatacagaaattactccggaaatgcttgaagcacaagaagcaattgttgcacaagcagaagctgaagaagaagctttgattaacgctgatattgaaaaataagattttgtaattaatatttggagagggatttactgacaaaaattctgtcagtaaatctctaatctcaaaatcgtctagcgttaaatttattagaagtggagaaagaattggttgatgtaaataaatttgagagtatgcgtattggtatcgcatctccacaaaaaattcgttactggtcattcggtgaagtaaaaaaaccagaaacaattaactatcgtacacaaaaacctgaacgtgaaggactctttgacgaacgtattttcggtcctcaaaaagactgggaatgtgcttgtggaaaacttaaaggtgttttctataagaatcaagtctgtgaactttgtggtgttcaagtaacaactgcaaaatcacgtcgtgaacgtatgggacatattgagcttgctgctccaatttcacatatttggtatttcaagggaattccatcacgtatgggactcgctctgaatatgagcccgcgtgcacttgaagaagtaatttacttcgcaagttatgtggtaattgatccaaaagaaactgatcttgagaaaaaacaactcttgactgagcgtgaatatcgtgaacaacttttgaaaaatggttttggttcattcgttgcaaaaatgggtgctgaagcaattcaagatttgttgaatgatgttgatattgacaaagaagttgctgaactcaaagaagaactcaaaacagtgactggacaacgtcgtgtaaaaattattcgtcgtttagatgttttgtcagctttcagaaaatcaggaaatgctttatcttggatggtcttaaacgtattaccagttattccaccagatttgcgtccaatggttcaattagatggtggacgttttgccacatctgacttgaatgacttgtatcgtcgtgttatcaaccgtaataaccgtttgaaacgtttgatggaacttaatgctccaaatattatcgttcaaaatgaaaaacggatgctccaagaagctgttgatactttgattgacaatggtcgtcgtggtcgtccaatcactggtgctggtaaccgtccattgaaatctctttcacacatgttgaaagggaaacaaggacgtttccgtcaaaacttgcttggtaaacgtgttgactattctggacgttcagttatcgctgtcggtccaacacttaaaatgtaccaatgtggtgttccacgtgaaatggcgattgagttgttcaaaccatttgtaatggcacaacttgttaaaaaagaattggctgctaatattcgtgcggctaaacgtaaagttgaacgtcaagattcagacgtttgggatgtacttgaaacggttgttaaagaacaccctgttctccttaaccgcgcacctacgcttcaccgtttggggattcaagcttttgaaccagtcttaattgatggtaaagccatccgtcttcacccacttgcttgtgaagcctataacgccgactttgacggtgaccaaatggccattcacttgccattgtctgaagaagcacaagctgaagcacgtcttttgatgcttgctgctgaacatatcttgaaccctaaagatggtaaaccagttgttacaccatcacaagatatggtccttggtaactactaccttacaatggaagaaaaaggtcgtgaaggcgaaggaatgatttttgcaactcctgaagaagttgaaatcgcaatgcgtaacggttatgtacacttgcatacacgtatcggtatcgcgacaaaatcactcaataagccttggactgaaaatcaacaagataaaatcttggtaaccactgttggtaaagttattttcaactcaatcattccagaaggaatgccttacttgaatgaaccaactgatgttaacttgacaacttcaactgatgaccgtttctttatggatgctggtcaaaacatcaaagaagttttggctggaatcgatactgttcgtccattcaaaaaaggatatcttggaaatattatcgccgaagtattcaaacgttaccgtacaacagctacatctgagtaccttgaccgtttgaaagaccttggttaccaccaatctactttggctggtttgactgtgggtatcgctgatattcctgttgttgaagataaacatgaaatcattgatgctgcgcataaacgcgtagaacaaatcactaaacaattccgtcgcggtttgattactgatgatgaacgttataatgccgttactggtgtttggcgtgatgcaaaagagtctctcgaaaaacgattgattgaagaacaagatttgacaaacccaatcgttatgatgatggattctggagcccgtggtaatatttctaacttctctcaacttgctggtatgcgtggattgatggctgctcctaatggtaaaatcatggaattgcctatcatctctaacttccgtgaaggactttctgtcttggaaatgttcttctcaactcacggtgctcgtaaagggatgaccgatacggcccttaagacagccgactcaggttaccttactcgtcgtttggttgacgttgctcaagatgttatcattcgtgaagatgactgtggtactgaccgcggacttgtgattgctgatattgcaactggtaaagaaatggttgaaccactctttgaacgtttggttggtcgttacactcgtaaatcagtccttcatccagaaactggtgaaatgattattggcgatgatactttgatttctgaagatattgctcgtaaaatcattgaagctggcgttaaagaagtaacaatccgttcagtatttacatgtaaaacaccacatggtgtatgtaaacattgttatggtatcaacttggcaacaggtgatgctgttgaagttggtgaagctgttggtacaatcgccgctcaatctatcggtgaacctggtactcagttgacaatgcgtacattccacacgggtggtgttgcgtcaagttcagatattactcaaggtttgcctcgtgtccaagaaatctttgaagcacgtaaccctaaaggggaagcaatcatcactgaagtaactggtacagttgaatcaatcgttgaagatggcgcaactcgtactcgtgaaattactgtcaaaggtaaaacagatactcgtagctacactgtaggtatggctgatgtcttgatggttgaagaaggcgaatttatccaccgtggtgcgcctttgattcaaggttctattgaacctaaacatttgcttcaagttcgtgatgctttgtcagtggaaacttacttgctcggtgaagttcaaaaaacttaccgttcacaaggggttgaaattggtgacaagcacatcgaggtaatggttcgccaaatgcttcgtaaagttcgtatcatggacaatggttcaattgatgtgcttccaggtactttgatggacatttctgattttgaagctttgaatgaaactgcactcttgaatggtgaaatgcctgcaactggtcgtccagtcttgatgggtattactaaagcctctcttgaaacaaattcattcttgtcagctgcgtcattccaagaaacaactcgtgtccttactgatgccgcaattcgtggtaaagaagaccatttgcttggtttgaaagaaaatgttattatcggtaagattattcctgctggtacaggtatgttccgttaccgtaacatcgaacctttagctgatttgacaaatgctccagaagtaaaagaagttgaaacagaaactgtggaaaactagttttaaatcttgaaattaaataaaaagttactgatgaaattttgtcagtaactttttttattaaatttactgacaaaatcattaaaaacataaaatctctgtcatttttggtaaaataattctatgacttattatctccttgcaaatcccaattctggtgcaggtaaaggtgcatgaacattggagattctgattccatatttggaaaaaaataattatgattatcgactttttaaaactaatgctcctagtgaagaaggggatttagtaaaacaaatattagaacttaaagtggctgaagaccatttagtgattataggcggtgatgggaccatttcgcttgttataaatgaacttccagaagaagaagcattttcgtatattccatcaggttcaggtaatgattttgctagaagcttgaacttaattcttgacccaattgaatcttttgaggctgctcgtagtggaatgaatcatgaaatttttattatgaattatcaatctaaaggattgaatggctatgctttaaataatattgggattggattagatgcggcgatagtacaagctgccaatgaaggaaaacttaagcaatttctaaataaattaaagctagggagtttttcttatattttgaccgctttacatgttttaatcactaaaaaagcatttccggctttgattgagatagaaaatcagcaaatatctttagaaaaaactttcctgatgacttttactaaacatccatattttggaggaggggtaaaaatttccccagaagcttccaaccaaaatgcagatattcatttggtagaatacagtaaacactctttgtttcgaactttttccttgattccgagtgttcttcgtggaactcatttaaaacatcctttatttctccatcgtgttaatccacacttttccgtagaactagcagaaagtcaacccgtacaaattgatggagaaattcatcatttagctgccgctgacagactttccatcagtaccgaaaaacgaatgattatttactgacagaataaaaactccgtaattctcacaacttagggttattaatagaggtcaaaatatgaaaattgggtatgcacgtgtcagtacttttgaacaaaaattagaatctcaaattgaagttctgaaagaagcaggagcagaagaagttttccaagaaaagtttactggaactacagtcgaacgtccacaatttaatctagtatttaaaaagttaaaggatggtgacactttaattgtgacaaagttagaccgattagccaggaacactagagaagttttagaaattgttcaatcgttatttaatagaggaattaaggttcatatattaaatattggtcttattgataatacacctactggtcagctgatttttaccatcttcagtgcttttgcgcagtttgaacgagaccttattgtaaccaggactcaggaaggaaaaaattttgctaagcttcatgatccaagttttagggaagggcgtcctcaaaaatttaccgaagaacaaattcaatttgcttatgagttaaaacagcaaggaatgacttacaagatgattgagcgaaaaactggtatcagtattgcgactcaaaaacgaagatttataaaagcaaaaaatcaagctattgacaaagactattgaaatgttataatttagttaacgaagatttgtgggagtggtatctcacaataggaactgaggaactgcgaattcctcagtttttttgtacaaaaaacgcccagttctgcgaaactgagcgaatgtggattaatggcgcttatatcggtattttaaccaatccttgaccagctcaaggattactccaaccacaataggagcgactactgatacgaagatttgcagaagcattatctcaccccctccctaaggcatttctgcattggtaaggtacgccactaaaaagtataaaaagggaatagatatgttcgtagtaggagatatccaattatcaagaaaactccaattttttggaaagttaaataatgtgtacatattttcgacaaaccatacattagaaataacaaaaaaacaccgtagaattgtttgattcatacggtgctttttttatgtctaattatttaagagtagtccaatatttttataagtcataattctagtccgcttttaaaatagtagtgtactggctaaattcctctaagtgttgagggctaatctggttatctgtaatgatggtatcgagttgatctagattgtagaagttaaagaaatcgtatcgatcgaatttagtactgtctactaataagaatttttctacagcattgtttagggcaagttgttgaatcacaccttccttgtcactatatgtagcaatagaattatgggtaacagcatttgcactaacaaaagctttggcaaatctcattgcttttaaatttgtcgaagccattgaacctacaaaagctccagttatttctctatattcaccgccaagaagcaataaatcaatggtttcgctatcatttagaatcaagaacacagggagactatttgtaatgacacgaattttataacctttacgacctttcaattctaatgccagttgtacaagtgtagttccgggtccaataaaaatagtatcgccatctttgattaaagagcaggcttttttagcaatgtcaattttttcttttgtatttagacttttcttctcgatatgtgtcttttcaagtggctttttagaggaaagcaattgtgcaccaccatgagtacgtgttaaaagtccatcagcttctagagcatcaaggtctctacgggctgtcatatcggaaatatctagttcatctattatttcttttatggttatggtcccatcaatctttaacatatctaaaattttttctaatcgtcgttttttgttcatatgaagacttttctttcataaagtaatttttttccaaagataattctcttttaattgtatcataaaagataatattttcaaggtaaaacaaacaatttcaaacaaaaacaaacgttagatgatgaaataagaacagaggattgacgtatattagcttaggtcagattttgtataagacgaaaataaagtaggacctcttaatcattaagttatagaaagtaaaagacttttgtaatacctgaatagatatttcacgtccattttgtgatggattaaatgaacaaaaatgaacaataatttaacggtgttatctattttttaaaaaaacaaataaaaaaaaacaaaaaattaacaaaaatagttgctttttgtttgaatgtttgatatcatataaacaaagaaatgatgaaaacgttatcttgaacattttgcaaaatattttctacttctacgtagcatttctttttaaaatttaggaggtagtccaaatggctattgttgttggtgcagatctcaaaggtacgagattaaaagatgttgtgaaaaattttcttgtagaagaaggttttgaggtaattgatgtgactaaggacggacaagattttgttgatgttaccttggcagttgcctctgaagtaaataaagatgagcaaaacttaggtattgtaattgatgcttatggagctggtccattcatggtagcaactaaaattaaaggtatggttgcagcagaagtttcagatgaacgctcagcttatatgacacgtggacataacaatgcacgaatgattacggttggcgctgaaatcgtcggtgatgagcttgctaaaaacatcgctaaagctttcgtcaatggtaaatatgatggcggacgtcatcaagtccgagtagatatgcttaacaagatgtgttaagaaaaggagttaaaaaatgagaatcgcaattggatgtgaccacattgtcacagatgtaaaaatggcagtatcagaattcttgaaatcaaaaggatatgaggtccttgatttcgggacatatgaccacgtacgtactcactaccctatctatggtaaaaaagtcggtgaagcagtagtaagtggtcaagcagacttgggagtatgtatctgtggtacgggtgtcggcattaacaatgcagtaaataaagttccaggtgttcgctcagcgttggttcgtgatatgacgtcagctctatatgctaaggaagaacttaatgcgaatgttatcggttttggtggaatgattactggtggtcttcttatgaatgacatcattgaagctttcattgaagctgagtacaaaccaacagaagaaaataaaaaattgattgcaaaaatcgaacacgttgaaacacataatgcacatcaagcagatgaggaattctttacagaattccttgaaaaatgggaccgtggtgagtaccacgattaaggtataaccaatgattctgacagtcacactaaatccttcagtagacatctcttatcctctagaaacattgaaaattgatacagtgaatagggtgaaagatgttagtaagacagctggtggaaaaggcttaaatgttactagagtcttgtatgaatctggtgataaagttactgctacaggtttcttaggtggtaaaattggtgaatttattgaaagcgaattagaacaatctcctgttagtccagctttttataaaatctcaggaaacactagaaactgtattgctatcttacacgagggtaaccaaacagaaattttggaacaaggaccaacaatttctcatgaagaagcagaaggctttcttgaccactatagcaatcttattaagcaatcagaagttgtcacaatttcaggaagtttgccttcaggacttcccaacgattattatgaaaaacttatccaacttgcttcggatgaaggagtagcagtcgttttggattgttcaggtgcaccacttgaaacagttctaaaatcgtcggctaaacctactgccatcaaacctaataatgaggaactttcacagttgcttggaaaagaagtaacaaaagatattgaagaactcaaagacgttcttaaagagtcactttttagtggtatcgaatggatagtggtctcattaggtcgaaacggtgcctttgcaaaacatggtgatgttttctataaggtagatattcctgatatcccagttgttaatccagtcggatcaggggactcaacggtagctggtattgcatcagctttaaatagtaaaaaaagtgacgctgacttattaaaacatgcgatgacattgggtatgttaaatgctcaagaaacaatgacagggcatgtgaatatgactaattacgaaacactaaactcacaaattggagtaaaagaggtataaaaatggtacttacagaacagaaacgcaaatctttggaaaaactttcagataaaaacggttttatctcagctttggcatttgaccaacgtggtgctttgaaacgtttgatggcacagtatcaagatacagaaccaactgtagctcaaatggaagaactaaaggttttggttgctgatgaacttacaaaatacgcttcttcaatgttgcttgaccctgaatatggacttccagcaacaaaagcattggataaagaagcaggtcttcttcttgcctatgaaaaaacaggttatgatacatcaagtacaaaacgtttgcctgactgcttggatgtttggtctgcaaagcgtatcaaagagcaaggcgctgatgccgttaagttcttgctttactatgatgtagacagctcagatgaacttaaccaacaaaaacaagcttatattgaacgtgttggttctgaatgtgtcgctgaagatattcctttcttcttggaaatccttgcttatgatgaagaaatctcagatgcaggttccgttgaatatgcaaaagtgaaacctcgcaaagtcattgaagcgatgaaagttttctctgatccacgatttaacattgatgttcttaaagtagaagtaccagttaacgttaaatatgtcgaaggttttgctgatggtgaagtggtttacagtaaagctgaagctgctgacttctttaaagcacaagaagaagcgactaaccttccatacatctacctaagtgcaggtgtatctgctaaattgttccaagaaacattgcaatttgctcacgactcaggtgccaagtttaatggtgtgctttgtggacgtgctacttgggcaggatctgtagaaccttacatcaaagaaggtgaaaaagcagcacgtgaatggttgcgtactactggattcgaaaatattgatgaacttaacaaagttcttgttaaaacagctagtccatggactgataaagtatagtaaaaacataaaacggaggatattgttgtgaacagagaagagatgactctcttggggtttgaaattgttgcttatgctggagatgctcgctccaaacttttagaagcgcttaaagcggctgaaaatggtgatttcgctaaggcagatagtcttgtagtagaagcaggaagttgcattgcagaggctcacaattctcagacagctatgttggctcgagaagcttctggggaggaacttccatacagtgttactatgatgcatggtcaggatcacttgatgactacgatcttattaaaagatgtgatgcatcacctcatcgaactttataaaagaggagcaaagtaattaatgcataaactcattgaacttattgagaaagggaaaccattctttgagaaaatctctcgaaacatctatcttcgtgctattcgtgatggatttattgctggtatgccagtcatccttttctcatctatctttatccttattgcctatgtcccaaatgcttggggattccactggtcaaaagacattgagaccttcttgatgactccttatagctattcgatgggtatcctagcattctttgttggtggtactaccgctaaagctttgacggactcaaagaaccgtgacctacctgcgaccaatcagattaacttcttatctacgatgctagcgtctatggtagggttccttttgatggcagctgagcctgcaaaagaaggaggcttcttgacagccttcatgggaacaaaaggccttttgacagcatttatcgcagcctttgtgacagttaatgtttataaagtctgtgtgaaaaataatgttaccattcgtatgcctgaagatgttccaccaaatatctctcaagtatttaaggacttgattccgttcaccgtctcagttgttctcctatatggacttgaactccttgttaagggaactcttggtgtaactgttgcagaatcaatcggtacccttattgctcctcttttctcagctgcagatggttaccttggaattacacttatctttggtgcttatgccttcttctggtttgttggtattcacggtccttcaattgtcgaaccagcaatcgctgctatcacttatgccaatatcgatgtcaacttgcatcttatccaagctggacaacatgcagataaagttatcacttctggtactcaaatgtttattgctaccatgggtggaacaggagctacattgattgttccattcttgttcatgtggatttgtaaatcagatcgtaaccgtgccatcggacgtgcctcagttgttccaacattctttggggttaatgagccaatcttatttggtgcaccaatcgtattgaatccgattttctttgtaccgttcattttcactccgattgtcaacgtttggatctttaaattctttgttgacacattgaacatgaactcattctctgccaaccttccatgggttactcctggtccgttgggaattgtactcggtactaacttccaagttctatcatttatcttagccggactcttggtagttgttgatactatcatttattacccatttgttaaggtatacgatgaacaaattcttgaagaagaacgttctggtaaaacaaacgatgctcttaaagaaaaagtagctgaaaacttcaatactgctaaagcagatgccgttcttggaaaagcaggcgttgctaaagaagatgtagcagcaaacaataatatcacaaaagaaactaatgtccttgttctttgtgcaggtggaggtacaagtggcttgcttgccaatgccttgaacaaagcagcagcagaatacaatgttccagtcaaggcggcagcgggtggttacggtgctcaccgtgaaatgttgccagagtttgacttggtaatcttggctccacaggtcgcttcaaacttcgatgatatgaaggctgaaacagataaattgggcattaaacttgtaaaaactgaaggagctcaatatatcaaattgacacgtgacggaaaaggtgctcttgcatttgttcaacaacagtttgattaataaatttgtaaaagttatttgagacgagatcactcattccatttccttggttttcagaacacagaatctcgtctcaaatgctttttttgaaaggacttacacttatgactaaaacacttcctaaagattttatttttggtggtgctacagctgcttatcaagcagaaggtgcaactcacacagatggtaagggcccagtagcatgggataagtatcttgcagacaattattggtatacagcagaacctgcaagtgatttttaccataaatacccagttgatttagaattagctgaagaatatggtgttaatggtattcgtatttctattgcctggtctcgtattttcccaacgggttacggtgaagtaaatgaaaaaggtgttgaattctaccataaactatttgctgaatgccacaagcgtcatgttgaaccatttgtgactttgcatcattttgacacaccagaatctcttcattcaaatggagatttcttaaaccgcgaaaatatagaacactttatagattatgccgctttctgttttgaagagtttccagaagtaaactactggacaactttcaatgaaattggcccaattggtgatggtcaatacttggttggtaaattccctccaggcattaaatatgatcttgccaaagtcttccaatcacaccacaacatgatggtctctcatgcacgtgctgtaaaattgtataaggataaaggttataaaggtgaaattggtgttgttcatgctttaccaactaaatacccttatgatccggaaaatccagcagatgttcgtgctgctgaacttgaagacatcatccataacaaatttatcttggatgcaacctatcttgggcactattcagataaaacgatggaaggtgtcaaccatatcctagctgagaatggtggagaacttgatcttcgtgatgaagacttccaagctcttgacgcagctaaagatttgaatgatttccttggtatcaactattacatgagtgattggatgcaagcttttgatggtgagactgaaatcattcacaatggtaagggtgaaaaaggaagctctaagtaccaaattaagggtgttggtcgtcgagtagctcctgactatgttccgcgcacagactgggattggattatttatcctgaaggcttgtatgaccaaatcatgcgagtgaaaaatgattatccgaattacaagaagatttacatcactgaaaacggtctcggatacaaagatgagtttgtagataatactgtttatgatgatggtcgtattgattacgtgaagcaacacttggaagttttatcagacgcgattgcggatggtgcaaatgttaaaggttacttcatttggtcacttatggacgttttctcatggtcaaatggttatgaaaaacgttatggattgttctatgtagactttgatacgcaagaacgctatcctaagaaatcagcacattggtataagaaattagcagaaactcaagtgatagagtaatatcacctgagaatgtaataatttgttatctgatttttagatcaggctttgaaaaggtatatattattaatttcgaagattgtcctataattcctgagcttgaagctacctcactacaaaatgtagtaactggtatgtttcacctggaaaagaatggatttgccattctgatttagcattatccgaatttgaatgggaagttttacaattactcgatgtagcaatatgtgagactgttcacttcgaggtagattatttgcctttccaataacaaaaagaaaggaattgactgtgactatcgaattaaaaaacgagtatcttacggttcagtttaaaacacttggtggtcaactgacttcgattaaagacaaagatgggttagaatatctctggcaagctgatccagagtattggaatggacaggcaccaattctatttcctatctgtggtagtttacgtaatgattgggctatttatagacctcaagaaagacctttttttacaggtctaattcgtagacatggttttgttcgaaaagaagaatttactcttgaagaagttaatgaaaatagcgtgactttcagtattaaaccaaatgctgagatgcttgataattacctttatcagtttgaactaagagttgtttataccttaaatgggaaatccattagaaccgagtttcaggtaacgaacttggaaactgaaaaaacgatgccttacttcattggagcccatccagcattcaattgtcctttagtagaaggcgaaaagtatgaggactattctcttgaatttagtgaggttgagtcttgttcgataccaaagagtttccctgagacagggttattagatttacaagatcggacgccatttttggaaaaccaaaagtctcttgatttggattactcacttttttctcatgatgccattacacttgaccgactgaaatctcgcagcgtgacacttcgctcgagaaagtctggtaaaggtcttcgagttgattttgatgattttccaaacttgattctgtggtctacaaccaataaaagtccattcattgccttagaaccttggagtgggctttccacttcacttgaagaaggtaatattttagaagataaacgacaggtaacgaaagttttacctctagatacttctaaaaagtcctatgacattacgatctttaattaaaatctgttataattttagtcttaaataaaatttgaatacgtttgccttgtggttatagattggtcttcttcgtgccaatcttacatcgcaaggtttttaagttttttatgggtctatgtcaactgtagtgggtgacgaaaagctaatgatgtaaaaaagatgatcaatagcgtacaagatgaaaccaaaaaggacatcagacagctacaaaaacaaatcagaaaatagttggggtacggaggaaatcataacgttaagagaatttaaaaattttattctacgaggaaatgtattagacttagcagttggggtaattattgggtccgcatttactggattagtaacttctggactacaatcaaatatttaaacacaaaatgaacaatatttttcgaaaataatttttgagttcagttttaaataaatatttccatcaaaaatctcagtcattaattttaaaatctccatagtaaaatttacttctgactgaaagagatttctcattataaaaaagaaaaaatttttaaaagggaatttaatgattttcactctagaaataataagtttcggaaaaattgttgtttttccgaaacttattatcaacataaaacgcatggttaagcggttttagtttttcaaaggtttacaaaagcaaaaaaagcacctattatggcaactttatgagagtatgagagtgttttttaattagccttaacatagtgcaaaaaggatattctgatttttaacacgattcgtcagagtatcctttttttattgattatttttgtgcgtccatttcaagtaatgtgttataatcgttttatattttagatatccctaaaatatattcctttctatcgtgctgccttccttttggaactccgaaggcagttttttaaaatagaggaagtgacaaaaaaaagaagttgtgataaaataaaggtaaagaaaaaagagcttgcactaacaagctctaatgtatccgttttaagaacggtagcactacatacatcaaaatggcctaatgcgtgctaagctgaacggtcattttttattacttgtatttatcacaagaatcatcaaggtcgcaaaagcaatcatgagactcaatgcctgaaatacagtaaaaaaattttcgcctttcatgttttgtgagggtttgcccacgaaataatcataagcaccacctccaatcaggctaccgttcataaactctacaaacattattataacaaaaaaagccccgtaagtcatagacttacagggcttttgaaatattcattaaaaccttgggccggcaaaggttaaagtcatttcagggtgggatttataatgtcccacaacatcaactctccattctcctctcaggatttgacacataatagggaaggcctttttaaagcgaacgagttcatcattataagttgctgaagtaaatggtcgtgcctggtctaaggtcatcaataaacgagggtctggagtatcgcaaatcaggtcatgacaataaaactgattgaagcggtcaatgacaaagtatccactatttattttttcaaagcagtccttacaaaaggctgactttttataatagtgccagccttcttatttgaaatattttttagcggcacttttatttgttgcccacaggggaagttaaaattcaaagccatcagggtcggtatatgtttttccgtctgaaaattgacttaacgtcagcagtttttagtatgattactgcttttattatttactctaaaactgttgttttacctttgtgtcggtagattgtcgttcttttgtcgttcttttgtcgtctatctgtcgtgtacatgtttaaaaaaatagtttattatatattcattctgaacttcacgatagcttagattgtaacgcaggtagtaaccaacagcgacaataatgacgtcttttttgaattgtttgcctttaaaatgattcattactctgtcctctctgtcttttttctcaattttacactaaaatagattttttggaaaactttgcaacagaaccaaatatttgagcaattcttgccctgtaaaataatttgataaatcgtgctctctgacgagaaaattgaaccttttctcagcccatttccaagttcggtcactaattgtcttaattagacgaaagggaagctgagaactataaatgatatgggcctcagctttgtgtttccaaagaataggaagcataatatcggcaagaatttccagagagacttcctcacaattgtacagcagcaattgctggttgacttcatcaacaatgtttaaataaatatattctacaatgctgggaaccccatttttaaaattgtttgtaattgttgttcgagtgatgtgtgagcgtttggcgatttcttcaatgtttatcttgccattttcggaagcgatgtttaagaggctgcgaacgataatttctttcgtatcttttgtcatttcaattcccattttatactcaaatgaagcataaaatcctttcttttatgggaggattcttctaaatatcaaaaaataaaaataatctgtttcagttagtttttcttattttttgaatattatagcattattttattcaaaaattaattgttttgattaatttttagtttgataaaaatttttacaaagtatttcgttttgtgtaatatataagtgttgatagttttgacagagcgctttgaaaaaatgaaatcaattaattaaatgaaaggaaaatatggtgaaggtttatcaaaaagaaaatgtttacgaagcttttaatcatagattagattatatttgtgattattttgaccatcttattatctctttttctggtggtaaagattcaggattgatattggaattggtttatctttattataaaagccataaattggtcgaaaaaggaataaaggtttcagttttctatttggattatgaaggaaattatcaagaaaccaaagattatattcatcgttcgatgggaaaatatcctgagtttgaatattatcatatttgtttgcctgtttcggcttcttgtggaatttcaatgtcacaatcgacttggttaccttgggacccagaccataaggaattgtggttgaatactattcctaaaggagccattcatttagaaaatcaagatttttcatttttcaaagttggaatgtcagattatgattttcaaagtaaattttgtcagtggcttcataatgaaaaaggggcgactacaacggctgttttggttggaatacgtgcccaagaaagtttgaatcgttataatgcggtgacacgagatgaaacattctcacgatttggaacaacaaattacagtcatcgtattagtaaagatgtctttaatttctacccaatgtatgattggttatttgcagatatttggcgagcgaatgctaaatttgagtttgattataatcacctctatgacttatattatcaagcgggtgtgccttttaaatcgatgcgagtcgctaaccctttccatcagtgtggcgttcattcgcttaaactttgtcaagctttagaacctgaaacatgggggaagttggtgggacgagtcaatggggcaaactttgcggccctttatggaggaacgcaagcgatgggatatcgtggagcggtcctacccaaaggtcatacttggcagtcttacgttgaatttctactggatactttgccggaagaaaccagaaatgtatatcgtaaaaagttccaatcatcaatggactattggatgagaaccggtggggcattaccggtaaatgtcgtcgaggaattgaaaacaagcggattggattttgaatgtttgggggctccaaccaataaacgcaaatataaacagtcctatgagcttattcgttttaagaactatccagatgatgtacctattaaaaattttacattggtgccctcatataagaggatgtgcattacaattttgaaaaatgacacttcttgtcagtatatgggttttggtcaaacgaaagatgaattacaaaagaaacaagaggcaatggaaaaatgggagacatttttataagcccagcttatcaaattaaacgagtgcttatcgagaagattagggccaatacttataatccgaatcgaacagcacctcctgaatttcgtctactggaacgttctattttggaagatggctatacgatgcctatcgtttgttattacataaggaaaaggatttttatgagattgttgatggatttcatcgctatttggtcatgaaaaggtcagaagaaattgctcaacgggaaggaaattgcttacctgtttcaattatagaccggccacttgaaaatcgaattgccagtactattcgtcacaatcgagctagaggaacacattcaattgagttaatgacagaaattgttcagcagttggtggaatcgggtttgagtgatcagtggattatgaaacacattggaatggacaaagaagagttgcttcgcttgaaacaactcagcggtctggcttcactttttcaaaatcaagacttttctcgttcttggacatggaaggaagatgaagagataagtgaagaatagatttattagaaaagaaaaggaaaactacaatggtacaagaatatttatttgtttactctagattaaaattattaatcaaagaagctcataagtcttttaatcaagttgaacgagaattaggttatcctcgaaatactttgaaaaattataaatacaagaaaaaaccaagtgttggtcgtgttttcgaaatggcaaattattttaatgtttcgattgaatttttattaggaatggaagaagagacagataaaacgagtttaacttatcgtttggaaaaaataaatcgggagaaaaaagagctcgaaattttgcttttagaaaaagaaatttagagtttatgcgataaatcttatagacgctaaaatgtttacgttaagggattgacacttttttgtaaatgatatattattatcttagttaaaggaatgctatgatgaagtgttcatttaacttcttttcttacatagtattggggataggtctattgatttattctctagaggttctttcctatggagagaaccttttattttgagataaaagtaacagattaaatcttaaattagggcttatgttataatagataatatattgaatagaaaaagggatatttatggaagaaaagaaaccttcaggaatgtttgcggtttttgcggcacttggagcaaatgttttagtggcaattagcaagtttattggttttggtttatcaggttcggctgcgatgttaaatgaaagtattcactcggtggtggattgtggaaatcaaattttacttttatttggtgaccgtcggtcaaaacaagcaagtacaaatttgcatcaatttggtgaggcacgtgcgaaatatttctttagtatgattgtggcaactttcctattttttggtggtggggttatcggagtcatggaggcttacgataagcttgttcatccagcccacactgtagaaaatactggaattattattggaattttactgataggtatgctcattgagggttcttcactaagaattgcctttaaagaaattggtgaattaaacacggaaaaattgcctattttcaaatttttacatgagagtcgtcatagtgaaattttagttatttttactgaggatttgtgtgcaatcattggtttacttttggctcttttagggactgttttaacaatggttactggcaatcctatctttgatgcaattagtggtttgttgattggattcttattgatggctgctgcgattttcttgactagagaattttatagtttgattgttggggaacgtgtgacagacagtgatttagagaagattttatctgcctttgaacgttctgaggttgaacgagtaattaatgtcaaaacggttcatctgggtccaacagaaatcttgattgcggctaaaattgatttggtcagcaaacttgtgttagaggattatgaaattataaatcagattgaagctgaaattagaaagaaaattagcgataagaagtgctatatttatattgaaattgacgaatttgttcaagactatgttcaatcttctgatttataagcataatttactgacagaaatattttaatgaggagaaaagaaggagagggcctatgaaaaatttttttaatcatattgaactgaaatttgctaatcttttatcgaaaattagttttatgttgctcatggtagttgggcttttgatggtttattttctatttagagaggtttataatctcgttttactggcttttctttctgagagtgaagttcattattacgatattttggaaagtattctttccttctttatcttctttgaatttttaactttaatcatcacttcattgagaaacaagggacatgtgtcactgattttcttattatcactaggaattacttcgcttatccgattattattgacttaccatgaacgtttagttggagtgcttttgattgctagtgctattctcatcttgattatcggtgttttcatcttaaagaaattcatttttccaaatgatgatacagcagattatttctaattttgcctgacggttctgtcagtaaaataaataaataaaaaattactgacagatttgtcagtaattttttttagaatttttttagatatattttatcaatgtgatgattttctgacttgtggagaatgatttctgcccgatttcttgtgggttcaatatattctcggagattgacacgattgacacgtgcccatgtttcacgggctaaatttagtactttgtcctcaggcatttttgtaaattgatgatagaaatttgtttggtcatactttgccaattttaaaagactatcaaagcgttcaaggtaccatttttcaatgagtttttcgtcagcgtcaacatagattgaaaaatcataaaaatcgctgatgtaaaggagttgattttgcggattttgtaagacattaatcccctcaacaattaaaatatcgggactgtcaataatttgactttgattaggtaaaatatcataagtttcatgagaataaatcggaacttcaaatctttcgccatttttgacatgataaagaaaacttgtcagtttttccatatcgtagctttctggaaaacctttacggtcgagaattcccatattttttaaatcatcagttgtgtataaaaatccgtcagttgtgactaaatctacagttaattttggaaatgcacgtgagaggagaagttgaaggagtcttgctgtggttgatttaccaacggctactgaccccgaaattccaataatcaaaggaggagttttaacgattttttgtaaaaaaagtcctttagaatagctcatatcttctaaattttttttatataaacgaagaagatgaatcagaggtagatagacgtcctccacgtcttgcaagctgatttcgtcattgagtgagcgaattgattctaattcatcatgtgttaatggggcgatagaagtattgtaaagattttgccaagtttcacggctaatttcgtcaaaattaatgaattcattcatgacaaatattttatcatatttttggtctatcgaggtaaaaaaactaataaatctgtaagcgtattaaatatgttactgacaacttttgagcttagtggtcagtgaaaagtgtaagagattacaaaataggtggaatttctaaaaattttttgaagataaaaaagggcttttatgttaaaattaaatcaatggttaaaacaaatatgtattatgaagataatcaagatctttcgcatgacttccaaacactaacagttgatttactaggactgtcaatgcgttttaaaactgatcgtggtgtcttttcaaaaaatggaattgattatggttcacgtgttttattagagaactatcagcccgaaggcgcaaaaacgcttttagatgttggctgtggctatggaacactgggattgaccttagctaaaaagtttgatttaagtgtgacaatggtagatgtcaatagtcgggcgcttgatttatgtcgccaaaatgcaattgataatgctgtcagtaatactgaaattgaactttcaaatatctatgaagctgtcagtgaaaaatatgatgcaattatctcaaatcctcccattagggctgggaaagaagtcgttcatgaaattttaactggtgcctttgattatcttaatgatggtggacatttaacaattgtaattcaaaaaaaacaaggagctccatctgctcaaagaaaaatggaagaggtctttggcaactgtcagctagtggcaaggtataaaggatactttattcttagaagttataaatgattaatcacttattatataaaatgaggagaagtctatgacctatcgaatggttgatctcattcaaaagaagagagacggcggagcatttagcaagtctgaaatcgattggatgattgaaaattatgtcaatggaactgtgccagattatcaaatgtcggctttggccatggcaatttattttaaaggaatgacgacacaagagactgcctatctcacgatggctatggttcattcaggtaaagaatttgatttgtcaactatatctggtatcaaagtggacaaacattctaccggaggggtgggcgacaaggtcacgctgattttggcgcctttagttgcttcattcggtgttccagttgccaaaatgtcaggacgaggtcttggacatactgggggaacacttgataaattagaatctattccaggtttcaagtttgaaaaaacagaagaagaatttatcaaacaagttaaagaaactggaattgccatcatcggccaatcagatgaattagttaaagctgataagttgctctatgctcttcgagatgtcacggcgactgttgatattatccctttaattgcaagttcggtcatgtctaaaaaaattgctgcaggctctgacgctattttactggatgtcacagtgggcgatggtgccttcatgaaatcagtagatgatgcacgacttctggctcaaacaatggtcgaccttggaaaatctgtcggtcgtgaaaccgtggctgttattactaatatgagtcagccgcttggttttgcaattgggaatcggaatgaaatgacagaagcagttaatactttgcagggaaatgcaccaaaagaattccaagactttatcgctgagcttgctcaaattatgctgcaacttgcgggacttgaaaaatcaataactgaaattttagagcattttaataatggcttagcttacaaaaagtttgttgaaatggttaaagcccaaggtggtgacccatatgcttttgaacagctgacagctcctcttaaagtgaaatatcaagttgatattcatgccaaagcatcaggatttatttctgaggaaaaagcattaggaatcggcttgcttgccatgaaattaggtgctggacgggcaactaaagcagatgaaattgattttgaagcaggtgttaccttgaccaaaaaagtaggagatcgagttgaagtaggtgagcttatcgccagcctctattctaatcgagaaattactgacgaattagttgctgaatttaatgatagcttagtcattagtgaccagcaaattgagcaaaaagaaattatagagattatcagataagatgaaaaatgatttaaaaattccaactccagtgatggctttgcaagtgattctgtcagctttagctggggcagccacaaaattatatttacaaaatttgggttggcttattcaacttattgcttttatcattattttcgtcgttgtctatctcattgtcggaatgatttatttaagattaaaaaaatagaaagaacatacaatgcaaattaataaatatattgaccatactattctcaaggcagacgctccaaaatctaaagttcaacaaatcatcgatgaagcaaaaaaatatgatttcatgagtgtttgtatcaacccgacttgggtaaattatgccagtcaagaactcaaagactctgatgtaaaagtatgtacagttattggcttccctttaggtgctaatacttctgaactcaaagcatttgaagctaaaaacgccattgaaaatggggctgacgaaattgacatggtcattaatattggtgcagccaaatctaaggattgggatcttgttgagtcagatattgcagatgtaaatgctgtgaaaggcgataaactactcaaggtgattattgaaacgagtcttttgactgatgaagaaaaaattaaagcttgccaaattgctaaggccgttggtgctgattttgtcaaaacttcaacaggtttctcaactggaggagcggcagtccatgatgtaaaattaatgcgtcaaactgtaggtccagatatgggagttaaagcctctggtggtgttcataatcttgaagaagcaaaagcaatgattgatgctggagcaactcgtcttggagtttctgctggtgtcgcaattatggaaggtcttacctcaaatgacagctactaaagagatgattgtggctgctcgtgaggctgcaagtctagcctacgtcccttactcacactttccagttggagcagcttttctaacagctgatggtcaggttattaaaggctgcaatattgaaaatgctagttttggtttatcaaattgtgctgaacggacagctatttttaaagcaatttcagaaggtgtcaaagattttgacgcactctatgtttttggagaaacagaagaaccaattagcccttgtggtgcttgccggcaagtacttgcagaattttgtccagccgatatgccggtttatcttatctcaaaagatgataaagtaaaagaaacgtctgtcgaaggacttttaccttattcttttaaaagccttgattaagtaaaaatgtaaaagttaaatatgctatctttagatagcatatcaatttgcaatcaaagtaagcgcttcatgtcttgtcttaaatgtaaagtaataatggtaattaccgataaatataaattttttttgtgtttttgttagttatttccgaacgttaagcaagaaaatgaaatattccgctaaattatgcttgcaagaagatacaatatagcttaaaatagtcttaagctaaatttagccaaacaaaattcggaggataccctttccatgaaaaaacgcgtaatcgcagttagtgctattgcacttgcatcagtcgcagtccttgcaggatgtcgttcacatgacgcatctggaacttcaggtaaagtaaaaactgaccttaaagcagcaatcgtcaccgatgctaatggtgtaaatgaccgttcgtttaaccaatccgcttgggaaggtcttcaaagctgggggaaagaaaataacctgaaaaaaggtactggatacacttacttccaatctaattcagcttcagattacacgactaactataactctgcggagcaacaaggttacaaacttttgtttggtattggattctctttacaagatgcgacatcagcagctgcgaaaaataatccaaaatctaactttgttatcgttgactctgtcattaaagaccaaaagaatgtaacttcagcaacttttgcagataacgaaagtgcttatcttgctggtgtagctgcggccaaagcaactaaaacgaacaaaattggtttcatcggtgggatgcaatccgatgttattactcgttttgaaaaaggttatgtagctggtgccaagtctgtaaaatcagacatcaaagttgatattcaatacgctggttctttctctgatgcggctaaaggtaaaacaattgcagcagctatgtatggttctggtgatgatgttgtttaccaatgtgcgggtggcgtaggaacaggtgtcttcagtgaagctaaagccttgaactcaagcaaaaatgaagctgacaaagtttgggttatcggtgttgaccaagaccaagaataccttggaaaatataaatctaaagacggtaaagattctaactttgttcttgtttcaacaatcaaagaagtaggaactgttgtaaaagacattgctgacaagactaaagacggtaaattccctggtggaacaatcgttacttacaaccttaaaaatggtggtgtagatttaggacttgataacgcaacttcagaaattaaagatgctgttgccaaaaccaaaacagatatcattgatggaaaaattactgttccttcaaaataattaaagataatttaaaaataaaaagagttagtgcatgctaattcttttttatatttttaaaaacaatagaagataagatttgcgattattttaaatgttcttgatttgtaagtcaactgaactatgatataatggtagacagatattaaagtggtatatattgttattatttagttagggggaactatggcaagaaaatcagtaccaaattatgtaaaaatacatgatgccttaaaagatgaagttgaaaaaggcatctggaaaattggacaacgtcttccaagcgaacgagatttagccgagcgttttacagtgagtcgtatgacagccagacaagctgtgacagccttagtagatgagggaattctcgaccgtcgagtaggttctggaacctacgttgctagccgacgtgtgcgtgaaaaaatgcgtggaacaacttcttttacagaaattatcagttcgcaaggcaaggttccctcaacagaagtcttaagttatattagaactgctcctaatgaagttgaatgtgagaagttgaacatcactaaaaaagattcgattattcgaatggagcggattcgatatgctgacaatgttcccatttgttatgaagtggcaagtattccatttaaattagtgaaatcttttgataaaaaagaaattactagtaatttctttaaaactttggaaagccatgggcatgaaattggtcggagtgaacaaattgtttcggcaaagagagtcagtacagaagtatcagaatacttaaaaacaagagttggagctgctatacttggtttaacacaggtttcttatctagtagatgggactgcttttgaatatgttttgtcacaatatgttggtgaccgttttgaattttatttggaaagataaaaaggacttaatgaagtcctttttttacttgccgacgatattgatactgacgaagttgaaaatgaatccaacagcccacacaaaagccacttaaagcgatggaagcagcgaggaaaacaaatgcggcaaaaacaattgccaaaatagggtgatgggtaagagaagcaatcaagctggcactcaataagcttgtagcaataatttgattaaaacgaaggtcggacttatcttcaagaatatattctgaggcctttctttttaaaaaacgtttagcaatcagaataacaaaatttcgttcaaacaatatgccagacaatccggcgagaatcgggagtagaagaatccaataaaaattactgaccactgctaaaataatgctaagtacaataaaagtttgattagtacgcacgagtgggcgggggataccctgaaaagtagttttagccataaaaaatctccaatcttgataagttgattctatcgtaattggagagacttggtcttaatatttttttatttgcttaatgggaatattagcttaagaacaagaaggattataaaccttgtatttgatttttaaactttgcaacagaacccatcaaagtaatttgacatggcggttagacgttttttccaccaatcatagccatcttcagccatcttttcccaattataagttgggaatccccagttttgtccatttacggcaaaaacatcaggaggcgcaccagcttgtttatcaagatggaaaagttcgggatgggtccacgcatctacagaatcgtgagcaattccaatcgctatgtctccttttaaagcaattcctaatttatgacaataatctactgcttcagtaagttgagaatggagaagatattgcacaaaaatatataaatctaactggctagtctctttttttaatttatcaaataaatttttatcataattcgcattttttccccaagctaaaaaattagcactcttattaatgtctctcaaataggaaaaacaggcataggccttcaaccattcttcattttgtttataaaattgttgataagacttggttttttgatattttacggctaaattttgataaataatttgcgcatattcccactttaatgccagacatctttcataatctatcttttctaaagaatttagttctgattctaaaatcaaaagtttttcttgttgctcttttgtgtaagatttccaaaattcatgaatgtctaaatagagtggatgcaaagcaaaaacggaaattgcccgataaggataggaatctcgccaatccataaaagtcgtcgtatcattaattggtagtaattggatgacatccatgccagagcgataggtaaaatcagccaatttcttaaggtctgagaactgacctactccgctagagttttccgttctaagagaaaaaactgggactgctattccggtatggtaagctttttctccatagggttcaattgaaaatgtgttagttaccatcttttcttactccttaaaatttttgaaattgatttagaataattaaagagaacgttttcttttattatatcttttttaaaataaatataccaatatttagtgtgatttttcagaaaattaataataaaaaatgaacttgataacttttgtttctattaaactacacttaagagtaaaacgtaataaaaaaagttactggtagactataccaataacttttttattaatcttctttcaagaagttggtcaaaacaccattaataaatcgactagatttttcatcgctaaagtcttttgaaagctcgatagcttcattgactgccacgacatttggtgtatctgtaaataatatttcataagtagaaacttgaagaatggcttgttcaacaagtgttaatcgtgaaaacgaccaattttttgctagatatttagaaatatttatttctaaatcttcttttttctctaagactccatcaacaagttgagtaaaatattctggagcttccagatcttctgctctatcattgtcgtagttaagtacgaaatgttttgtttcttttaaaagatctgataagtgagattcggcagtcgtttcagcctgctgtaactgctcatcaagctcttcttttaaggtatttggaacaaataaatcgcttgtgtacttttcaagaatattttcatgaaggaaagagaaggttttttggaaagtttcaaaagtctgctcggttgttgcattttctggcagatttttgaaaaattctaatacttttggtgcaactggctcttcatcaagctcaatttggaacaaacgaataagtttgaggttatccataattcctgaaaataaatttgttgcttcatattcattcattttcttagcgtaaccaccaaaatcacgcatgaaagcaagtgctttagcgacatttgttttttcgatatctttaacaccgagaatctcgtaaatttcgtagattgcttctaaaggttgagatagtcctttaggaaacttacgaacaataattcgttcatcacgaaaatcaacgtcaaaacgaatcgtttgagaaagttctgtttctatcttctcaacattttcacgaaaagaacttacgacactggttgccatttccttttgtacagcgtaagaaaacaatacttggaccgctcgttgacgaatttggtgttgcgtgagcgttttaggcatcaaaaaatccctcatcaaacaagtcttcaagcgctggttttggttgtttttcagtcataattcctacaacatggatattgacttcatcaacaacaatttcagtagcttgagcaactgcttctttcacttctttttggatttttgtagcaaccgctggtaggctcacaccataagtgagataaacgtagatatcaactgctactttatcatcttttgagtcaatataaacgccccgtccttcatttttcttccctaaacggtctgaaaaacgtttattacgaagagcatgtacgccttcaattttggctgttgtgataccgataatcacttcaagaacttcaggggcaatgacaatatccccaagttcttcagaatgtacagttttttctgccattttgctttctccttttgtctttgcaaatttttctaattagaaaaatttcacttacaaaatgaattttctttactgacgaagtcttaaaacttcataaagttactgacaaaccgctgtcagtaacttttttcagtaatcgtgctgacttaagcacgttttaagtattcacctgtttgtgtgttgatttcaagttttgttccaacttcaacgaagtcaggaacgttaacaacaagacctgtttccatagtggctggtttacctgaacctgttactgttgcacctttaattgatggttgtgtttcagtaacttcaagaacaactgttgttggaagttgaataccaattacttctgtaccgtaaaattggattttaacatctgtattttcaagaacgtaaagaagttcatctttaacttgttctactggaatttcatattgttcgtaagtttcattgttcatgaagttagcaatatcatccattgaataaaggtattgagctgtcactgtttcaatcacagcttgttcaaacttatcttcaggacggtaagtgtcatcaaatgttgaacctgagcgtacgtctttaagcttcatacgcatgattgtatttcctttacctggtttgtgatgacttgcttccataacgcggagaagtttttccccattcaaaaatgtcatgcctgatttaaggtcttttgctaaaaccatgtttatgtttctcctagtatttataaatttagatattctgccttttttctttttgtcagtaattttctgtacacaaaagaagtaaaatgacaggatttaacatcttattttatcacaagttattgcttttttcaaataacgataagctcttttggcgcttttgtcaggacttcacagccattttctgtcactaataagtcatcttcaattctaactcccccaaattcaggaagataaattcccggctcatcagtaattatcattccggattttagttggttttcggtcatcgactgattaaaataaggaatttcatgaacatctaaaccaagaccatgaccaattccatgcgtaaaatattgcccaaaatcagctttttcaataacttctcgtgggatattatcgtattgtgcataagtcatccctgctttaacttgtttgatgagtgcctcattagctttacgaacggtctcatagattgttcgcattttgtcatcaacagagccaacaaagattgtccgtgtcatatcacttgcataatgctcataataacaaccaaaatcaatggttactggatcgccaaattgaatcattttactcgtcgcaacgccatgcggtaaactgcttcgtttgccagaggcaacaatcgtttcaaaagaaattccgctcgcctctaaatcacgcattttaaaatcaagaaaattagcaacttcgatttcagttcggcctggttcaataaatcttagagctgacataaaggcttcgtcagcaatttcacaggctttttttatcaaacttatttctgattcgtctttgatttggcgaagttccaaaacaaaattgctggtagaaaaaaaggctaattttgtggccgccttggataaccttttaaagaaagcataatcgactgtttcctcaaaagccatatttttaactgattcacttgctgataattctgtcagtaaactgatagggtctctcgtctcaataatttcaaaatttttgattaagccacgcgccatctcactgtaacgactgtctgtcataaaaatattgcgcttttgggtcaaaaaaactgtacccgcggttccagaaaatcctgtcaaataaaaaatatttttcatatcagtaatcaataaactatcaatattttctgtcagcatttttgcttttaatttttcaattctcattttgctctcctttaaatataaaattaaatgatagaatgacctcatcattttcttccatgataacacaaaaactctaacatgagttaacgttttcttttaatttttatttactttttaagaggtaaaagcgcatcagccaatttagcgaattcctcaatggacaaagcttctccacgtatcgttggcgagatttctgcttgtgccaataatttttctatttctggtttactgtcttttccaaatgctgcttgcatgttattcatcaaggttttacgacggtgaacaaagctactgtgcatcgttttaaagaaccattcttcatcttctacttcaactaaaggttcttcacgtcgaaccattttcaaaatagccgaatcgacatttggggcaggaataaagactgttcgtgggacgataaaggcgacacttgcttccatataatattgaacggcaattgataatgagccgtaagccttggttttaggtcttgcagcaattcggtctgccacttctttttgcatcatcacaacgaattcagaaaaaggaattttgctttcaatcaaatgcatcaaaatcggagtagtgatgtagtagggcaaattcgcaaccactttaattggtaaatttggatttttaaatttttgaatttcagaaagtaaatcaactttcaaaatatcttccgataccaaagtaaaattatcgtaaggcgccatcgtttcttctaaaattggaatcaaagatttgtcaatttcaaaagccataacctcagcggcttcttctaaaagatactgtgttaatgaaccaattccgggtccaatttcgatgacgttcacttctttggacaagtcagccgtctccgtaattttggtcaaaatattatggtcggtcaggaaattttgaccaaattttttcttaaaattaaaatcatggcgacgtagaatgtcttgagtacgaatgatatttgagatgcggtctatattattttctgtcattttttctttcttttatttatatctaattttttactgacaaatctgtcttgaaatgaaagtaatctataattgactaatttaaggttcagccttaataatcatattttgtttctttaaatagttatttcatcagtaatttttcattactttttcaatctgttctattgtaattttaaacatattaagtcgtttcttaatttgtttgccattagcatagccaatccttaattcttcacatagaaattctcgacgctttctactgtcagcagccataattaaaccaaatctcattaaatcagtttgggtcaaatctgctgacgaatctgtcagtgatgctttttcaccaaaaacctctgacaaagcttgattgagtgccgcaaaatttgcatgttcaacaccaagtgacccttttcctttgggttttgcttcatcacgatttagaaatgcatgaccagcttgcgggattgcttgcataataatttttcgaatccgttctccttgaaaatctgggtcagtaaatacaataatcccccgtttttcttcaagtactttcaaacgttctaaatctctgtcatcaatagaagatccccctgtttcataggtatcgcagtcaaaataacgtttaagatttgccgtatcatctcgcccttctaccacaatcacttcattaatttttggtttttctatcatattttattaaatacttctctttatctttccgatttttaaggataataactttgtcccaaacagcaaattcacttattttttgctcaatttggggaaattctttttctggaaaagtccaaacaaagtttaaaaactccagatagtctttatcccatttttctctgaactcttcagccatatctgatcgatttttatgaaataatcgcacgagaattgaacgttttatgactcgaaagacagtcttaaatcttgaaccttttaaccaaacaatctcgtctatataagggagtcgttcagataaacttgaaccataattaccgtcaataattccattttcattttgagaaatgaaatctcttgtggcttcacgcagttttattctaccaagatcacttggatgtttatggaatactttatccaagtgtaagacagggtaatccgtcttttttgctaattctcttgctaaagttgatttcccgctacctgaactaccgataataataattttcataaaaatagctcctagcaaaactaagtaattactctactttttcaggtcaaaaattttcaaagcattttcgtttgttgcctcagcaacttcttccattgaaatcccacgtaaatcagctattttttcaacaacatacttcgtatatcctggtgtgttttctttgccccgataaggagttggtgtcaaataaggagcatcggtttcaactaaaatcttatccaacggaagtaaacgagccgcttcttgaacatccaacgcttttttgaaagttaccacacctgagaatgaaatattcataccaagttcaacaaacttgagtgcttcttcagctgttcctgagaatgaatgcataatcgcaccagcagtcccgacaccttctgatttaataatttcataagtatcagaaagagcatccctcgtatgaacttgaaaaggaattcctaattcttttgagatttgaatttgtcttctaaaaactcgttcctgaaccgctttaggagagaccatccaatgatagtccaaaccaatttcaccaacagcaattacttttttgcttcttccttttgtcagtaaatattcctcagcagcagtatcaaattcagcagcatcatcaggatgccaaccaattgttgcataagctgactcaaatttatcagccaataaaagcgcagcatcgtttaactgataattacttcctacattatttatttttgtgacgccaaaggattgagctttacttatttcttctttgacacgtccttcaaattcaatagtattaagatgcgtatgtgtatcaaaaatctctatcattttattatctatccttgtatgtactatttaaaaatcaataattaattcgttaaaattacaaaatcttctattttctcaatttcacttttcttatttttaaattgcactcgttctgacctattccttttcacaagaaaatatcttctgtcagtaaatttttaaatcaaatcattcttcttctcatttttaaaataaaagaagccatatgcatttatattatatcatatctgtaaggctctttcattactttttcaaattgctttcttatttcattctctaaaaaacttgtcagcaacctttaactttatcaaattaaattataaaccactgtcagtaaaattttattgcttatatccttaaaaatctctttcttaatttccataaattacacaccctagcagctgcttgacaaatgtcacctaaagatttacagttgtaaacaggaggaatgaaatggacaattcaaagttatttgacgacgttgcaactgaagaagagctactgaaaaatgattatcgtaaatatcatggtgaaaatatggatatttattataatgcaacaatttgtgaacatgcaggtgagtgtgtccgaggtaatccgctagtatttgaggttggacgtaagccttggattattccagataatggcgataccccttctaatcaaacagtaatcaatagatgcccttctggtgccctaaaatatctaatcaaggagaaataataaatggaaattatcgaaaagcaaaatttattcgaactactttcagataatggggaagtcatcggggaaatgaattatatgaatatgaaaaattcaataattattactcatacaggcgtagcacttgattatcgaggccaaggcttggcagaaaaattagttcttgccggaattgaaaaagctcgacatgaaaatattaaattgggtgcaacttgcccctatgcagccgagtattttagaaaacataaagaagaacttgctgatattttaaaataaaagtattgatgaaatattaatcctaaggcctctatcaaggtcttttttttactacttctatgtaaaagttctatccatttttctaaattttttgttatttttagactaatttttgattaaaaattattaaattgtgttgtaagttcacaattattttgctataatgacttattattttattcacaaaatagaaaatgaaattattagggagaacttatgaaggagaaactagctggtaaagactatctttttattggatcaatgttatttggactttttttcggtgctggaaatttaattttccctatccatatgggtcaagaagcaggtgctgctatctctcaagccaattttggttttttagttacagcagttggatttccatttttaggaattattgcattaggaatatcacaaagtaatggcgtctttgaattggctacccgagtcaatcgtatttatgcctatatctttacgattttactttatttggtcattggtcccttttttgcactgccacgtctagcaacaacttcgttcgaaattggaatttctccatttttatctaacaaacttcaaaccccacttttagcactctttagtatcctattctttggtactgcttggtttttatctagaaaacccacaaaactattggattatattggcaaatttttaaatccactttttctagtcttgttaggtttaatcttaatcatcgcttttagtcaccctcttggatccgttcaccaagcagaggttggtaaactttatcaaaattctgcttttatgaatggttttactcagggctacaatacacttgatgcattagcagccttagctttcggaattattattatcacaacgattcgtcagcggggagttaaaaatcccaaaattattgctaaggaaaccattaaagccggtttgattagcgtaggacttatggctataatttatacttgcctctcttacttaggagccatgagcgtaggaaaatttgcgataagtgaaaatggtggaattgcccttgcccaaatttccaattactatcttggaacttttggaatgattatcttggctttgattgttatcattgcctgtttaaaaactgctgttgggttgatgtctgctttctctgaaaccttcgtagaattatttccaaaaagagaatatcgcttttacttaatgatcgttagtatcctcccttgtatttttgcaaatatcggtttaacaaaaatcatagaactttctgttccagtgcttatgtttttatatccattagcaatcacacttatccttttagccttattaggtccagtttttcaacattctaaacttgtctatcaaataaccaccgccttcacacttttggctgctatcgccgacggactcaatgcacttccaaatccgctaaaatcacttaagcctatcgcggccattctcaattttgccaaagactttctccccttcttctctcttggaatgggctggattctcccagcagtccttggatttataatcggttgtttagtccactttttaaaaagaatcacaaataaataaaagagcttctaatatttaggagctcttttatttatttttaaagaccgcacttctaagaagttattttatatttagtgatgtatctttcatttctttacaagccaatgctcaatcgttttccaattttccttcgtaacaatcagtctagggatattactatacttagtttcattagtaaccactcctggggaaagcgtaaatattccactgattccgtctttgagcatataattttctaaatctttattttgagccccataaggataagcaaaaacattcccctttttatttaattcttcttgaaaagttttttgactttttaaataatctttttggactacttttttcgaaatatttgtcgataaaactggttcaagattttcctgataatgtaagtcgtttgtgtgcaaaccagatatcaccaaaggattttcatccatctcctttatttctttccacgaagacatttgtgaaccatcaatcgtttgaccaacttttccggtaataataaattgggtaaaaggtaagtcaaactctttcattactggataagcattttctgtcagagatttatcgatatcatcaaaagtaatgacaaccgctttgcctattacctcttttttattaattttagagatgagttattcagacgttaaaaccgatatgtgattttctttcaaaaattccatttgtttttcaaaatcctctaaaaaaacattgtattcatgtaactgcgaattttgagaaattgttgaagcaaagcttgtgataggtgtatctttgagaacacgatgataacaaaggacaataattccatcattatcctgaagtaaactctcataagcgaaatcaggttgttcttttttgctctctttcacatattcttctgtttcacgagtagacatgattactaaaaaccctatgattaaaaacatgactagcaaaataacatttttttcttgtatttcatctgcttctagtcctcctttgttaggatatacagagatggaatcgtaagtatttaaagcatacaaaataatgaataaatcacatcttcccaatttgttattggaaaaccaatgattactaaaatagagataattccatcactatagattcctaatatagaaagtgctaagaatataaaaatacttaaaataaagccccaacacatgaagacagccataaattcaaaaaaatgtctttttttctttttcttacgtataactaacccgaattgctagttgattatttagccatgacttgatacccgatagaatatcttaaagtctatggttccagtgatttagctgattttaacagtaaagaatacgctaaaaatctttggagaatgaattctgattttatagctagttgttttatttcttttgaaatggctaattcaaatgctgatcttccaatttgtaaaaagtgattgtcaacagttgggagatttaatagttggcctgaaattagtgcttcttggccaattataattggtttggggagtttgttttgttcaaaccatcgccaaacatttgcagcaatatcatctgaattggcaaaaatactatcaaattgagcaagttctgctcctaagtcgtagccgtctgtcgaggagaccgctcctgttttgatttggtcagtcctaactggttatttatatatttcgctataggtctggagggtgacggatgtggttgggcttttatagcgtgaaaatagaaaacctatatttgtacagttttgttttttaagccatttaaaggcatcacgatatccgatttctctttcggcatagctggctgatattgtcttggtcttaggtttatggcataagataattggaccatatttttggtatttaagaacggtttcctcagatatttttctagaggtaaagattaaggcttcaaatgcttttttgcgtaattgctctaagtattgaagttctaaattttgatcataatttgagggaagaatgacaatcttatagccagtttcaaagcttttatcaagaattccttccaaaatctgactgaaaaagggtgcttaacataaggtagaacgacaccgatattcttggttgttccggcagcaagttcttgtgcaatagcattaggagtataatccaattcatttgctaaatcttgtatgattgtccgagcttcgggagatacgtagccatttccagaaagggcacgtgaaactgtagcttttgaatagccactgagttttgataaatcggttagtgaggtcattaaattacctgttcattgagggtattgatggctgatatggcctctgccacaccatgctctgtattctttgctactaccattttaacatgttttttaacttctgggttagcgttatccactgcgatggctagacctgctgctttaagtagaggaatgtcattatgaccatcaccaattgcagcaatttgtgtaaaatctaatgcttcgtcgttaaggattgattgaaccgcattggcctttgttcttttatcagatgtaatttctaaataccactgaccactttgttgaattgcgatatttggaatttccaattgattaagttgattttgaagttgatgaagttcattttggtcaaaaacaatcatcataatcttatagatttctgattgtccatcgaaagttttgattcttggttcgaggactgtcaaggctttttggataaaggctcctttatcttgtttgttagtataccaatgagcaagactataccagtttagacttactttcggaaattcacttgaaacataatttaaaatttggaatactatttctgagttcagggtgtttttatctaaaatttgaagaccgaattgattttgcgtaaatgttaaatttccattgaaagcaatttgtggtgtggaaagctgtaatttttctaccacatcactcatttctaatgggctacgtgctgaaactagggtaattggtaacttcactgtagtatattgaccagtggttggtatcagataaagctccatgtgagtcaagcaatgttccgtccatatctgtaaaaatgtgtttaattttcattttgtgaagctccttttctttgattattctattctaatttatgaaacgcgttccatgtcaaggattattattttttatttttactgatggaagtgcttttttctaaaaatggatagagctgagcaattccaaaaggagtgtttaaaatgttataatttagtaaagctgatttttattgatttgagagataaattgatttgaattaaaagtaaaatagaataaatagaataaaaagtagaaaaatagaggtagataatagagatggaagataagaatagacttttgctaattgatgggtcatcggttgcttttcgagcgtttttcgcattatataatcagttagatcggttcaaagcacctaatggcttacatacaaatgccatttttgcttttcatacgatgttatcttctttgatggaacgaattcaaccgacacatgtgttgattgcttttgatgcggggaaaaccacttttcggacggagatgtttgcggattataaagggggacgttcaaaaacacctgatgagtttcgcgagcaactgccttttatcaaggaaatgattgaaaagttggggattcggcattatgagttggcaaactatgaggccgatgatattatcggaactttggataaaatggctgaagcgcctgatgtaaatttcgatgtgaccattgtgaccggggacaaggatatgattcagctggtcgatggaaatacacgagtggaaatttctaaaaagggtgtggctgagtttgaggaatttacgcctgactatctcttagaaaaaatgggacttacgccatctcaatttattgatttgaaggctttgatgggcgattcttcggataattatcctggtgtcactaaagttggtgaaaaaacgggtcttaaacttttacaggaatttggttcactggaaaatctttatgaaaatgttgagacgctaaaagccagcaagatgaaggataatctaattgctgacaaggaaatggcctttttgtcacagcaattggcgacaatcaatacgaaaactcctcttgaaattggtttagaagatacgcttttaaaagaaaaaaatgtggctgaactgggccaattttatgatgaaatgggattttcacaattcaaaagtaagttattaactgacggcggtggagaagttactgacgaaactgtcagtgaagaaattaagtttgaaatagttactgacaaaagttcagttgcttcagtcaatgctgatgatttcttttatttggaaactttgggtgaaaattatcatcgtgagcagattgtggcatttgcttggggaaatgctgagaaaatttatgtttcaaaaaatctggatttactgacagaaatgaaatttcctgaaaatacttatgatttcaagaaaaatcgcgtacttttgagccacttaaatattgaattgcctctggttaaatttgatgctatgcttgcaaaatatttgatttctacaacggaagataataaaatttcaaccattgcacgactttttgatgtgggacatttggccactgatgaggaaatttttggcaaaggtacaaaacttgctctacctgatgatgagattttgtttgaccatttggctcgtaaaatcagagttttagctcgtgccaaagaaaaaatgatggctgaacttattgaaaatgaacaagaacatcttttgtctgatatggaactgccattagccgaagttttggcaaaaatggagattacaggaatttctgtcagtcaaaatacgctggaagaaattggtgcagaaaacgaagaaaaattggctttgctgacgcgtgaaatttatgagttggctggtgaagaatttaatattaattcaccaaaacaactgggagtgattttatttgaaaaattgcaattgccagtaggtaagaagacaaaaacgggttattcgacggcggtggacgttttagaagacttggctgctttatctccagtggtggcgaagattttggaatatcgtcaaatcaataaagtacaatcgacttatgttaaaggcttgattccgcaaattgctgatgatggaaaaatccatacgcgatatgttcaggacttgacgcagaccggtcgtttgagttctgttgacccgaatttgcaaaatattcctgttcgactggaagaaggacggaagattcgtaaggcatttgtgccaagtcaagattctcttttgttgagttccgactattcacaaattgaattgcgagtgctggctcatatttctgctgatgagcatttgattgacgcctttaaacatggggctgatatccatacgtcaacgtctatgcgggtctttggcattgaaaaagcagaagatgtcacggcaaatgaccgccgaaatgcaaaagcagtcaattttggtgtggtttatggaatttcggattttggtttggcaagaaatctgggaattacaagaaaagatgccaaaaattatattgaaacttactttgaacgttatcctggtattaaaacttatatggaaaatattgttcgcgaggctagagataaaggatttgttgagacaatgagtcatcgtcgtcgtaagattccagatattaatgcacgtaattttaatgttcgtggttttgcggagcggacggcaattaattcgccaatccaaggatcggcagcggatattttgaaaattgcgatgattaatctggataaagcgctgacggaacgtcaatcaaaatcaaaattattattgcaagtacacgatgaaattattctagatgttccacttgaggaattagaagagattcaggcacttgtcaaagaaacaatggaagaagcaattgaacttgctgtaccattgaaagtggatgaaaatactggtaaaacttggtatgaagccaaatgatactagttattaatgatactgacaagctttctgtcagcaagtagcagttgaatttttaattcagttgacagagcggctgactgacaaaaaaagataaataaaaatgataattagttcgtgctgattatcattttttggtgtttatcattttggtattttaacaggtactgttagaagatgtgtcggggtctgtgatataataaaattatggaaaatatcgaattgaagatggatgagagaattgatgaaattgccagtagtggggtcaaaattattcaaagccgagaggttttttcttttagcatagatgcgattttgctggctcgttttccgcgcttgccaaaacgtggaaaaattgtagacatgtgcgcgggcaatggggcagtgggtctttttgcgagctctaaaaccaatgcacagatcattgagctagagattcaagaacgtctgactgacatggcgcagcgttcaattgagcttaatgaacttactgacagaatgtcggtcattaatgataatctcaatcaggcgcttaatcatcttcatacttctagtacagatttgattttttgtaatccaccctattttaaagtagactcaactgacagtcatctaaatgaaagtcagcattatactctagcacgccatgaactgacaacaaatttggatgaaatttttgagattagtaaaaagttattgaaaacgaatggtcatattgccatggttcataggcccgagcgctttttagaaattgttgataagatgcgggctaataatttgcagcctaaatggattcagttcgtctatcctaaagcgaatcaaccggctaatattttgttgattgatgccattaaagatggaaaagaaggaggtgaaatcttcctcccacctctcattgttcataatgatgatgggacttataccgatgaaattgatgaaatttattatggaaaacattaaaaaaagttactgacagaaagcctaaagttaagcttttacttgtcagtaactcttttttaatatgcggcacttgcttgagccattattttttcaatcgctgcattttgcacttcttcaagtgtgttagtatctgtagcagctggttctttaattgctttctttaatttactacgtgttgaagataatgagagattgaggtcagcacttgctttttctttagtattagtaatacttccggaaatagtgctcgtcattttgtgtgccttattatcaatcacaaatttaacagaaagtttactaatatcaaggtttttactttctttaatcagttgttccacttgttttttagggattgaagaagttgagctgatactattaattaaatctttgaggtcaatatctttaccagagaattttaaagtcaccttatcaccatctttggtaaaatcagaatttggtatttttttaaattcctgttccaaatcagcttgttttattttttcagtagatttaaataagtctttaaaagttgaagaccaattttcatcaacagattgagcacttgaatcaattgtttcagaatcaatcaaaagatatgatttattaagactgtcaatcatcgctccataaaccattgccgtatcactatcttcactgggaatcaaatctttattgttatcataaagtgatttgatatcagtgctagcaagataaaggcctttttgtgacatcatcacgcctaaattataatcttttttatctaatgtgattgttccagcgagagcagcaagttggttagtcttgtcaagcccaagatttacgtttaaatgggccccttttgaaaacattttattgaattcagaagaatcttccccgtgtagcttgaattcgttgacatcaagttttacattttgtgcgttgtattctttagagttgtttaaggcaactgtatctgagataaaggctttttttgccgcatcagagtttttagtcgagcaagcagagagagtgacaactgcaagagcagtgattcccaaagacatccaaattttctttttcataaattactcctaatgtattttattgatattttactataaaaaagtaaaatatcaataacaaatcagaaataatgaaacaaaagaacaaaaaaatcactgacaaaccattaagagcgaatctaagttgtttgtcagtaattttttaataaatcatatcataaatttcaatggcaacaaggtcgatgtcatcgaacaaagaagcgtctttttgtttaggataacgtaaagcaaatgcttcatcttctgggctgtagctcactgtgagcattacttcgccttcacgttcaaaattataagtttcttttggatcgccaccttcaactaaacgatttaagcgattcataattgttaacaaatgtgatttcatttcttaaaaattcctttcgacgttttgcaaagcaaaactttgttttttataaaattgtttttacttacaattgattttcaaaggaacagctttcaggattaaccccattagtcctgttctttgtccttatctattttaacataactttgtagatttttggcaagtttactggcttttctagcaaaatattttgcccgaatttgttctcttttaagtgaacgtttaacagtaactggcatttggcgaatggtatcttccattttcattgggaaacgttccgcctcaatagatttaaggttattatattcgataattgtatcaatatagaagagataaacttttttagcaaaattttctgctgaaatttcatagagtttcttttcaaatttatctttatcaattgggtgtaagtcacgaatcgcacttttagtaacttcagctaaatcgtcatcaccgataaaaagtcttccaaattcatcatcattgattaattcagataaataaggattttttgctgctaaaactcttgttcctgctgccattgcttcaagataagtgagcccttgtgtttctgaggtagaggcagagatgaaaaagtctgcggctttataataataagcagtttgctcattttcaacggaacctgtaaagataactttatcagataattcgagtgaatctattaaatcttttagcgtttcggcgtagggaccatgtccaacaatcacaagtttcacgggaaactcttctaaaatatcaggtagcgcgtgaataaccgcttggatatttttttcggcagcaattcgtgaaaggctgagtaacatgatttcattttcttgtaaaccaagctcagcgcggagttttgcggattcttcaggtttaatatcgtcacgtttgaatcggtcgatttcaattcctgttggaatgacccgtttaggaagggttgcgccatagctattgactgtttccagaaccatttcacttgggcaaataatcgcttcagttcctcgtaagaaattacgaatcacatatttgaccatacttggacgaatcaaacgtcctttagcgatgtaataaacgtagtcttcatacttagtgtgtaaagtatgaatgacaggaatacgtaattgagcagcaaccattttacccaagattcccattccaaactcagtttgggtatgaatgatatctaagtcatattctttcgcaatcaagtaggcagcaaaaacgcctttgagtacaatttttcgttcagccaagctcacaaaaggaatagattgcaagcgaatgatatttcgttcgtggtccacatcagcatttgggtctgttgttgtaaaaatgaaaacctcatgccctagtttttcaagctctatggctaaagtgcgaatacttgttgctacaccactgatttgtggaaagtagctatctgtaaaaagtccaactctcataaataaattcccgtttatatttctgtaaagtctatcattattgtaatgatagacttttttgtcagttaagattactgaccagtctagtctgtcagtaaattcatttatcccattatatcaataaatcattcaaaaaatcaaagttccaaagtctgttgataggcatcagccaattgttgtgctactttttcaattgtccgactttcagccacttgataagcggcttctgttttatctaccttcccatctaaaacatcttggagctggctaacaaatccatcaatatcgcaagccatacttacagcatttgaatcaagccagccatgatagaccggaatatctcgaacgacggttttttgatgactagccaaggcctcaagaacaacaattccttctgtttcttcacgtgaagggaaaaagaatgcgtcagcagaagtcatagcaccttcaaaaatatcgcctttgatatagccagggaaaagaacatttttagggtgatttttcttcacaatgcggcgaatccatccaggaatggtccataaattttggtaaccaaaccagatgaatgtcacgtcaggcattctttcagcgactttgataaagtcatcaattcccttacgtttaaaataaagagcagcagttacgacaactttttggtcagctttcaaagaaaaatggtcacgaaaagcttgttctttagctttacttcgggaatatttagccaaatcaattccatttgaaatgggtaggattgggcatttaattccataagaacgaagcaaactagcagaataatcagttggtgtaatcactaaatcagctgcccgataatagtgcattaaatattgtttaaagaaaggagcggcaatatttgagccgataaaggaattttgaaaatcttcttttgtcgaatgaccgtgaaagattactttttttcctgcttttttggctttctttaacattttccaactgctaaaaccataagtatttaaatggaggatatcataatcatcctcaggattttttgtccagtcaatgcccattaaatcaagggcgcgttgttgatgtttcattgcacgaccaattcctgaatgactcaaaaattgttcggcttctaagtaaagtaaaattttcatgcttacctttattttaccataaatcaataaaagaaaaatggaaaattattattttacaaaatttcagactttagtatgaaaaaaagccttctttccagaagacttttttatcaatgatatattaattagaagaagatgaactatttgtttctaaatcgcttgttgatttagagagtttaacatttgctgtggctgatttaccatcacggtagtaggtgactttcacagtatcattaatattgtgtgagtaaagagcactttgtaagtctgttgatgaagtaacggcggtatctcccaccttcgttatcacatcgccagctttcagaccagctgtggcagcaggaagacccgcttgaacagagtagacaaccaatccaccagttacgctgctaggtaatttcagttgagaactatcatttgttgataattgagataggtcaaccatacgaatacctaaggcaggacgtgaaatcttaccatcagtttcaagtttattaatgatgtttaccacatcattagatgggatagcaaaacctaaaccttccacagaggtagaaccatcttcggtcgttgtgattttactttgagtaataccaatcacttgaccttcaatattaatcaaggctccacctgagttacccgggttaatggcagcatccgtttgaatcgcattgatacttgttgtttgaccattttcttgagtcaaagtgacttgacgacttgttgcagacagaattccttcggttgcagtattagcaaactggctacctaaaggtgagccgactgcaatagctggttcaccaatagttaacttgcttgaatcagcgaaagttgccacgtctttaacatggtcagagctgattttaagaacggcaaggtcagtgtattcatcataaccaacaactgtggctttaactttttgcccaccagaaagtaaaacatcgagggaactatttccagcaataacgtgatagttagtgaccacgtaagcatctccaccagattttttataaataacaccagaaccctcactggaaagttgcaagctgtcattagctgaacttgagccgctatttccaccaaaaattgaactaaaatcactttgtgaattctgtttttgataattcataacagaaacgacagaatttgaaacttttttaattgcagaggtgacatcggtattgacatttaccgaaacattactaacctttgtgctagttgtatttgagcggttagcatttcctagttggtttgtagtgctttgataaattgcgcttcctccgagtgcgatagctccacccacaacaccggttaatagcaattttcctatattagcttttgccataaataattcctttcaattattactctttgtagaatttctatgttgtaattataactactctcacttaataataccttaatagtaacaaaaatcaaactaatatagcttatccacatttttgtggataatttaaaaattaatgaggataagtggatatttaagaggagttttccacacaaaagtggaaaaaagtgaaaaaatgttgataaatcatgctttcatcttgttttcaatgggggaaaagggctaaataatcaactagcaattcgggttataaatataatttaacatcatcggattagacctacttatcatattatcatactcatatcatatcataaaaatacaaatttagaatattttttataaactattaactgacaattaaagaggcaaaataatcattatttttcataatctaatgattctggactaaaaaatgtacagaaattatttctgcacatttatctttgtcatttatctttgtatagcatgtctatattatttaaattattcgagttttaagaagaatccacttttttgcattattttgatgaaatcagggacactgtctgttcgattccaatcacgttggaactcacaagcaatctgagccaaacttgtcatttttgctccagcttgttccacacgccgtaaggccatttcatgcgctgttttgcttgttccaccaacagcatctacaggaacaaagacttcaaagccttctttcaaagcatctaaggtaggaaaagttagacaggcctctgtccaaagcccacatataataatgttttttcggccaattttcttaactgcttcgttaacttccttatcttcccaagaattaattgaagttcgatcataacttactacatcacttaataattctttaagttgggggattgtttctttattgcgaccagttactacattaactgtagacaatacgattgggacatcaaaggttttcatcagctctgttaaattagtaacatttctaattaagtcttgtttgttcattgaattaatagaattaacctgagttggttggtaatcaatcaacagaaacatactattctccggtgaaagtaactcatctgtttctgggtttctaggttctaaacttgtcatgtgaatcctcctttatgcctaaactatatcattatttttcttttaaagcaacctttctgtaattaaacttcaaccaaaaagaattcgtaattttaaatcatgatacattgtaacttattggttacaaaacaagagcctaatcctcttttactaccggatttgtctatatttacttactccttatctattagattagtcataaaaaaagttactgacaagaaactgtcagtaactttttattattggccaaggagttcttgagctttcgctttgtattttgtcatatcaattgaaagtcctaaacctccatacatgtcataagcgttttcccagtcattatctgccgggatagttgttgagttaattccatttttcatatcaaacaaggttgtaattccctttgttaagaagaaagaattaggaatattggtcattgtgacggctcttgtcgttccaagagcacttgatgcagtgaataaagcaagtggatttttcattttagacattactgtttctaaaacttgttgttgacgcttaacacgcccataatctccctcatcatcatgacggaaacgagcatagtttaacaacatgcgaccatccatcttttgagttcccggtttaatcatcataaatgtaccactaccatcaggataacccaattcggcagccttttcagcagtcaagtctttatcatttgaagttttcccttccgttgcagcaaggtcatcgggtacaggtacagctgatagcgtttcaccatttaccgttgagaattttgcatcaattttcaggcctgtcgggaataaagaatcaataattgtcgcaaagcttgagaaatctactaccgcgtaatattggcaattaatgccaaaatttttcttcaatgtctcgctcatcaggtttacaccttgtttgttatattgttctccaattgtgaaggcagagttaatttttgaatctggactatcacttgaacctacatcaggaatattgacaagggtgtcacgcataaagctgacaatttgtatattatggtctttaccattaacatgtaaaaccataatactatccgtatgagcaacaccagaagattgccagggcctttggtcagccccaagtaacaaaatatttactgaaccatctgagtttttcaaacttgtaaatttttcttgttttgcaggacttccttcatgcttgactccgcgttgatagccgtacacaaagaaaccaaccataagcacaataatcaagataataattccaaatattgttctcaaccaatgtcgcttctttttcttaccagatttcgcctttttggaacctttgttgcctgtagaaattttatttctatttttttctgggcttgggctactttctcgtgtatttcttctattagtattgtagttattagagggtgattccaaatctctttgttgaaaattttctgattcataatcggaatattctggttctgtatattcttcaaattcttcagattcagaataatttccttcttttttcagttcattgagtaactcatagtactcttgacgctctctaattgtgagataatcgatattatgtctcaaatattctaagcgtttatactttttttcattcattgtcatattattatatcaaagtttgataattcctgcaaaaacttgcaaaggatttataatacagaaaaatataaaaaaactcattttacatgagttttttggctttttcttcaataaattgaacaatttctttaatagtttttcctgtactatcaagcaaaattgcatcctctgcttgttttaatggagaaactactcgtgtgctatctttacgatcacgttcagcaatttcaacttttaagcgttcaagatctgtcggaattcctttagataagttttctttataacgtcgctcagctcgttcatcaactgaagcaactaagaaaattttcaaatttgcctgaggtaaaacaacggttccgatatcacgaccatccataatgattccacccttttgagcaattcgttgttgttcagcaaccataaactcacgaatttccaccattgctgaaattttagaaacagcattcgttacttcgtttgttcgaataacttcagtcacattatccaaaccaaccagcacttcttgaccatttttcccatttgcaaaagaaattggatgattttcaataaattggatgatttttgaagcatcttctgttttttcttgcaaagcaactaaagtagccactcgatacatggctcctgtgtctaaataaatgagtccaagatttcgagcaattatttttgcaacagttgattttccacttgacgcaggaccgtcaatcgcaatttgaatctttttcatagaacctttatcgttaccttatttcttattttctcttttaggccaaattttactgacagaattaaaagaaagattttcttctataatatatgcttatttaactttctgtcagtgaaattttatttcaattttaaaatttgcccagcatgaatagctgacccatcagcattatatccgtcagcactaattccatttaggctggcaattgtcgcccaaggaatacctgtcttagccgcaattgtacttgggtaatcccctgttgcaattgtataggtataggtatcggcagcttctgagctactgcttgatgatgaagcagccgtactactactagctggtgtactagcttctgttgatgaagaggccgggacttgacttgatgcttgttctgacttagatgctgatgattgatgaaagcttttagcaatactagctgtatttcttacttgattattccataaaataaaaccaatagcaaatccaacaagaatgaacatgaggacaacaagaaaagttaaaaagcgtgtcgtcaaaggacgtttgctttcttcttttcctctatcatgtcttttcatttcagtcgattcttctttcatcgcacgataaatttcattattccagggttcttttgttgacacgaccttttcctttcaattttactatttttttattatcatttgttatatgaagataaaaataattcccgataaatgtatcgcatgtggtttatgtaatctccatgcgccagaaacttttgactactatgataatggtatcgtaaaattttacgatacggatgaagttcaaaaagaactttcagaaacttcctcacttcttctcgctgtcaaatcatgtcctaccggagccctcaaaatttcaagggattagtgtattattttatcaactactattctaccataagtttttcgattcctgtcatttttcaaaaagatttatcttactttgataatctttttttattttgaacataaaaaaactcggtttaaagctatctatacaaattaattataaagggtttccattccttaaagaacaactgtaatatttttatgaaaacatttgcaaatatcgatttgaagtagtataataactaagtaataatttttattataatcttatataggaggttactcacattgagtatcggaattgttattgcgagccatggtgaattcgctgcaggcatcaaacaatctggttctatgattttcggagagcaagaaaaagtacaagttgttacttttatgcctagcgaaggaccaactgatttgcatgctaaaattgaagatgccatcgcaacatttgatgctgaagatgaagtacttgtccttgctgacttatggagcggttctccatttaaccaagcaagtgcagtgatgggtgaaaatccagagcgcaagatcgctatcatcacaggcctcaacctgcctatgcttatccaagcctacacagaacgcatgatggacgcgtctgctggagtggataaagtcgtagcaaatattatgaaagaagccaaaggcggtattaaagtacttcctgaagaacttcaacctgctgaagaaactgctgttgcagctgctccggctgctgttcaaggtgcaatcccagaaggaacagtcatcggtgatggtaaaattaaaattaacctcgctcgtattgactcacgtttgcttcacggacaagttgcaactgcttggactccagactcaagagcaaaccgcatcatcgttgtttctgacaccgtttctaaagatgaacttcgtaagaaactcatcgaacaagcggccccaactggtgtaaaagctaacgttataccaatcaagaaaatgatcgaagttgctaaagacccccgctttggtgacactaaagcacttcttcttttcgaaactccacaagatgctcttgcaacaatcgaaggtggtgtaccaattgatacattgaacgttggttctatggctcactcaactggtaaaacaatgctcaacaaagttctttctatggacaaagatgacgttgctacttttgaaaaattgcgtgacctcggagttaaattcgacgtacgtaaagttccggctgattctaaatcagacctctttggtttgattaaaaaagctaacgtacaataatcagaatatgctcgtctgatattctgattaataaaattgaatattaggcagctaattaattaaggagatataaaaaacatggaatacggtgttttatctgtaatcttggtcattctcgttgccttccttgctggtcttgaaggtatccttgaccaatggcaattccaccaaccaattatcgcctgctcgctcatcggtattgttactggtcacgcatctgcagggattatcctcggtggttcgcttcaattgatcgctcttggttgggctaacgttggtgccgctgtcgcacccgatgctgcccttgcctcaatcgcctcatctattttgatggttcaatcaaacaactttgatttgactcacatcatgggtactatcgttcctgctgctatcttgcttgcaactgctggtcttgtattgactactcttgtacgtatgctttcagttgtgctcgttcaccaagctgaccgtgctgcggaaaatggttcttacacaggtgttgaaatgtggcacttcatcgcgcttatctgtcaaggtttgcgtatcgctatccctgctggacttcttttggttatctcacctgaagctatccaaaacgcacttgctgctattcctccagttatctctgatggtcttgctgtcggtggtgggatggttgttgccgttggttatgcaatggttatcaaccttatggctactcgtgaagtatggcctttcttcttccttggtttcgctctcgcaccaatctctgaattaacattgattgcaactggtgtcctcggtgttgttatcgctatcgtttaccttaaccttcaatcttctggtggttctggaaatggtactgcatcatcatcaggtgacccaattggcgacatcttgaacgactactaagaaaggaggatctaaaaaatgtctgataaaaaagtaactcttgataagaaaatccgtcgtagcgttatgtggcgttcaatgttcctccaaggttcttggaactacgaacgtatgcaaaatggtggttgggcttactcgctcattccagcattgaaaaaactctacccttctggcgaagaagctaaagaagctttgaaacgtcacttggaattctttaatactcacccatacgttgccgctcctatcatcggtgtaactcttgcccttgaagaagaacgcgctaacggtgctgatatcgatgatgccgctattcaaggggtaaaagttggtatgatgggtcctcttgccggtatcggtgacccagtcttctggtttacagttcgccctatcgttggtgctatcgcagcttcattggctgttggtggttcaatcatcgctccactcttcttcttcatcgtgtggaatgcaatccgtatcgctttcttgtggtacactcaagaatttggttataaatcaggttctgcaatcactaaagaccttggtggaggacttctccaaactgttactaaaggtgcatctatccttggtatgttcgtccttggtgtattgattcaacgttgggtaacaatcaacttcaacggtgctaacgctgttgtttcaaaaattcctttacaaaaaggttcttacgtagaattccctaaaggttctgtatctggtacacaacttcatgagattcttggtcaagtaggtaacaaactttctcttgatcctacaaaagtaacttatcttcaagataacttgaatcaattgattcctggtcttgctggtttgcttatcacattcctttgtatgtggttgcttaagaaaaaagtttctccaatcgttattatctttggtctcttcatcgtgggtatcctcggtcgttgggctcaaatcatgtaatcaatggattaacaaaaaccaatcttcggattggtttttttattataatttatcacttgaactttagaatatttagagcaagtaaagcgtttttatggtataatggtttttagattattaatctatgaaatggagagaatctgtggctcaatcactaaatactaaagctgattattcaacagaaggaattgtttatttgggttttgctgaatatggtaaaattctaattggcgatgttgcttttgaattttataatgatcgcaatgttgaaaaaaatatgacttttccttggacttcagttgctcgtgtcgagggtgacgtctctaaaacactcaagggtgaagttaaagtcggtcgtcagttttcaatcgttctacaaaacggttctaaagttcgtttttcttcgaaaaactcaggaacagttttaaaatggattcgtcattatctaggaaacgaaaaagtggttaaatcgccaagtttccttggaacttttaaaaatgcttttaaaagaaagaaaaaaaaataaaaaaaatccctgtttggggatttttttattagttgggacatgagcagtcacttgtcgcgcaagtgcaacttctttctctttttcttagtccaaatctttcaagaacttgctgacgataagaaggacgtccaatgaatcgtgtcactttactaaaaataaaacaagataggagtgtcacaaaaaagtttggaagggccagataagttacaagtgctaataacatcacaacaatatcaatcccaaataatgtcttatcaatagatattttccatttgttttcaaaaagtcgagctaagagaatagagccaccaaatgtcccctgtgataagacaactaagcctgctccaatccctgaaagaattccatcaatcacccctacagcaattaatgagtccatttgaaagcctgtaattccaatagcctcatatatcatcatccaaccgctcatagctaatgctcctgggatggtcagtaataattctctttgttcaagtaatttccaactgacaagaaacaatggaatattgaccgcaaaaaaggtcaaggctggattgagaccaaaaacaaaatgaataaagactgaaaatcctgcaattccattgcttgccatagcattaggaacaacaaatagttgaatggataaaatataaagtcctacaccaatgagtagtatgaataagtctctgagaaatagtcgatcaatttttactccgattaaagtcctcttacctcctttattagttttttcttataatctaatgataacatttttataattaatctataaaccatatccctctttggaatcaaaatttattatctactcctttgtatatattttataatacaagtatcaatggaaatgagggcgattttggaagctaataattcagaaatttttttggagacaaagggaacggcttatttaggtgtcgttgaaaatggaaaatttattttaggaaatgctggaattgaatttcaatataaaaatcctcaccgtgggaaaaatattttcttttcttggaaaagtataaaaagtgccgaagttgatgtttcaatcagcggaaaacttggtcagcaattttctttaattttggacactcaggcaaaagttcgcttttcttctaaagattctggtcccattttaaagagagtggctgaatatgtgggcaaggaaaacattgtcagagccccaagtttacttgatcctttccgtcgagctttcaaaagatagaaaatgtttaatccagcagcaatcagttttaaaatttttgacaaagtaattcacaaaatggtaaaataattttagaaaagggtcttgtgaacttttttagagagcttgcgtttggtgaaagcaagtaaaattaagcaacgactttctacttcttttaaatttctcatgaaaatgagaacgttctgtttacgttacaaacatgagagttctatttttactgacagatttttcagtaaatcaatagataatttaggtggaaccgtgcgattatcgcgccctaattcatttcgaatttgggcgctttttttctactgacaaaatattttttgcttacttgtagcgtttgaattttcgtcagtagattgattataaaattaacaaaaaataaaggagagcttatgcttgatattaaaaaaattcgtgctgattttgatggcgttgctgcaaaattagctactcgtggtgttgaaaaagaaaaacttgaaaaacttcatgacttagacattaaacgtcgtgaacttattgtaaaatctgaggctttgaaagctgaacgcaatagtgtttctgatgaaatttcccaagtaaaacgtgcaaaaggtgatgctagcacacaaattgcagagatgcaaaaagtttctgctgaaatcaaagccattgacgctgaacttgctgaaatcgaagaaaacttgaatgaaatcatcattatgttgccaaaccttcctcatgaaagtacgccaattggtgctgatgaagatgacaatgttgaggttcgtcgtgttggtcaaactccaactttcaattttgaacctaaagctcattgggatttgggtgaagatttaggaattttggactgggaacgtggtggtaaagtcactggttcacgtttccttttctacaaaggtgctggcgcaagacttgaacgtgccctttataacttcatgcttgatgagcatggtaaagaaggctataccgaaatgatcactccttatatggttaatcaagagtcaatgtttggaactggtcaatatcctaaatttaaagaagacacttttgaattgaaagatgatcgtggttttgtcttaattccaactgctgaagttcctttgactaactactaccgtggtgaaattttggacggtagcgaattaccaatcaaatttacagcgatgagcccttctttccgttctgaagctggttctgctggtcgcgatactcgtggtttgattcgtttgcaccaattccacaaggttgaaatggttaaatttgcaaaacctgaccaatcttatgacgaacttgaaaaaatgacagcaaatgctgaaaacattctgcaaaaattgggtcttgcttaccgtgttgtggctttatctactggcgatatgggattttctgctgctaaaacttatgatttagaagtttggattcctgctcaaaatacttatcgtgaaatttcttcatgttcaaactgtgaagatttccaagcccgtcgtgcccaaattcgttatcgtgatgaagatggtaaagttcagctccttcacactttgaatggttctggacttgctgttggacgtactgtggctgctatccttgaaaattatcaaaatgaagatggctcaatcactgttcctgaaatccttcgtccttatatgggtggacttgaagtaattaaataataaaaaaatctactgacagaaattttttggtcttgtcagtaggtttttttgttgaaatttttaagtttgaaatagtagtaattatcgaaaactttgaaagcttgagaaagatataaagtattgccggaaatattttcccgccaagtttgaataaaaacttcttgtttctcactattcttatttctatctaataacaacagaaaaaacttcttggcatatctgatgttatccttaaatcttagagtcactattcgattttttatggtataatgttttgtaaggctgtgtaccagccaaattgttggaggaattttttttacaaatgaacgaatttgaaacactattaaacagcgttgaagacgttaaagtacgtgacgtcgttaagggcgaaatcctttcagttgaaaacgggcaagcaactgttgccatcgtaggaactggtgtcgaaggtgtccttacacttcgcgaaattactaacgataaagatgctgatatcaatacattcgttaaacctggtgatgttcttgatttgcttgtaatcaaacaaatcgtcggtaaagaagctgaaggtgctaacgtatatctcctttcattgaaacgtcttgaagctcgcaaagcttggactcaattggaaggcaaagaaggcgaaatcgtaacagttaaagttactaaagacgttaaaggcggactttcagtagactataacggtgttcgtggatttatcccagcatctatgattgatacttactttgtgaaagacactaagaaatttgtcggcgaagaaattgaagctaaaattatcgaagttaacgcttctgaaaaccgctttatccttagccgtcgtgcagttgttgaagctgaagcaatcgaaatgcgtaaagaagcttttgcgcaacttcaagaaggcgacatcgttgaaggtacagtttcacgcgtaactaacttcggtgctttcgttgaccttggtggtatcgatggcttggttcacgtttctgaactttcacacagccgtatcaaacgtccatcagatgcagttaaacctggtgacgttgttaacgttaagattttgaaactcgatccagaagctggacgtctttcactctcacttaaagctacacaacctggaccatgggaacaagttgaagaaaaagcaccagttggctcaactgttgaaggaactgttaaacgtttgacagacttcggtgcctttgttgaactttatccaggtgttgaaggacttgttcacgtttcacaaatttcatgggaacgtgttgaaaatccaaaagatgttcttaaagttggtcaagttgtgaacgtaaaagttcttgacgtgaaacctgctgaagaacgtatctcactttcaatcaaagcgcttgaagaagctcctgctcgtccagctcgtaacaacgacaacgacggtgaaaaacgtgaccgcaaaccacgcgcaccacgtaaagcagctaaaccttcatacgatttgcctgaaacacaagaaggcttctcacttgctgatttccttggtgaagacttcgatattaacgatttgtaagaaaaattcaaaaatatcctctaaaagacccgttgggtctttttttgtatagaaaactaagaaacaattaaattgcaaagtttgataatttataaattttatgggaaattcacagaaatctaacataaaaactagtagttctcctgttaaattttttttataataaggatgtaaaaaataaaggagaactacaatatgaaaacaaaaaattcatttcgaacatggaaatctggcaaaacttggttgtattcatctttaatcttaggtggtttactgctaagttcaggcttatctattaacccagcaaaagtatcagctgaaacaatgggaaccaaaagtagtcaaatgacctcggcaactgatattacaatgggactgcaagcaaacctcaaagcgacaacaaccatatcagcagcacaattggcaaacgctcaagcacctggtccgttcacagcaggtgttaatcaagtgattccttttgaagcttttgggggagacgggatgctaacacgtctgttacttaattcttcaaataatgcggcttggtctgacaatggaacagctaaaaatccagcacttcccccaatttcaggtcttgaatcaggaaaatacttttatgaagttgacttagcaggtacaaatggagcgacaggtcaaaatctacttgatttattacgagctaatggaagcaaaaattatgaagcgaccgtaaaagtttatgctgcagactcttcgagaaaggcagatactagcaaagtagttgctactaaaatgattcaggtggatttggctggattgacggataacattaagaacaccacaaccgtatcagcagcaaaattagcaaacgcgcaagcacctggtccgttcaccgcgggagttaaccaggtgattccttttgaagcttttggaggagatggaatgttaacgcgtctgttacttaactcttcaaataatgcagcttggtcagacaatgggacagctaaaaatccagcacttcctccaatttcaggtcttgaatcaggaaaatacttttacgaagtggacttagcaggtacaaacggagcgacaggtcaaaatctacttgatttattgcgagctaatggcagcaaaaattatgaagcgactgtaaaaatttatgctgcagactcttcgggaaaggcagatactagcaaagtagttgctactaagatgattcaggttaacttgactaaggaacaaaatacggttgctagtcaagaggtctatcgtttatacaataaaatgagcggagaacatctttatacaacaagtgcctatgaatacaatactcttacaatgacaaatagtagttggtcaggcgaaaaagtagcttggaaagcaccaaaaactggtaataatgtttatcgagtttataatccaaattctggagaacatctttatacagaatcatcatttgaagtaaatagtttagtaaaacaaaatggttggaaatcagaaggagtggcctttcattcggattcaaacagcggaacaccggtttatcgtctctacaatcctaattcaaaactcggtgctcacttcttgacaatgagttcatatgaacgagatagcctggtcaaagctggttggaaatcagaaggaattgctttttatgcgataaaataataaactcaagctattgatgaaagacttaaaaattaatttttaagtcttttagattatgaaaatcctttagaatttcagaagattgaacctttttaatgttttttgctatactatgagtatgaaacgacaaatactaattattgaagatgaagaaagtatttcaaatttattggaaactgagctttcgtttgaaggatataatgttttatcggcagcagatggaatgtctgggctaaaaatttttgaagaaaaacaagaatacttagatgtagttttgcttgactggatgattcctaaacttgacggcttagaagtcttacggcgaatgaaaaaaatgactaataaagttccagtcattttcgtaactgcccgtgactatgtaggggataaggttgctggtctagatgctggagcagatgattatttaacaaagcctttcaatattgaggaactcatggcccgtttacgtgtaatttttagaaaaaatactcaaccggctatttattcctacggaacggtttctcttaatcctggtgaacatacagttgaatatcagggaaaagcaacaagtttaactcaaagagagtttgctttactccttttcttatttgaacatcaagtagaaatcatctcgagagatgacatattagaggaagtttaaggaatgaattttggaggtcagctaaacactgttgacacctatgtcagatatttgcgaaaaaaattagataaaaatatgatagaaacaataagaggtctaggatatcggcttaataaagataaatagagaaaataaaaagaagaaaatttatacgaatgaacagctgattcgtaggatttttcaacgaatttttcttttactattaacatttagtggtttaacttttattacttatagtttggtgcaaatcagtgatcgagaaacaagtgcgattatgacaggaatgaaaaatgtttcaaatttatctacgatgaattttcaagatttaaatggttttcaagaacaaaaagattttattcgtatccgctcacaagaaaatcaaacaataatgagtaaaggaaccgaaaactttttagaaaatcgaacatttagtttctggaagattacaatatcaaatggaaaactttatgatacagtctataagaaggataagggaattacttatgaaatctggctttctcttcaggatatatttgaagaagttggagctgttttagctagtgtctttgctatcttgcttcttaattatttaattggattacttctaatcagacattactcaaagaagataaatggaccaattcagaaattggcctttgaggccagtcaagacagtggtttattggaagtaccagaagctccagtagaagtaagagagctcgcaattaattttaacgagttggttaaaagcttgcaagaaaaaatagagtctgaaaaagaatttgcctcaaatctatcccatgaattaagaacgccagttatggcaatttcgggttatatttctttactcaaaagaagaagagaagaacacccagaaattgttgaaaaatcgctaaattatttggaacaagaatctgaaagactaaaaaaattaattgaagattttctaactttatcaagaaaagggcagattgactatcaggaagaaattttcacaactaaaagtttactgttagaaattaagtctagctttgaaattgattcatctaataaaatagaaattgagggcgacgacaacttacacattaagacaaatagatttgctttgcgagagattttaaatattttagtggaaaatgcaataaaatattcgcctaagagtagtatggttttgattaaatatgataaaaaggaaattcaagtcattgatcaagggataggagtttctgataatgaaaaagcaaaagtttttaatcgcttttatcaagtagagaaatcaaggacgaatcatactggaaatgggattgggttagcaatcgcacaacaatacgcacaaataataaatgctgaaatttatataagcgataatctcccgaatggaacgacattccatctttcttttaagaatgtgaatgagaaataaagataattcaaaaagacctaatgaggtctttttttctacaatttaataattaagttcttttaattgtttaaaatatttgctataatttaattgtttcaaacaaatcaaataaacctttatgaaatgaaggagtgactaatggaagagttacaagcacacatccaattgaagaaaactgatgcagtagaagatgcaattattgtaggtgatccagcgcgggtagaccaagtggcaaaatttttgacggaattcagagaattaaaatataaccgtgaatttcgttcacttcgtggcacctataaaaacaaagaagtcttagttctgtcaacaggagttggggcgccgtcagctgctattgccattgaagaacttcataatattggagttaagagaattatcagagtaggctctgctggagctttgcagttagggattggtttaggaaatccaattattggagaaggagcagtgcgtgacgatggtctgacaaagatgtatgttccagaacaatatccggcagttcgctctagtactttactagcaaaagcaaaagaaattgcacctgaggccatttatggaattattcgttcgcatgacggtttttatatggataataatgaacagacacaggaatattggtcaaattttggacttattggtgaggatatggagtctggagccttatttactgttggacgtctgcgaggaatagaaactttatctattttaaataatgttgtagcttataaagaagatttacaagccggggtaaatgatttagtttcaggggctgataaggtcattgaaggtgaaaaacgaacaattgaaattgctttagaagttttaaataagtaatttgaaaaggagaagaaatgacaaaagaatcatggctttttaaacaactttttgcaaattggaaaaagtttgaaatcacatatattgctattttattgttattacaaatcattgtttatattattgctccggattccttcattgggatgatttcgggtgtctttggagtgctttgtctcatttatgggatgaaagggcgtaaaattaattttgcgtttggattgatacagactatagcgatgactttaatagcttatcagacccattcatggatgagttttgtaatgggaattttttatattttatctcaacctgttggttggtttttttggggacaagatgatgctattcatgaatttaaaccaaaaactcgtcgactgatatttttaggagcttttattgcttggctaatcgtttgggttattgatgcttttttaaatggccaacttccttattttgactccttaaatctgattatcccacttatcgcgcaaatattatacattttgaaatataaagaaaattggtcactctggattgtggttaatactgccgccgtggtctattggtcaatattgacaatacaatttataatggacgtaaatactcaaggtcaattgggaatgtatttatcacaagttgctctgcaaggagccttactcttcaatgccatctatgcaaatcgggtttgggcaagcggcgaagcggataatgaaggtggtacgaaatgattagtcaaaataccctaaggatttagggtgtcttttgttcttattaacatccaaaaggagagcagctcctacatttttttgctataataaacattatgaatcaaacgataaaagcgaagttggagctattgcctgatagccctggctgttatttacataaagataaaaatgggactgttatttatgtcggaaaggcaaagaatctgaaaaaccgagtgcgctcttattttcatggttctcataatacaaagacagaattattggtttccgaaattgaagatttggaatggattgttgtaggttctaatattgaatctctggtcttagaaataaatcttattcaacgttacaagccaaaatataatatcatgcttaaggatgataaatattatccttttttgaaaataacaaatgaaaaatatcctcgcctgttagttgtacgtaaagttcaaaaagatggggcgacttattttggaccttatccagatgttaaggctgctaatgaagttaaacgacttttagaccgaatttttccttttagaaagtgcggattgcacgagaaaaaagtctgcttctattttcatatccatcagtgtttatgtccggttgttaatcacgttgatccacaagtatataaggacatgactcaagaagtcaaagagtttctaacaggttcagataaaaaaattgttaaagaacttgaaggaaaaatgataagtgcttcagataatatggaatttgagcaagctgccgaatatcgtgatgtgattaaggcgattggaaccttaagaacgaaacagcgggtgatgaatcaggatttgaaagaccgagatgtatttggctattacgttgataaaggatggatgtgtgttcaggtctttttcgtgcgtcaagggaaactgattcaacgagatgttaatatgtttccatattacaatgatgccgaagaagatttcttgacttatattggtcagttttatcaagataataatcatatgatgccaagagagatttttattcctcaagatattgataaggattatgtagaagcagtagttgccgccagtcaagaaggaaatttgctgacaaaagcgcaagctaaagcagtagatgctaaagtctttacggcaaaaacgcttaaattttctgaccaaaaagatgttgagcaatcaattgtcaaactagataaagaattatcatcagagaaacgtttgtcttcacttttagctaaaacacagattatccaaccaagtcgtggagagaaaaaacaattggttaatatggcgaccaagaatgctcagactcaattacagctgaaattcgatgtggctgaacgtgacattttaaaaactactaaagcagttgaaaatttagggaaaattttaggtataccaaaaccggttagaattgagtcttttgataattcaaatatcatgggaacttcaccagtgtctgcgatggtcgtatttattgatggaaaaccgtcaaaaaaagattatcggaagtataaaattaaaacagtagttggagctgacgattacgcctcaatgcgcgaagtgatgaccagacgttattcgcgagcgctcaaagaagaaactgctcttcctgatttgattgcaatggatgggggggcaggtcaagttaatattgccaaagaagttttgcgagaacttggtttagctattcctgtagcggggatgcaaaaaaatgataagcaccaaacatcagagttactttttggtgatccactagaggttgtccccctatcaagacaatctcaagaattctttttactgaccagaattcaagatgaagttcaccgctttgcgattaccttccatagacaactacgtgggaaaaatacattttcaagtaagttggatggaattgttggattaggaccaaaacggaagcaaaaattgctgacaacttttaaaaatttaaaagcgattgaagaagcgacagttcaagaagttgctgaggcaggagttccttatgaagttgccgagcgtgtcaaaaacactttgtctgctcctcataaaagcgatgaaaattgggaatccatcaaagataatgttcctcttttaaaaagtgaaaagtcataagcaaaaggattgtcagtaaaaactgtcagttcttttatcttgtcagtaaaacaaagaagagtgcttgaagcatatcgaaaatgtaaatggagaattgatggactggtctaaaaataaaataaaagaatttcaaaaagatttactttcttggtatgatgctaataaaaaaccattaccttggcgacaaacgaccgaaccttataaaatctggatttcagaaattatgtcgcagcaaacgcaagtggaaacggtcataccttattttgaacgcttcatgaaaaagtaccctacagttgaatcattagctcaagctgatgatacagagttattaaaactttgggaaggtttgggttattattcacgagctcgaaacttaaaaattgcagcacaagaggtcgtgaacgaatataatggaaaatttccagataatttgaaagagattctatccctcagaggaattggtccttatacagcagcggctattgcatctatttcctttgatttggctgaaccagctatcgatggaaatttgatgcgcgtgacaagtagaatttttgaattagagtgtgatatttcaaaaagtagttcacgaaaaatatttgatgagcatttacggacactcgtcagtaaaaaaagacctggtgattttaatcaaggactgatggatttaggttcacttgtgtgtagcccaaagaagccaaaatgtgaaacctgtccgctgaataaatactgtgcggcagtagctgatggaaaacaattgaactatccagtaaaaacaaaaaatctcaaacaaaaagagttgtattatactgccttcgcattagagaattctctaggggaatactatttggagaaacgaccatcgaaaggcttgttagctgatatgtggacctttccactgacagaattatcatcagtagactttgaaaaaataattactgacggagcaatcagtaaaaatattaccatgccaaaacttcctgaaagtatatctaagatggaatacttcggtaatttcactcatatcttttctcatcaaaaatggcacattgtacttatcaaagtaaaggcagaagagaagtttgaaattgctgatgaattactgacagctgataaaaaatgggtttattatgattcaaaaaaattaggcgaaaatgttgtcaatctaaatcaggatttatcaaagataagccgtttaaagcttccactttctggtccgcaagtgaaaatgtttgaactcttagataaaaaaatatgaaaactattgtaaaactctattggttcacactgtaaattaaataataaaaaaaacattggcaacgcgaaccaatgtttttttgtgttggagtaaaataatatgttaagaaaaagttagtagatccaacacaaataggtctaagacattcaaatttataaataaagaatttattaaatctatctcttaaaccacttaagttattcctccgaagagtaacgacgtaattgtaacaatcaagaaaacaaaagtaaaaaataatgattataagtaatttattatattgagtatttataaaaaaattatgaggttttggattgataaggtcttaaaaaagccaataaatcatggtgctataaaaaataagtttcttattattagtattttataaaaatctataagattagttaagttacggtttgatactgtaatatctctgtatgatgacaatatctttaaagacagaaaactaaaaaagggtacttagtttgatttgaagtaataagtgaattctcataaaataggataaagagagtattttatagcttacgattttataattaataatagacatagtcacttattaattgtataatagagtagtcatattatgttaaaaaaataaaacaaaatcaatcaaaagaaataaaaatgtgataatattaggctttggactacgacaaatttcttatatacctattaaatgagatataaaagacaaaaaaaccatcatattaacacttaaaataactaaagaataatttcactaaattatatggcatacaattttataatactgatgggatttatattcgctattcgccagttcaagaaacattaaattatgtatcggaatatccctccctgacaatatatgcaaacggggatctagcaattgaagaaacaggagatgttattgggaacatttccacttctgaaccagctgtagaatataaaaaatatatattagaaaaatggagaacaaacaaatgaagtatagattaaacccattatttacgctcagaaaaacagataaagcggtcttcaatttctcaagggcggaattaacacaattcaacgatacaggttttgatattttattggcagttcttgaacaagaaagtgatagagagtggacagatgatgaagatgaattcctgaaagagttaatcaaggagaaaatcgttgaagaatcttgaagagcttattcaactaagaaaatcaaataaatttcataatattggtgtaaatgttgaaagtgtaatagaaatagtaaaaaaatcctactataattttgagaaacatagcgttccttctgccggagctatatatggtttgaaagttttacttttttataagaacaataaaaaaatatttaactctaaaggggagataagtacagataaattcgagataaatcaaattaaaaaaacttgtttttatgatgataaatatttttcttcaagttcaattcttattgctgtgacatatgattacgataaatattttggcaaatatggtaattgtggggtaaggtatgctttaatcgaatgtggtgcttttctgcaaaattttcaactactactttcagaaaaagatatatacggttgtccattaggcttcgtagataatgatgctctgttgggaatagaagaacccctaatttattttattattaattaatctttgataagatatccgaagtttaggattcttatataactatttgggctcaaaatagtaccataataaggaggaattttcatgaacaaagaaactgtgaaagatgttcgcaaagaacataaagaaaaaccagaatttaaaacaatttcattattagcatgcatgaactcgacttctatcgctaattaattattgatttttatataaatataaatcaatggagtgaaaagagcctatatcgaaattgatttataccttttgatagttgtataagctataataaaaaacgctctgacgaattcatcagagcgttttaattatttttatcaatagattattagtattggtctaacaagagttgtttgatctcatcaattcttggttgacgtaccattgcgacttcctgctttagcaggttagcgagcatggatatcgttcggttccaaatactataatcaatatattaatattggtctaacaagagttgtttaatctcatcaattcttggttgacgtggattagcaggtgtacattggtcatcataaacaaggtcagccaatttatcaagctcacgttcaagatgagctttatctacaccatttcctgaaagggtgatattaatatcaatactatcagtcaattttttaagttcagcaaccaaagctttgaccgctttttcatctgaatcttctttgccagcaaatcccatgaagcgtgaaatttcagcgtagtcttcttgcgcacgataagtttcataacgtgggtaaggggtacgtttaacgtttcctgttacagcgttaaatttaatgacatgtggcatagcgatagcaatggcaagaccatgaggaagtccaaattcaccaccaattttatgagcaagtgagtggttaattccaaggaaagcattggcgaaggccataccagcgagtgttgcagcattgtgcatgttttcgcgagctttttgaccttctttggttggatgagctgggtcatagtgataagactcagtcaagttttcaaagataagtttgatggcttgaagtgatattggttttgtatagtcagaagacatgacagaaacataagattcaagcgcgtgtgacatggcatcaatcccagaccaagaaacagtacgttttggtacagtcataacaaactcagggtcaacaatggcaacttgaggtgtcaattgatagtcagcaagtggatatttaacgtgagtttcatcatcagtgataaccgcaaatggagtcacttcagaaccagtaccagaagtagtagggatagcaaccatttgtgctttgtgtgggtggtagaatttgataatacgtttacgaatatcaacaaatttttgagctaactcttggaagagctctttcaaacttgcgtcatcggaaaggtcagcctcaccacgagcatcatattcataaatcaaacgtccaatcttaccagcatcaagggcagagccaccaccaagacagatgacagtgtcaggttcaaattgtgtcatttgacgagcgattgcaatggcttcgctcaaagttgggtcaggttggactgagccataaatgcttgtttcaacttgagttgggcggatagcaagttgttccaaaactttatcaacgaaaccgaatttaaccataccagggtcggcaacaatgaaagctttgtggacgtgtggcaattcttgtaagtaagaaattgcatttttttcgtagtaaatttcttttggcaaacgaacccattgagggcgattacgacgtttagccactgttttaacattcaatagatcgtatgtactcaaattgtgtgaaagtgaatttttcccccatgaaccagttccgagcgtcaatgatggacgcattgcatcagtataaatatctccgaccccaccgatagagtcaggttggttaacgaggatacgagaagcttcgactttaattccgtattctttgacaaatgggtcgtccattgcaccgatttgaatggcagcgttgtgaccagctccttggtaagcaagtaagctacgtacaatttcaattccttcttcacgtgtttctgatttgtagattgaaagcaaaggagaaagtttttcagaagaaagagcttccccaatatttttcttatcaagttcaaaaagaagaacatctttatctttagggacgttaacaccagcttgttcagcaatccattgaccagaacgaccagcaacaggaccagttacaccaaaaccttcaccagcacgttcaacgaaaacaaaactttcaattgccttgtaatcttttttaggaaccatataagcgccttgggcttgcattttagcgacaaattcatcatagattgatgcatcaataactgcagagttttcagtcgcacaaatcattccgttatcaaaacgttttgaaagcaagagatcttcaacagcacgatcgatatttgcagttgcatcaacgtatactgcaccattaccagcacctacaccaagtgaaggattaccagacttaagcgcagcattgaccatacctggaccaccagttgcaagaattgtagcaattcctctattttgaatcaaagcagtcgtcatatcaagactgggtacttcaatccattgaatgaagtcttcgggtgcaccagcttcaatcgcagcatcataaacaattttagctgcatggcttgagcatttttgtgcttgtgggtgaaaggcaaagacaatagcattacgagtctttgcagccaataaagatttaaagatggctgttgatgttggattagttgttgggacaataccagcaagtactccaagggggcttgcgatttcaacagaaccagcaactttgttttcagcgataacgccaactgttttatcatttttgattgcattataaacagattcagaagcgaaatggttttttgtatctttgtcctcaacaactccacggccagtttcattaacggcttcgtgagcgagttccagagaatgtttgcttgctgcaagagccattgcagcaacaatagtatcaacttgagtttgtgtgtatccttcaaatttaagaactgcagcttgagcttttttgactaattgatcagtataagcgacagcttcttggaattttgcggctttttcttcagcgcttaaaactttctttgcagctggagcggcttttttagttgccatatgtgtacgttctcctttgtgatttcattcactttattttacgtgaatagtttaacaaagttttttaaagatgtcaagcgatattgtgatgaaatttacaaaaaaactcatcaaacttttagaaatcgctttataagcaagggtttcagacaaaaaaatattgccaatccttttaaagatttggcaatatttttttgtctgatttagtaaaactttgtgaaaaaacaaaagcaagatttactaaagtttagtttttacaaaggtaaaacacaagtaatttcaggagcgtaaaagtctttttgttctaacgttaatgaccctgtatttttatctctcaagaaaagagttaaattatcagattcttgatgagcgacaatgatataatcttcggttttattaaaattaaaatcgcgtggaatatgaccttcagtctttgtccaaccaatagcttctaattttgttccgagaggacttaccttgtaaattgctaaagagtcgtgcccacgattagaagcatagaggaacttaccatcagaagaaattcgaatagcagctactccattggctccgtgatagtcttcaggtaaagtactgattgtttgaagacgagcgaatcgtcctttttcttcattatagcttagaacttcaatagttgaatttaattctccgacgagataagcaatttttccattaggatggaagctgatgtgacgagctcccattcctttttcggcacgataaatcgtaacgatattgagtttaccttcaccaataacatcgtaaacagtcacttcatctgtacctaaatcacaagtaacaagacgaccatctggagttaaatcagagtaatggacatgagaacttgcttgctcaggtcgagggccagaaccattatgtttaactgtatcggttaatctaagggaaccatcagcttgaattttgtacacacgaacttcacccaagtgatagttggcaccataaacgagttgacgtgcttcatcaacagccacataacacaaaggggctccagtactcgttacattccctaggtgagttgtattttgaccatcaaaatcaaaggtagcaattccaccaccatttccatcagcagcacaagtgtagaggtgccctttttgatcaagagtgatataagttggattttgaaccgctgcaacttcagttaaagccgacaattcagctttcttgctatctaatagaacactgtaaacgcctttagatacacgtttagtataaccgcctaaaaggattttttctttcatatttctctcctcacaaactattttatttactataattattttatcacaaaaaaaagcgttttcagcaaaaatattaattttattcttagaaaaaaatgcaaaaatctcccttaaggggattatattggcaaaaatattagttaaatttgtcagataacattgagatataaaaaatagaataaaaagaaagtggagtaggatagttttcactgactcatattgataaaagaaataaatgaatagatgcttgcaaaagtagcttaaacaatgtataatgagagagttgctatgcaaccatctcgcatttcgtctcgacaaagtcgtagtgtacgcaagtattgcggctgcggatgacagatgaaagaggaaaaactattttaaaaggagacattaacatgtcagttatttcaatgaaacaacttcttgaagctggtgttcacttcggtcaccaaactcgtcgttggaaccctaaaatgaaaccatacatcttcacagaacgtaatggtatccacgttattgaccttcaaaaaactgtaaaacttgttgacgatgcttacaactatgtaaaaaacgcttcacaagaaggcgcagtagttctttttgttggtactaaaaaacaagctgctgaagcagtaaaagaagaagctctccgcgctggtcaatactacgtaaaccaccgttggttgggtggtatgctcactaactggaatacaatccaaacacgtgtgacacgccttaaagaaatcaacaaaatggaagaagaaggaactttcgaagtattacctaagaaagaagtagttcttcttaacaaagaacgcgaacgccttgaaaaattcatcggtggtatcgctgatatgcctcgtattccagatgttatgtacatcgttgacccacatgctgaacaaatcgcagtaaaagaagctaaaactttgggaatcccggttgtagcaatggttgatacaaatgcagatccagaaccaatcgacgtagttattcctgcaaatgatgatgctatccgtgctgttaaattgattacagctaaaatggcagacgctatcattgaaggacgtcaaggtgaagatgcagcggaagatttcgttgcagaagaagcagcttcagaagaatcacttgaagaacttgctgaaatcgttgaaggtaaataattttaacttcaacttatactaaattaagtaactacaacaggcgaggccttacgcctcacctgtttttttaaataaaactactgtcaatattgacagaataaacacataggagatttacaaaatggcagtaacagcagctcaagtaaaagaattacgtgaaaaaactggtgcaggaattatggacgctaaacgtgcgctcgtagaaactgacggaaatatggaagcagcagcagaacttcttcgtgaaaaaggaatcgctaaagcagctaaaaaagctgaccgcgttgccgctgaaggacttacaggaattgctgtaaatggaaatgttgcagcacttgttgagttgaattcagaaacagactttgttgcgaaaaatgaccaatttgttgctttggttaaagaaactgcagaacttcttgcagctagcaaaccagcaaacaatgaagaagcgttggctatcaaaacagcttcaggcgtaactcttgaacaagaacttgttcaagcaactgcaacaatcggagaaaaaatcactttccgtcgttttgtagtaattgaaaaaactgatgcgcaacactttggtgcataccaacataacggtggtaaaattggggttatttcagttatcgaaggtgctgacgaaacacttgctaaacaagtatcaatgcacattgccgctatgaacccaacagttctttctgctgatgaacttgattcagaatttgtaaaagctgaattagcacaaatgaaccacaaaattgatgaagacaacgctagccgtgtactcgttaacaaaccagaacttccacatcatgaatatggttctaagagccaattgacagaagaagttcttgcagcagcaaaagcttcatttgaagaagaacttaaagctgaaggcaaaccagaaaaaatctgggacaaaatccttccaggtaaaatggctaaatttatcgttgacaacacaaaagttgaccaacaattcgctcttcttgcacaactttacatcatggatgatagtaaaactgttgaagctttccttgaatctaaaggtgctaaagcaattgcattcacacgttttgaagttggtgaaggaattgaaaaagctgaaacagacttcgcagctgaagttgaagcagcaaaagcaggactttaatttgataaaaggagcaaccaaattagtggttgctttttttttgaaaaagaaaaaaggatttacaactagaaaactaagaaaatagtgtatttctttgacgcaatatgctataattatatttgagattttctatttaattaaaatctattaaccttagtaaacaaatatattttcaagtaataaaaacattttatggagtaaagcatgtcaagtactgtaattatcctcattgttgtcctattagttattctcgttgctttttacgcttttgcaattttgatgcgaaagaaaacggaggatcgtattttagccttagaagagcgaaaagagtcgcttttcgatttacccgttcaagaagagattgattctgtgaaaaaaatgcaccttgtagggcaatcacagacaattttccgcgaatggaatcaaaaatggcttgatttatcatcaaattcttttgctgacttagaagagcatatttttgaagccgaacagctcaacgattctttccactttttccgcgctcgcgaatctgtcgcagatagcgaagcccaaattgaaatgatggaaggagatgttgaaggaattcgccaaggggttgcccaacttgttgagcaagaaaaacgaaattcaaacaagattcaagaatctcttgatttgtatgataatttgcgtagcgatatcgcagataatgcagatttgtatggaacagtaattactgaacttgaaaaacatcttgctaatattgaaacagagttttctcaatttgtaacgttgaattcaactggtgacccaattgaggcagccgaagttttagaaacggcagaagaacatacaattgcattgcgtgcgattaccgaacaaatcccatcattcattaaaacaattgaaaaagatgtgcctaaacgtcttgaagaattacaagaagcaagtgacaaattcattgccgaagattatattctcccagagaatgttaatctcaaagagagaatggatgatttacaacatcatcttgaagaaagtagctcacttttggagcaatttgaacttgatcgagttgaagcagaacttgatttgattcaagaacgagtcgaagaactttattctatctttgagagagaatacagtgcacgtcgaaatgtcgaaaaacgttcatcggttcttaaagaatacattgaacatattagagtgaataacaaaaatcttcttcttgaaattgatcatgtgactcaagcttatatcctttcgggaaatgaaaaaggttatgtgagaggatatcaagaacatttagagtcattggatgcagatgttgatgaaatcatcgccaacattgaagctaaagcaattccttattcaagcctttcacgccgcgtgaactctgttgtcaattctttagaagatattgaaaaaaatcaaatcaaaattagcgagactctttcaggactcagagatgaagaaagagcagcacaagaaattgcagaacgttttgattctgaacttcgtactatcaaacgttatgttgaaaaatgtaatttgccaggacttcctaaagattatcttgatttattctttatgaccggagatcgagtgcaaaatcttttcaaagagttgggacgtgtaagaattaatattgatacaattaaccatcttgttgatgtgagtaccgaagatatgcatgttttgaaagaagcaacaattaatttgacagaccatgcagtattagcagaacaacttattcaatatgctaatcgttataaagcgtctaatgaacaagttgcacaaggcatttcaagagcacttcaactttttgaaaacagtcgcgattatgatggttcattcgatgaaatttctaagactttagaaatagttgaacctggtgccgcttcaagaatttccggagtttatttcaaaaacaaacctacaccagattatttataaaaaagtaaggattaatttccttgctttttttattttatttcaaaaaatagtttgataatttcagaattttctgtataataatgttaggtaaaacaaataaaaattattataatgaaacataaagatatattcatgtcttggaaagggcaaaaatgaagattcaacattataatagaattccccccctgacggcttattagacagtcattctcctccataatttctttaatcacttataataaattatgaaaaagaggaatatcaatgacatattacttggaagaaaatgaattcgaaggtttattttctggaatgaaaccaatcatcagaaaattgatgaaacaaattcgaatcaaagcatgggacatagaggattattatcaagaaggaatgattattttgcatcaccttttagaagaaaatcacccatccactaatatttatacaaagttcaaagtaaaatatcatcaacgtttgattgatgaactacgccatagctacgccaaaaaacggcttcatgaccattttgtaggtctagacatttatgaatgttcggactggatagatgcaggaggaagtacccctgaaagcgagcttgtgttcaaccatcttttagcagaagtttatgaaggattgagcgcccactatcaggaattactcgtgcgtcaaatgagaggagaagaactcacgcgaatggaatgctatcggctacgagaaaaaatcaaaaatatactattttctcgagatgatgattaaaaaaagctcccttatctttgataggggagttattattttaaaaaataataaaaaaaacaagaaaggcttcaagcgtttgctagcctaagttaaaacggatacataagtagattaaaacgaacgaagataaaaaaagattgaaaaagtgttatgatgattaaggacaaaagaagggaatgaggaatgcaaagtttaataaataaaatccaactttttttcgagcaaatcaataattttaatgataatcaaaaaataattgctttaggacttttgggcggtttgttagctgtcctctttgcttatcgctatttagctattttaatcactttacttcatgaatttggtcatgcttttatggcaaaagtcacttttgggaaggtttataaaattcatctaaatcctgatacatcaggtgtaacagaaacaactggtggatggcggagtctttttattttattatcaggttatcctagccctctactatttagtggactttttgtctggtttttgcgattaaatcatccagagttttttttgtttgtattgctttttgtcagtatctctgtcctttttgtaataaggaattggtatggggtgcttatttgtttactaggggtaatcctaacgggaagtttgatttattttggtcagtcagaagtttttacaggaattgcagggatgttgattgcctttcttactttgggagcttttcgggatgttagagctgtttttcatcatcatttagggccttctgacgctgatttattgcatgaaaaatttacatttattcctgcttttgtgtggaaacttgtcttacttttgcttatgtttcttgctctagttccggtgtggcgaggtcttgcgagtctattattattttgatataagagaatcaaaaacattttttgacaaagttctaaaactttgctataatctatctaacctttaagattgtccagagaggcaggcaaggtcagaaattaataatgtaataatatgatggatactgtccattttctgatacctacctgcattctctttggaatgcagcttttttgtatactgacggacatcttattaatggaagtattaatcgataaatgaaagatttgtcagttaactgacagattaatcattaagaatgaaaggagccccaaatggctagaaaagaaattattgacgaaatcacaatgaaacgtgcaattacacggatcacttacgagattattgaacgtaataaagaactggacaaattggttttgattgggattaagacacgcggtgtttatttggccaaaagaatccaagaacgtttgcaacaactggaaggtttggaaattccttttggtgagctggatacacgtccattccgtgatgataaacaagcacaagaagatacaacagaaattgatatcgatattacaggaaaagatgtcattcttgttgatgatgtgctctacacaggtcggacaattcgtgcggcaattgacggaatcgtaaaacttggtcgcccagcccgtgttcaattggctgttttagttgaccgtggacatcgcgaattaccaattcgtgcagactacgttgggaaaaatattccaacaggtcatgatgaagaaatcatcgttcaaatgtctgagcatgatggcaatgacagtattttaatcaaacgtgaagattaagaaataagttctctgtcagtaatttaagaaaaagagtaatctataagttactgacaaagttttcaataaatattcaacttagagttttaggagaaaaaagtgcacgataatgatattatcttaaaagttgatgagaaaccagctgccagtcagtggtttggactctcatttcaacatttgtttgccatgtttggctcaacggttttagttccgattttagttgggattaatccagcgattgccctattgagttcaggacttggtacacttgcacacatgagtgttacaaaatttaaggttccagcttacatggggtcaagctttgcttatattggtgcgatgactttactgatgaaaaatggcggaatgccagccattgcccaaggagccatgacaggtggtctggtttatctgattgtcgctctgattgtgaaatttgcgggtaaaggttggattgacaaagttttaccaccaatcgttgttggaccaatcgttatggttattggtttatcccttgcgccgacagcaattaatgatgccatgtataccgatgttgcaaatctaaaaggatacagtttagcttatatcattattgccctcatcaccgttttatcaattgtcgtttacagtatttatggaaaaggatttctgtcagtcgttccaattttactcggaatcatcacaggttatgttgcagcaatgattattggtaaaatcactggcatgaatatcgtttcctttacgggaatttcacaagccaaatggttaacacttccaccaatggaaattccatttgctagctataaatgggctttctatccgtcagcaatcttgacaatggcacccattgcttttgttacaatgactgaacattttggtcatatcatggtcttgaattcattaacaaaaaaagattattttaaagaaccaggacttgaaaaaacgttgacaggggatggtttagcacaaatcatcgccggctttattggtgcgccaccggtgacctcttatggtgaaaatatcggagtcatggcaattacaaaaattcattcgatttatgtgattgctggcgctgcggttcttgccattgttgtctcatttgttggcaaaatcacagctcttttacaatcaattccagcaccagttattggtggagcatcaattgcactctttggagttattgcagcctcaggtctgaaaattttggttgaaaacaaagttgattttgatatcaagcgcaacttattgattagctcagtggtccttgttatcgggattggtggaatgattatcaacatcactcaaaacttacaaatttcatcagtagctattgctacgattctcggaattgtcttaaatcttgtcttaccaaaagatgctagcgaaatttaaatatctaaaaattactgacaggactgccagttcaatgtgatgaataatgagcattgaatcggcgaataaaagattcgtcagtttactgacaaagctgtcagtaattaaaaaagtggacttattactgatggaaatctcgataagtatttcgttagtaaataaaaattttgtcagtttactgacgaaataaatatattgtcaaaaaactgttgtgacagagagcacacagtcagggtaaaggagaccttatgtcagtaaaaaatggattagttcaactcgaaaaccttacaagcatggaaaacttgagcgttgatgaagtcatgggacttattaaaagagcctcagctttcaaagcaggaaaagcagacttcgctttagatgagcaaactttcgcttcaaatatattctttgaaaattctacaagaacacatcacagttttcatattgccgaacgtaaactaggacttgatgttcttgaatttgatgcacaagccagttcaatcagtaaaggtgaaacactatacgatacggttttaacgcttgatgcacttggtgttgacatctgtgtcattcgctctggagtagaacattactacgaagaattagtgaattcagacaatatccactgtgccattgtcaatggtggagacggttcaggacaacatccaagtcaatgtttacttgacttgatgactatttatgaagaatttggcaaatttgaaggactaaaaattgcaatttctggagatttaacacactcacgtgtggctaaatcaaatatgatgatgttgcaaaaacttggggctagactttatttcactggtccagcagcatggtacagtgaagaatttgacgattacgggcattatgccaacctagaccgtattttaccagaacttgatgttcatatgctcttacgcgtgcaacatgaacgtcatgacagtggtgaaagtttttcaaaagaaggttatcacactcattttggactgacgcaagaacgagcaaaaatgttgaaaccaacagcaattattatgcacccagctcctgttaatcgtgatgttgaaattgctgacagcctcgttgaaagtccacaaagtcgcattgttcaacaaatgagcaatggtgtttacacacgtatggccattcttgaagccattcttgctggaaaaaaagcgaagtaagttgaaattgatgacaataggacaaaaagaaatattcaaaactaaattgttctgtttttaaagcaaagtttaaaggaaataattattatgagcaaaagacttttaattttagaagatggaactatttttgaaggagaagccctcggggcaaatttagatgtgacgggtgagcttgtctttaatacaggaatgaccggttatcaagaatcaattactgaccaatcttataacgggcaaattttgactttcacttatccaatcgtaggaaattacggagttaaccgtgatgattacgagtctatccacccaacttgtaaagccgttgtcgttcatgaagcagcacgtcgcccatcaaactggcggatgcaaatgtcattcgatgaatttttaaaatcaaaaaatattcccggaatcactggtgtagatacaagagcaatcactaaaattgttcgtgaacatgggacaatgaaagcttcactggttcaagcaagagatgaagtggaccatcaaatgagccaacttcaagctactgtattgccaactaatcaggttgaaacaagtagtacagcgactgcttatccatcaccaaatacaggtcgaaaagtcgttgttgtcgatttcggattgaagcacagcattttacgtgaactatcaaaacgcgaatgtaatttgacagttgttccttacaataccagtgctaaagaaattttggaaatggaacctgacggagttatgctgactaacggcccaggagatccaacagatgttccagaagccattgaaatgattaaagaagttcaaggcaaaattcccattttcggaatatgcttaggtcatcaattatttagtcttgccaacggtgcgacaacttacaaaatgaaatttggtcaccgtggctttaatcatgctgttcgcgaagttgcaacaggacgaattgattttacatcacaaaatcatggctatgcagtttcatcagaaaatttaccagaagatttgatgattacccatgttgaaatcaatgataactcagttgaaggagtgcgtcacaaacatttccctgcattttcagttcaatttcacccagatgcagctcccggcccacatgatgcaagttatctttttgacgatttcatggacctcatggataacttcaaaaaataaagtgttggtataactagatttgtgagcgttgatgtttcatatatttggcaaaagtagcaaaaaagtagcaaaaataaaaacctgttttatagcaggttctttttttataaattgttaagtgcatcaacaatatctttttttgcctttttagtaacgtgattatatattttaagagttacttttgcatcagaatgtccaactctttccatgatggattttaatggcataccgagttccgagagaagtgaaacatgagaatgcctaaaaatatgagatgaaatttctttgtcgatatgattcgcttttgcagcttcttttaattttaaattaaatgagttcaatactaacggattccctctacttgataagaaaatatagtcatcgtcttcagcagagaaatgaattaaatcgtactgtttcctctcttcaattatttctatagccctatctggcaagtcaacgatacgaaaactggtagaagtcttaggcgatgttttttctgcttctgtaatacttcgcataaagctatcaagcgttccctcaactcttattgaaccgtcatgatagttattccactttaaagcttgaagctctccatatcgcaaaccagtgagccataggaactctgatatcctagaatgaagcaagcatctttttttattagctaaatatgatattattttttcggcttcatctcgttcaagatatttgttctccaccttttcacgctgtttatttttatcctctattttaagaactatttcagtatcttttacaggattatttgataaatattttcgactgattgcaaatttaaaaattgttgaaagtaaagcccgaatttgactagtgtaattataagagtacttcccaaatgtatacatttcatcaatgagtttagttatcagttttccatcaatattttttataagcatatcatcagagattaccgtatgtatcctctttaaattaccgtcaacttgtttccaagtttttctcttgttttttgcctgatagtaagggaaccattcatttagaagttcgccgaaagttatatttttttgagctgggtcagtagtagtgatatcttctattttttcagataagagttttatcgcttgtttcttagcttgtggtgtatctttttctagagttacacttgcagtctttgttttctcagaatacggatcaatatatctctcgcaatacttaaatttaccattttttaggctgactacccacataatattatcctttctaaaaatgcccacctaatcaaaggttgggctttttttataaatcaatttctactttaacggcttgaccgattacagctgctggattgtcttgtgtagcgaattgatccttaaattctttgttgattgatacaagtctcaagcaatctatttcgtgataaactttttttaatgttgcctgacaatcatcatggaaaagaactgctccaatagtaccgtcgctcacatcaggaacagcttcaattaaaacataagatccaaacggaatctttggctccatgctatgcccatcaaccattaaccaataataatcacgagcagaagataagaagtgcgcaggtactggtcttgtaccgtcgaagttttctactgcatcaagaggaagtccggccgctatcctaccaagaataggaacatctaccatgtcttcatcaggttcatattccatagtgtttgtaggcataacgaagttttctaaaatctttctacttatatatggtggcaaatcatcaggtatcttattaatcggaatcactttagattcctttttcttttcttggttttgctcatctaactgattggttgcagtgtttaaaacaactttttgacgtggttcttcgagttgtgaactgattttatttatttcagatagaatagaagatgtttctgaatacttttccactaaatcagatttatctactccaaaataccgagacattaactctattttatcaattcttgggtatgtttttgcattaacccaatccaaaacagtagtatacttaaaacccataatttcggagaactctttaacatttaagctttttttagataaatgccgttttatgttctcggacattatttctttgtttcctaaatcttttgttttcatattcgtattatacgggcaaaccgtaaaaaaagcaagtaaacactataattataaaataaaactaaaaaaaagaaagttttttattgacaagtacggtttaaccgtgttacaataaactcataaagtcaaacaagcgaacaaacatggagcattcagtacggcagacggaacaggctcaaatgacggtacacgacgtatccaccgcgacgtaagtagcaagtttggcaaataaaagccccagaggggcggaaaggaatctgtatggcgaaaataaaatcttatattccaaagtattcaagagaacggcaaaagaaaagaagaaacaatgacgtgattagagttacaacaagtccttttctgacagaagtacattcaatcgctgatgcaacggttaacatagtaaggaatgaaataaaaaaagccaactaccagattggtaagtgacttttttaaaattaaaacaagttgttcatagctgattttttaccaatttcttcatcaattgtactaattgatgccttgataaatttaggtaatatctctgatagggcattagctaagttctctgaatcctcaacatgatgtttgtcaagaataactttaatatcattttcattcattataaaattcatctcctttccatagtactaagcaaatacctcaaatatctgctcatagctattataccaaggagaacacaaaaatacacacacagaaaggagccagtatggcagagaaaacaccagtaacttatacattgttgcaattacgaactggtaaacgttggactcaaaaagaagcagctaaaaagctaggcgtatctgaatctacattatcaaaatgggagaatgccattagatttccaacaatggatcaagtttgggtaatagaagatacctatgaagtaccattaagtggtattaattttttaccagaaaacacggttaaaccgtataaaaataaacaggctagttagaaaggcgaaaaaatgaacgaattacaaattacagaattaaatggtcaacgagttttgactactcaacaaattgctgatggttacggaacaaaaaaacggactatcgttgataattttggaaataataaatcacgatttaaagaaggtaagcatttctttttattagacggagaagaactgaaaaaattcaaagacaacaacgaaaatttcggtgtagtcggaaatcgagcacctaaactttacctttggacagaaaaaggagcattgcttcatgcaaaatctttaggaactgatgaagcttgggatatgtacgatattttagtcgatacttatttcaaagttcaagaagaaaaacaagctccgctcacattagaccaacaaattgcagctatcgcaacaggttacggaagtgtgaaagaagagcttgtagaagtcaaagatagagtatcagaccttgaagaaaatgcaccgcttagtgctggcgagtataactatattggtagtcgcattaaccaacgtgttgcggaagtagctagaggatatggaaaaatcactcgagaacagcgctgcaagttgtttaaagatatcaatcaaggagtcaaggtagttacaggagtatctacacgaactcaattaagagcaaagcattttgatacagttgttgatttcactaataactgggagccttccacagctacgaaaatgcaactcagacaaatgagtttcgattttgaagcttagaaaggaaacagaaatgactacaattggaaaagttaagatagttgaaatcgaagatggaccattcatgacagacggagaaattgctaagtatctgtataagacagaagtgttagatgaaaaagggaatattgacaaaaagtctaatgcttatcttcgggcgcaaggtaatatcaaaaaatttgctgataatgctcctgatggtttcgtgattgatgttgacggacgacttactcacttgattgccttcttagcatggtcaatttggaacaagaagtatcgaggaatgtctagagcgcctaagtttattgattatttcacagaaaataaaaatacactaacttcaattctataaaggagtgggctatgacctacacatacatagtcaacccatcaaaattaaatgcggtactccgctagaaaagagaaaagatgagcataaattttgaagaaatagaatcaattgttgtagaaacggatgaaaaaaactctatacccattgcaacaatcactgcggatacagtgaaaccagagcaaggttatagagttagaattaagcctaaaattaaaaattagcccttaggtggaaatggatcattgccataactgttacgttcacggatttgtccgttacggccatgtataaacatttcagagttttgattttgagaaatctgaattgctttgttaatagcttcggcttgagttctgaagtttgcagtagctttagagtttcctgctcctttaacattccaaccaccgttactatctgggacaacatgttgatttttacctggcatatagtctcctttcaataatattttgaaaaacaggaggatgttagttggtattaacggatttatcctgaatttcattaactctattatactgctacaaattgttttagtcaacataacatactatatattgtgtttaattatgtaaaaaacaagaaagggacactaaatgttgtggtcgaagataaaaactaaacttgttgagaaaaatatgaccgagtatgaacttggaaaagttacaggacttggtgctcaacaaattcatcaatttaaaaaaagaaattctgaaaatcctcgttggctaacaatggtcaaaatagcggatgcattagatatcagcttagatgaattcagagagaaaggaaaataaaatgttcggatttaaaacaaaagaagaaagtgcgattcttgctgaccataataatacggttagagatattaaagagagattaaattgttttcttcaacgaagtgaagttctagtaaaaaatgagacaatggttaattgcaaacaaattagaatttacagaagtaagtattttagaaaatagcttatttaaaaatgatattttaagaatactctcattaactgaaagtggagtagaggaaattatttccaaaagaagtagtgcctataaaaaattatcaaaaattcttgattttgattctcttactttaaatgagcttgtagacttaattgtaaaaaatgaaaaattacttcgacgtcctttagtaattgatgattatcgtctacaagttggatataatgaagacgatattcgtaaattccttcctcgtaaagttcgtcaattaggactgatggaagcaatcgagaatgttcgactttgggatcaagcaaaatagtagatagttcaaaaaatgaaaaaattctgaatattctcttacaagattattaaagcgaatctttgatttttatctcataaaaagctacaattttaactataaataatttgttatctataaattactaaactgaactcgttttaaaattacgaattcagttattttatggggaaaaatatatagattgagagaataaaatgagaatcacaattgccggtgcaggagcgatgggaagccgttttggacttatgcttcataaagggggcaacgaagtgacccttgtagatggttggcttgaacatgtgactgcaattaaagaacatggcctacaagcaaattttaatggtgaagaaatcactgctcatctatcagtagaattacaatctaatatttcatcagaagaaaaaacagatttaattattttatttacgaaagcaatgcagttagataaaatgcttcaggacattaaacctttaattgctgagcatacaaaagttctttgcttacttaatggaattggtcatgaagatattattgaaaaatatgtttctaaaaataatatttttattgggaataccatgtggactgcaggtttagaaggaccaggaaaagcaaaactatttggaaatggttctgttgaacttcaaaatttcattcctggcgaagaagaaacggctaaaaaactagcaaacattttatctgcttcaggattaaatgctaactattctgataacatccattattcaatttaccgaaaagcgtgcgttaatgggacaatgaatggactctgcactattttggatactaatatggctggattgggagcaacaaaacctgctcacgatatggttgttacaattgtcaaagaatttgcggcagttgcaaaacatgaggaggtgaatcttgatatagatgaggttgtagaacatgttgagacatgttttgaccctgaaacgattggcttacattatccttcaatgtatcaagatttgataaataataatcgcttgacagagatagattacattaatggtgcagtttcacgtaaagggaaaaaatatcagatagctactccttactgtgattttttgactcaattagttcatagtaaagaagagttattaaaggcgaaataaaataattttagtttctgaaaaaggctagtctataattagccttttttgttttctttagggatgaggataacaatctggtagcaaacaaactaaagtttttttgataatgttataataataattaaattcacttggggagataaatatgaagtttttacatacgtcagattggcacattgggagaacgataaatggtttttcattattagaagagcaaaaatatgcctttaaacaaattctttctctggcaaaagaatatgaagttgatggaataattattgctggagatttgtatgaccgagcggttccaagtgcagattctgttattacttttaatcaaatgttaagagaaatgaacatcatcgaaaaatttccaatttatgcaatttcaggaaatcatgatggggccaagagattaaattatgccaaagaatggttggattttaatcaattacatttacggacttctttagaggaagcttttattccaattgaaactgagcaagttcaattatttttattacctttttttgatccgatggatgcaaggatatacttttcaagtcagggtctggacgaggaaaaagcaaaagaaatcaaaactattgatgaagcaatgaccttagttatttctgaaatgcaaacacattttgataaaaacaaaaagcaaattttagtgacacattttgcggtaagtcctcataaagaagagattaacttaacaagtgaaactacctcaaaagtgggtggtttagcaactttaaatgttattcaatttaaagcgtttgattatgtggccttaggacacatccacactagatttgcttcacccagtgagaaggtacagtattctggaagtccagtaaaatttaacacaaaagaagcaaaaactcaaaagggagtttttattgtagaaacacagcaagattccgtcagctctgagtttattcctttacaaatccaaacggatttagttgttattgaagaagagtgggataccttaatcagtcgagagttttacgaaaatcagccaattcatcaagcttggttcgctatcaccataaaaaactttgatagagcaaaacttgcaggacaaaatttacgtgcccaacttcaaaaagtatatggaaccatagtggaattggattataaatttaaaaatatttcgtcagtaaaaagtaaaactcaaaatattgaaagcttggataatattgggatactttcaaatttttatgaagttacaactggtgagactttaagcggcttgcagcaagaaattattgagaacacattcaaacaaatagaaggagaaaaataataatgaaacctacatatttagaaatgaattattttggacctcatgagaaatctattgttgattttcgtctattagatgaatcgcctatttttctaattagtggtgatacgggagcaggaaaatcaactatatttgatgcgatgacctatgcattgtttggcacaacaacaggagatagagatgctaaggaaatgagaagtcagtttgccactcctgataatttgacaagtgttgtattctattttgaacagggggacttattatataaaattgaacgaaaacccgagcaaaatattgctaaaaaaagaggtagtgggacaacaatttttaaagcaactgccaaattagcaattgttgatagagtggcaggaattgaaaaagcaaatattgctacaatccctaaaaatgttggagaggaaataacgcgactcttacatttgaatgcggaacagttcaaaaaaattatcctgcttccgcaaaatgatttttcaagatttttaaagtcttcaacttcagaaaaagaatcaattttaaagaaaatatttggaacatcaatatttacagcttttagtaatgccataaaattacaaaactcagaaataaatgaaatttttgcagagtatgaacgcaaattacaaagttattatgaatctcaaatttggaactcttttgaattagaaagattagaagtagtccctgaacatgaaaaatttaatgaaatgcttcttcttaaagaagaacggacgaaagtaaaagaagaaacaatatccaaaaacttagaacaaaaagaaaaagtaactttattagaagattcatataaaattgcactaaatttatataatgactttaaaaatttaagtaaattagaaagtgattatcaagaaaaaattattgaacagtctcaaagctacaataaaaatctgaaacattttgaggaattaacttgggcccaacctcttaaacagagccttcatgaactcgaacaagataaaaaaagatctaaagatttagagataaaaattactgacatgactactaaaacattgacagaagaaaaattgttgcaaaatttactgacagaaaatgaacatttaagtgaacagcaacaaaggatcaatgatcagaaaagtgagtccgaaagtttaattacacaaattcaacaggcttttgaagatgagaaaaagcaagccaagattgttgatctaagaaataagcaatcagagactcaacaatcattgaaaaattcaaaagatgttttaattgaatttaatcaagaaatattaaagctaagagaaaatatcatttctgattcatatttttctgagaagaaagaggaaataaatcaattaaaactcactttccagggaaaattacttcctgattttcaaaggatttcatggttagaaaaggaaaatcttgatttaagtaataagttagagagtacaaagaaggaacaatctgaaaataaaaagcatctaaatgatgttcaaatggcacatgaagaaaaaataaagggaagacgccgtttgatgattgctcaacttcaggcggaattagaagaaaatgaaccttgtcctgtttgtggtgccttagagcatccgtcagtagatgagattgaaaatatttcttatgaaaaattaggaattttactaaaagaaatagatgaatctcaaaagttactggcaactttactagaaaaaaataagcagctaaatcaattaacgtctgaaatcactaataaccttgtctcgaaatcagccgaaaaagaacaagccattaagaatttctcgcttctctatcgtgaatttatttctaattactcagatatttttccatcagcatttgatgaattcgtcattgaagggcttattcaaaatttggaaagtgctttgattaaagaggaagcggaaaataatcagttaaaaataaaattaactgatttggaggggaaatatttaggattacaagaagaagtaaaaaaacttgaaaatacctaccttgagttttctactcaaatagaaaatttgctgacagaaataagagattcagctgtgactcaaaccagtgaatatttacaagataagcgcaataaactcaaagaggaaattgcattatttgaaaagcgtttagctgatctaacatctaaaatttcggagataaaaatatcagttgctactaaaaaagccaatcttaaatctttaaatattcagttgatagatttaagtgaacgaataaaaaataatcaggataagattgataagacattgcttcaacctgaggcattgactacagattttcaggttttatgggaatgggctaatgacgataagtggcttgaactatctcaaaaagtcgaacaatacaagtcagaaaaatcaagattagaacaagagattgagagcctgcataaaaaacttcaaaataaagctcgtccaaatcttgaagagattgagaatcgcaaaaaacaagaaacagacctctacctttctttacagaagaaattagcagctgatgaaacagctgaacaacaagcgatcgtaatcctttctgaagtgagaaaactaatgaaaggtcaagagaaacaatttgaaaaaagaaaagccattggccaactttatggtgcgatttcaggaaaattgtctgaagataaattaagactagaaacttttgtggtgcaaaattatttagaaaaaattcttgattatgctaatattcactttatcaatcaactctcaaataaccgttatcgctttgaactttctgaagaaggaaataaccggcgcatggatcatggattagacattaacatctatgataatgaaacgggtgcctctcgttcagctgataccttatctggtggtgagacatttattgcggccctatctattgcgcttgctttaagtgaggtagtacaaaatactgcaaatggtgttcagattgaagccttatttatcgatgagggctttggttcccttgaccaagaaactttgcaaaaagcaatgcaagctcttgaacaaatcgggaaaaatagattggttggtgtcataagtcacgtagaagagatgaaatcgacaattggtcagcaaattatcattaaaaaagtgggtgatggaagaagtaaagttaaatctgtcatcaaataatacttacaaaaaatctcataaaaaatgaaaatataataagtaattaaattacttttccttaattttgatttttgtgtaagttatttatgtcatttatagatttgttactgaggaaatgatataattatttaaaatgatgaacaataaaaagattgataccgatactaaaatttgaaaaatctaaaattgaataaagtattgaaatcacaggatatttaggaaagaattagataaagtaggaaataatacaaatgaataaaaatttaaaagaatttttaccacttggtagtgttgttttgcttgctggcggagaagaaaagttaatgattattggccacaagcaaatagaaatagaaactaaacgtgaatttgattattcagcggttttatttccagatggctacaaagatgaactggccctttatcatttcaatcgagaagaaattgtttatatttttcaaatgggatttttcgataattaaaaataactaacaaaaaacaagaagagataacttcttgtttttttatatttttatttagaaatcaaaaggttggataacctaattattattcatctctggattcatccaaacaggttctaagcaatttccatctaaatcatgtacttctaaaccatacatcatttcttcagggataccatcatccaaatgaatcgattttccaccattttcgctggcaagtttaccaaaatttttaactgcatcagcattaggcaatgtaaatgaaatcaacgcagcgcttgttgttcttgtatcagcaattttcctttccccaataaaactttgatagcgttcgtgagaaagaagcatgatgaaaaaattttcatcccaaaccatacagctgacaagattatctgagaaatttggattttttttgaaaccaattttttcataaaaagttgttgaagcttgaatatccgttaccggaaagttaacaaaaaccatagtcgtcatagatagaccctccttgtttggtaatatgtataatattgtgactgtcttataaatgagaaggtttgtcctcacaaactctccttaacaattatatccttatatgaagtatatcaaatacaggcaagggatactatattaatgacttattattttatttgttctaaaaaatagcgcaggtaatatatattgattatatttttagcctatgctacaattgttttatgaaatattttgactttactagactaaagatttagatcttggtcatttatataatgaagagaattaaatgataaaaattgaacacttaaatgtattctatagcgaaaataaagcactgacagatgttcaactaaaacttgaatctggtggaattatcggtatgattggcccaaatggtgcgggtaaatcaaccttaataaaagcaattttaaatatcattccttattcagggaaagtactgattgaaggaaaggaaagtaaaaatttcttaaaaaatatcgcttatgtggagcaaaaaagtaatattgaccttacttttccaatcacagtcaaagaatgtgtttctttagggacttatacaggcttgaaactctttcaaaaagttggaagtaaagagtggctgcgagttgcccaagcgcttgaaaaagtaaatttatccgaatatgcaaatcgacaaataggggaattatcaggcggacagtttcaaagggttttattagcgagatgtctggttcaagaagctgattatatatttttagatgaaccctttgtgggaattgactcagtaagtgaaaaaatcattatggatattcttcaagatttgaaagaacaagggaaattgattttaattgtacatcatgatttaagcaagatgaaagtctattttgatgaactgattattcttaataaggaaataattgcttacgggaaggttaaagagagctttactcacgaaaatttaaaaaaagcatatggggataatatttttataggagattaaattgagatgatacaaaattttataaatggcttatacgagtttcattttttgcaaaataccttgattacagcggttgtgataggaattgtttcgggagcagttggttgctttattattttaagagggatgtcactgatgggagatgcaatctctcatgcggttcttccaggggtggccatttcttatattttaggtataaatttctttattggagcaattgcttttggacttttgtcatcacttataattacttatatcaaaaataatagtctaattaaaggggataccgcaattggaattacgtttagctcatttttggcattaggtatcattttgataggagtggctaatagttcaacagacttattccatattctttttgggaatatcttagcagtacaagatatagacaaatggttaacaatcggtgtatccatttttgtattaatcgtgattgctcttttctttaagcaacttttaattacctcatttgacccattaatggcaaaagcaataggtatgaaagttaatttttatcattatcttttgatggttttgctgactttagtttcggttacagcaatgcaaagtgtggggaccattttaattgtggctatgttgattacaccagcagcaacggcctatttatataccaatagtttgaaaaaatgctaattctttcatcttcaattggagcaatctcatctgttctagggttatttattggttatactttcaatattgcggccggttcaagcattgtgattacctcagccattatatttgcagtaagttttttaatttcaccaaaacagaactttataagaaagaaggttaaagtttaatgctaaataaacataagaagtttctacttgcttttgtgctaattatgacagctatttccttagtggcttgttctaaaaatacaaatcagtctataaaaaaagcggatgacaaattaaatgtagtggtcactaattctatactggcagacatgactaaaaatattgccaaagataaaattaatttgcacagtatcgttcctgtcgggaaagacacccatgaatatgaacctttgtcagatgatgttcaaaaaacttctagagctgatttaattttctataatggaataaacttggagactggcggaaatgcttggtttacaaaattagtcaaaaatgcaaataaaaaagaaaatgtagactactttccagtcagtagaggggttgatatcatctatcttgaaggaaagagcactgagggaaaagaagatccacacgcctggcttaatttagaaaatgggataatctatgcccaaaacattgaaaaagaattatcaaaaaaagatcctgaccagaaagatttttatcaaaacaacttgaataagtatataaacaaactaactaagctagataaggaagctaaagcaaaatttgcttcaattccagaaaataaaaaaatgattgtgacaagcgaaggctgcttcaaatatttttctaaagcttatgatatctcttctgcttatatttgggaaattaataccgaagaagaaggaagcccagaacaaataaaaacgttagtgagaaaactaagagccacagagcttgcatctttgtttgtagagagtagcgtcgatagtcggccgatgaaaacagtatctaaggatacgaaaatcccaatttactcaacaatctttacagactcagtagcaaaaagtggggagaatggggatagttattatcgtatgatggaatggaatataaacaaaatctatgacggactttcaaaataattattcgataggaagccttattatagagaaaataattgaaaaactaaaagtccccaattgaaaggttgggtactttttttaatatttatttatacttttatctaaatctataagagacagatataaatcaatccaataataaggttaatcaatcccactcctatccactctatggctaatgaacttttcgcccctgttttagggagctctttattcttagaatcgatttgtggattttttggggaattgatatctggcttctctttggaagggaagctaccagtaaagccaactgttgcctgagtcatgtttgccgctctttcttgagcaaagacagaaaagggataggcaatcactatcaagaatcccatagagatcaaaaaagtttttattactttattcaaagttttcttttcctttattggtgactatctttgtttcgtttgcggctaaagatgaggaagattaataacagaattataaggataagcgcaattccaatgatcatcagccaattgattggttctttataatgaaccgttgggtcactctgattaagtttttgggctttttcttctgcaatttcaaactctttttcaaattcccatttatactcatactttacagctttaccatcaactgtactttcgtaagttccgttcgtatttttcacaccataaactgtcattgttagatgatactttccaggttccaaggctttagaagtttgatctttcatatttccttgaatagatactggaatcgcaaagttaaagttagaatttggagccattttcatatcagaattttcaaagctatattttatttctggattatttacgttttttactgtcgccttcgcattcatatcttgaaggtaggttggtgacatgttttgtaaatttgctgtaaatacatttctagaatttacttgtgtagctttggcatcgttcattttaagttgaggagaaactttctgagtatcttgttggataacaagtgcaatcacataacgatattcatttgttatcgatacaccttttgatgtactttcttgatttttcgatttcttttctttgaaagcaaatcctccagccaagactccactgtttgctccttgaggcattttaattttcgcagtcacagtcacctgtgaatgagcggaaattgttatttcttttttaggaatttcaacataatcttcaatattatattgaagagaactatccttggtttttccagctgaatcataaatagcaaggccattatcattcgtagtcgaacgtgagaaggacatatctactgttatagactttgaagtcgtattattcagattaaatgtcagattttgttctgcttctggattcatcaataagttaaaataacctaaactcttgtcaatttgattctctggtgttactggatttacattaaaattagaggatgaagcatatatatttttactacagtagcataagctaaagacaagtactaagacgaggcctattttccctaaaatattatatactgagttctttttttcaatcattttgtttccattcttgacaaattttatttagttgctccttttgttccgaagtgatagattgaaaagaatcattcactaaatctaggattttgttgtcttctaaaccaaagaaaaattttcacctatcagaaaaattttcttaattggaaaatgtctcttactgattacttaattttttaaactttctttggctcttagttacattttcttttgctttaaaatctttttttttcttaaaagcacctcctaaatttccaaatttaatcatatcttcaaaatataaaatgattctttttttcatagttaactccgccatcccatacttttaatgagcttaacaaagcatcgttttctcatttttttaccgctagtatccgaaaaattagtgtttttcggatatatgtttttagtgtacataactaaaaaaatagaagaattttgtacttcttcatctaagtttttgaccttctagtagtcaaatttaagggataaaattataaactcttaaaaataatttaactattttttagaaagcaattagtaataaaaaaattacctcgctaaatttacattttctcagttgatcggaataagcgaacgtagtttcttgttttcaaaaagataactaaaaccaacaatacagaaacatctaggcaccgttagaacaggaaaaagtgaaaaacaaatgtattttgtttgataatattaattttattagttgaaatgtaatttcagagtaaatttccagtctgctaaatttgattttaaagagagttgtgttataatattactataattatatttttgtaatattttgctcagaaaatttcactcatatatccgaaaaacactaatttttcggatatacgttgttataaaattcaacttatttgtaaaacaaaacatcaccaagcttcatattggtgatgttttgttttacaatcttttgttttatatttttttgataacgttaaggttaaaaaatagattgtgctctttttcactttaaccgcctgtttgttagcgtgctcatttcaaattatgtattactattctatggtaatctaaatattctttgatatctttgattcttgccagtttgcaccgagccttttatttcttataaaaattaaaaaccgcaattactcatttctaaaaaatgacttttgtttttaatttgttacttttagtgcttagaaagcttttttatcttctattaatttatatttttagtctcttcgttggcatttttttgctcataactgagaaagtattggccatgaatttgatttataaaattttctaatcattattcgattttttctaaaaaaaaaaataaaagcatgagtataaatcatgcttttatttgtcttcttttcttatttgtttttcagtttttgtcgtttaaaagttacataaattccaaaaataaatatcgccagcccactaatagggaggaatctattttcttgttctcccgtttttggtaattctgatttttggcgaggtattataagttttctattaacaaatttgccaactttaaccatttctggtttattttctgattcattaacaatttcaaatgttttagtctcttggcttaattgataaccagtaggagctttttcttctacaaaagcatacttacctggttttaaattatttgccttgattattccatctgagttagattttagtccttttaaaacaacttcatttttacttgtatcaacaactttaaagactgcacctgaaagtttttctccagattcgctcaccttgactaattcggcggatccttgatagttaataaaattatctgaagccatgaccacttttggtttattcttttcttcatctgagatcgtaaagtcagctttcgctgtgtttagaatataacctgcgggagcctgagtctcaatgaatgagtaatttgccggtactaaatcatcaatcttgactttaccatctttatcagaggtcaagccttcttttatcatttctccagattcattgacaactttgaagactgcacctgataaaggttggccttcactgtcatgtttgattaattcggcggatccttggtagttaacaaagttatcagaggcagtcactacttttggttgaccttcttctttgtcagaaatagtgaaatcaaccttttcagtattcaagatatagccagttggggcttgcgtttcgatgaatgagtagtcacctggcgccaaaccatcaattgctactttaccaactttatcggatgtcagtccttctttaatcacttttccagattcattgacaactttgaagattgcgcccgatagaggttgacccttgctatcgtgcttgattaattcggcggatccttggtagttaacaaagttatcagaagccatgacaagctgtggtttttcttctgattcagcagaaattgtgaagtgaacagggtctgtgtttaatacataacctgttggagcttgaacttcgatgaatgagtagtcacctggcgctaggccgttagcaattactttaccgtctttatcggatgttaaattcgtttgaattgttttgcctgatttatcaacaaccttgaagattgcacctgataatggttgacctttactatcatgtttgattaattcagctgagccttgatagttaataaagttgtcagaagccatcacaatttgcggttggccttctgcttgatcagcaaccgtgaagtgaactgggtctgtatttaatacataacctgttggagcttgaacttcgataaatgagtagtcacctggcgctaagccgtcaactattactttaccatctttatcagatgttaaattcgtttgaattatcttgcctgatttatcaactaccttgaagattgcacctgataatggttgacctttactgtcatgtttgattaattcagctgagccttgataattcactttttccaagttaacatctgaaattattccctcttcatttgctttgagttcaaattcaattggagttgggtctaagatataacctgctggagctttcgtttctacaagtaagtacttgccagatactaatttttcaatggtaacatttcctgaactatcagaagtaagttgtccataacccgcaacagtttgacctgagtcatctaagagtttaaattctgctccttgaagtggattttttacttcttctccattttcaatggtcattcctacttttttaagtactacttttgttggttcgttctcgacttcttggataggaaagttagctgtttcaccatcttcagcgacagttacttttttacctttaaccaattcttcatcaagtgtgtatcctgctggagcttttgtttcaataagaagataatcaccgacacgtaagtgtcccagtttcaaatcaccattttggtcggtatctccttcacggattaatttatcttttttaccttcatcattaattgaccaaagttggagatgcgcatttgctagtttttctttatcaggaccaactttttcaaaagtaactgacccttctgaaccctctgctgtcccgtcatgattgattacaggcacatctacttcaacatctttctcaatcgttgtttcgttgtctccactgatatgagcttgattacttacggtatcattagttttatcagtagtaattaatgcccgatattccaccatgtaggctgtgttaatttcagctaagaaatcaaccgtaattacttgcgctccggtgatgttatctgtagtaatatcaacagtatagtcaactccttgtttgagcacagtgtttttatcttcggttatatttcctgatttatcaattgtcgttccgtaaacaacgacatcttctggaacaacatattgatttgaagaaggattatcaacaacttcaacgtctttcaaagttgattgtgaagcattgacggtaagagtccaatccacataatcagaatctgaacttgattgttcaccagattttgaaacaaattcaccctcatgagccgccgtgacgctggcagttaaatcatgagaaatgtcattattagtaaatgtagctgtatttttatattctttttggttgatgagttcaccagccaaactggtttcaaagattaacacataagctttggtactcttgtcaggaaggttaaccttaatatcatttttaccttcggtcactttaattcctgatgttgaagtaacatcagcacctaaagtataagtcccatcactattaatcgtggcttcataaactttagcacttccagaaacatatttttgatccgctgaaattgggtctactattgaagcatcatttaattcttgttgatcaaaattagtagcaactgtccatgtaatctttttagtcgttgcattatagtcaccagatttttgtccattgtattggaatggtggaagaggttcaacatctttatgatcagtatttgtatgatctccacctttttgatcattccaagtcatagaagcatcatttttaaatttgatgtctccttcatgaccacttccattatcaatcgcactagtatcaaattttgtcttgtatttaatctgatatttatggtcagttccttcttttaaaggagaattaaaggaaacttggaatcctgttgcagtttttactagtgtatattctgtcggtaatagaacacgatttccctcatttttatcaataatttggaaactatcttctataaatgtaaggccttgagacattgtgtcttctagcgaccaattttccatcaaatagcctgcactattgatatctattttccaaggaatttcatctttgctgtagtcaatatcaccatcaacattttttactaatccttcttgagttgcatttcctgttgacccatctttgtccccagtatctgtctctactgagttctcaattggcacattttcatctacaatatctttaacctttgtttgatattctgcttttactgcataatcgatatctttaagaaatacaattttaaatttttgcgggtcattggggtctggaacgagcttataatcttcgccctcttttaattcagccccttttatttcatttccatttttatcaaaagtaattttatagagcttaacactgccgtccacgagttcaatagcatcgctcattgtatcttcaatatatgagccagctttatgcttttgctcattataattatactcaacattccaattgtaaacttgatcatcaccagttgagtaagggccattttttgtaatcggtcctttatattcagcatcaactgaggcacttgcatcagtatctgttttcccatcatttaatgtagcagtatttgtaaagtttacatttccgcctttttctggaatagtatcgtcatcaatagatgttgtataaacaacattaaaggcttgatcagtcttcgcatacttaccgatgaatgtaatttttccatttgcatctaccgtataatcggttccttcaactaaaggatgagctttatctactgataggatttctccatttggcccaactgtttctggataaatgactactgacttataagtagttccagctggcattgggtcagtaagagttgcattctccatcgtatttaatggacgattaatattaatttcccaaattacttcactaggatttggggtcttgtcaaagtgtcctgatttgtctatcccttgattatagtctgggcgaacgtgaacctcagaaggagggaaattttcctcagttggtgtatcaattacaacttccccaggaactgtttctttatcaaagtgggcatcataatggaaagtcccatgaatatcatgttttgtttcgaccttttcattaaatacaaagtgaactgtaccatcagcatcaatagtataagttccgtaatcccccatatttcccatagcttcttcaattgtcactccatctggtaacttgaagtcaaagtaatctccagcctttaagggcataatatcttctgggatactccatgtgtaatcaattttaacagcggcgtcaatagggacattattctggtcaggatacggatttccgtctttatcaacataaacaaccgttgcaccattgatgatagaagccggagaaacacccgcagcatctagaagatcatgaatatttcgaccggagtcagcttgagttgttgtttcttgttttgtttgttcttttttgctttcagaagttgactgactcttgctctcagaagagtttgttgaaagctctgaattacttgtacttttagattctgaagtactcgttgaattttctgttgagtccgtcgttgaatcagttgttggaagatcaacacttaccttttgattattaagcgttgctgttaactgattgaggtcttttaatttttcttttagtacagaaaagttaatgttcaattcattgttgctattcgcagctacaactaccgttaatttgttttcattagcagtaaaatctgttgttgattttgttttattatcttcactaggtgtattaatagaactgttcaaatcgataattactgtctcattttgttcaattggtttttcaactttaagtgttaagttaaatgacgttagatcagtttttgtttctgattcgtctattttaagttggcttaaactaatagcagtatttacgctgccatcagtcaatgcttccgcaatcactcctactggtgtaacaatatattgcaaaagcaatactagtcctagaattatagaagcgactttttttctactttccataatgtcctccttgttgagtttttaatcagaattcacaccatagaaagtcttttttctagcgtccaattgtgccaccctgatactaggacattataacacaatatactacaaatgtgtaatggatttcgtacattatgtatttaaatgttacgcattttttatatttttttctgaaaagaacactcgcaaaaaggctgaaaatcccgatattacggtattttttgagcattattggattaatatggcctttaaaaaattaaataaaaaaactgatttgagatttaaatcagttttccaatattgcaaaatgtaatatatcgtatgttttaaacgacagatgaaacaatttatataataggctttatctattaatcattcagccatatatcaacttatctttgcttagttaaggtctattttaaaacaaaaaaagcctgatagtatcagactttcatcatttttcaactgataagaggaggtcatcgatgctctttgtaattacctcatcaaaataatctattcttttttgatttcgagaaataagctgagctccttgaatccctgcaaaaaattcgctggctttttgagaactcttatattcggtaaattgtttttctagccacgagatatttttctgaaaaaagtcaccgactttgttattgatactatcattcagattataagtatccattgctaaatctgagcatagacagattcttccctctatcaaattcattctatataaagaagtataatattctaattttgctttaagagtggatgctgtgctttgctctaaagcttcaaaaaagttcgttgaatacttttctaggactgcttcaattaaatcggttttacttggaaaataataatgaatacttgcctttttgatatcaataactttggcaatatctgcaaaactaaacccatttatccctctcgtttgaatcaattctaaacctaagttcacaattttttcttttgtgtttatcaagatttccacctactcacttattgataactttaagtatagcaaattctatctttatttaatagtcagtatttcttctgttgccaaacgattattggtaaaagtattaatcttatcttctgagcgataaccaagtgctattattagctcttcttcttttatatctagattttctctaatttcatcaggatatttaatattttcataagccaccattgaatctactccccgattcgttgctgacagcattaaagtttgagcgaaggctccagtatcataaactgaccaaactggcgttgttttgggaattgtgagataagccattgctggtgcattccacaagtttacatttgcggtcaaaaaatctttcattgtggcatctgaattgactttatccaaccaagtactcatatttgtaaaaggaagtttaccccaatcttggatatcttttacaggaaggtcggcactcccttttaaagctttttctaatttttaaaatgggatttttggatatttttcatcgtttcccctgtagcaatataaactctccacggctgtgaattagcccaagagggagcttgctgtgcatctgatacaatatttcttaatatttcctttgaaacttgttcatttttaaaatctcgaattgaacatggacttatggctttacttttatataagttgtatctactttttgccattaactgctctcatgtgtaaagggccatgctaaaatgtaggaaacgggccattgaaaatgtaggttaactttaaaattgtgataggcttttccttatgagaaaagacatcctagaaagtataaccgaacatcttatgactggaattaaacctaatttcgctgatattgccagacgctataattgtgactatcggacggtcaaacgttattatgacctcggaaaagaaaagacccttgaagaagcttcaaaacgaagggtcccaccgtcacttattgagaactataaatcaatcattgaagataaactcaagcttggctgctctgtgcgctcaatttactacttcatccaactaaaaggctatcaaggctcatatacgaccgtcaaacgctatgccagattgattcgagaatcctgcaaacataaagcaacgattcgaattgaaacaacgcctggactttctgctcaagtcgactggaaagaaaatttaaaactgatctcacgcaatggtgaagtgtttacgattaatatctttctgtatattcttggctactctcggatgaagtatcttcaattgaccgtcgaccgtctccaacccacactctttgagtgtctcaatcacgcttttgagaaattcggaggtgtccctgaagaaatttggtttgacaatatgaaaacagtggtggaccattctaaaagtcaattctcaaatgttgttttcaatgaacgattcaggcagtatgcaaaagatgctggatttaaacccattgcttgtcggccattcagacctcaaaccaaaggtaaagtagaagcgcttgcgagaactgttgaccgcctgcttgtctttaacaatgagtttgaagaccttgaagaattacaagcactggtccaacaattgatggaagatttgaatcataaagaaatctctcaagcgattggaacctcaccttctgaacgtcttgaccaagaggcgttgaatctcaaggcttttgatttagagcttctcaaagtttatagtcaattgagtgttcctttgactcgaaaagtctctaaagaggcacttgtgatctttgaagggcgtaaatattcagtgccggttaaatatattggacagaccgtaacctgtgaaaaagaacaagaggaccttaaagtctattgtgaccaacgcttgattgctcgtcatcctttaagcgaccgtccctttaattatcgccgtgaagattacgttgaaattcttaaatcagatgtcttcaaacatcttgaagaagacgaactagaggcttatgtggatgagaatcttcaagcctacgatttattgtgaagggagcgcttatgacaacttatcatcaattactcaaccaattggaccatttaaaactcgatcgtgtgcgtcagatcttaccagagttcttagatgagcatgcggatatttccttagtagagggccttcatgaactcttgagtgaagaacttcgtgaacgagaagcgctccttcaggaaagacgattaaaaaaagcccatctgccttatgaaaagcgtgtgatggactttgattttcagtttcaaccgaaaattaataaagcagagattttagatttacataccttacgttttttagataagcatgagaatcttctcttcattggcaatagtggcgtaggtaagacacatttagctatttctatcactttagaagccctagagaaaggttatagctcttacttttgtatgagtactgaattagtggaccgtttattaagagccaatcaaaaaggaactttagagcgagtattaaaacagtatgccaattatgatgtacttgttattgatgaagtgggttatctgcccttttcaagagatggagcgagtcttctctttcaactgattaatatgagatatgaaaagaaatccacgttgattactacgaatatcccactttctcaatggtctgagtttcttcaagataagaaattaacgaatgctttattggaccgcttggttcatcattctaaagtcatttctattactggaaaatcttatagaatgaaagactatagtgagaagaaaaccaaaaccccaaaaagtaaataaagtgatgggcccaaaaccaacaatttgggtggcccatttcctacattttcaatgacccaaaaccaacatttttagatggcccttgacaccatgttagcaatacttgttatttctcttatgaaagagccaaaagttaaagttaaaaatgaagtaagttcaacttttagcgacatttttaagtcagtgataacaactcttaaagttaatccaaagttaataaggtggatgttaattagtcaaactttaataacatttacttcaatgttttatttctattatcaaaatgaaatggttcaactgcaatcttggcaaataagtttgatgatgttagcttcatgtcttattaatatatttggtgtttggatggctagtaagattggtgaaaaatggacatctagacaagtttttaaaataataattcctatttcggcgttcttatttttattagctattttagctaatccaagaatttacatctttatttttttgattagtgatggtttagttgctatgtttttcccaatttataataatgatatccaacaagaatttgaatctcatatcagagcaactatgcttagtgtaaatgctatgattggtagtctgatcatgatttttatatttcctcttatgggaatgataattgattacttaagtttttcaattagctttatgtatttgggtatctttcttttattagtgagcataggtatattaaaaataactgaataatgatgagataaaactagccttgaagattttttcttcggtggttagttttttcttttttcatagttaccaaataatcactaaaatctcaaaattacttagtatttaaattgatttctaaaattcaaaccttgttaaatcaaggtttgtcgtctttaaaaagagcttggtagcactcaaaatccagtgtcctcacggacgtgccggttcgaccccggccgccagtatactataaaagacaaggtttctagaccttgtctttttgtatatttgataatataatttattcagttaccaaaatggtaccataaattattttgaggtgtgatattatgtatgaaagttatacacgacaggttttgccatcaaaggagtaccgtgaattattaggtacttgtttatgtgttttcaatgcaaataatagttttattattgaaaatgttttagctaattcgaatgatctgagttggtacaatttaatggacttagaatctggaaagctacaaaaacaatttaagaaaatggaagaaagttttcctgaagatattgtcaacattttttttgaccttgtaaagagaagaaatagaataattcacagctttcaaattactcaagatgattcacagatcttagcaactaagactaaagtaaaagatgataatttacaatttgttatctctaaagaatatcttttagaatttattgcgattaatgaaaaactttcacttttactttatgattttagaggcttttaatataaattatctaatttgtcagctattgatttttgtttgctagggtatagatgtgaataggtatctatcgtagtagtgatagaagcatgtcctaaacgttcttttactactaggtaatcttctccttggttaataataatgaagcgtgtgagtgtctaaaatcatgaattcttatccttttcaagctagggtctctttgaagtatttgtttaaactttttatcaatcatatttttagttactgttactggtgttgattgaataacttgcaagttttgtgtcgaagtggtaaattgacttagtatttcaccctgcttatttttccactctttcaaagtattcaagagtttttgatttaaagttatataccttgttacagctcttgtttttgtactatttacgtggttggttttatttacatagtaaacagatttagtggttctgttgcgaagtttgaaaataaaacgcgttctctctgaactccaaatatcttaggctgttattcccattaataccttgatttcagtagacaccgaaaagccgaagagcgttccatttcttcacatggtaaagtgtgggctctgcgaggcttgtttttgctagcgcaaaaattgacacttcgtgtcaaaaaacacctttttttgtgccaatcacaaaaaaatccgcccaaaaaatgggcgataattcactcaaaaatttatcaatttttttcgttcaataaagccaaaacaaaaaaagagtggctaagccactctcaagatcacaatttagttcattttagcaaacgcaactaacaatccctgatcacaggattcgaaaccattcttttcataaaaatatctaacaccagaagcttcttcagttaaaagaactttttgacgaacatttttgtatttatttaatattctttgcaataattcacttgcaatacccttattctgataagcattcaaaacaagtatatcttgtatatacacaatcgttaatccgtctccaatagccctaataagccctactaatttatcgtcattccaaacagttataacatctaacgattgtaatatagcttgctttaatacttccaaatcttgagtatacgcaccccaaccaacgtcattatataattcttctaattgcttaatatcgatatctttacttatactgaaatttattgtcatttttattaactccctattcaaattttatactgaatagtcactccataatttatcaactgtcttatgaaacctttcaaaatacaaatttttctccagtttctctatctatttttttaaaaggcttatgccgattagaacgtaaataagcagttaaaaagatcgtctgacttctaacagtaggaaaccattcatcaaacttttcagatacagcataatcaaccaagtcgccatattcataacaattagattcacgaatccattgtactatttcttgcagaataacatctgtatctacaccaacgtctgttaaatattgacgatatctaaaaccattatgagcaacaacttcacttttatcatactgatacttttcaggattgtttgccttcaaaatgattcattactctgtcctctctgtcttttttctcaattttacactaaaatagattttttggaaaactttgcaacagaaccggaaattccgtcaattttaatttcaactaatcctctgacagcatttgtcatataaaaacaatcataatttttcaaatcagaaatcgcaatatctttatatattagcgtatgatttttcgcaaataaatctaaaaaagttccttttagggcatatttggccggcgtttcgtactgattccccttttttgccacaaaatttccgattgataattcactgaccaaaccatctgtatgaaatagaatatcttgaaacccttcttttttcacgtctaagacttcctgacgaaagaccttttgaaaatctggccctgaaagtttaaagttagacaaaggactaggcttgtcattaattgacgacagtttaactcgataggactcatttgaatgcgtcagttgacgaatctcagggttcaaagaatctccgtcagtactgacacgtaaaactccgtcagtaacattttgagcaaattttctcaatttttcttccaagtctggatgatggtattgttttttcaagcgattgacatgaccctctaaatttaacaattcaccatttttgacaagacctgtcgtaaataaaatacttggaacatctttcaggcctaaaatatctaaaaaaggttttgcttttagtaaaatctctgaaaactctgcttctgcttcgctctcgaacgtaattccaccgcctacaccaagctgataatgttcaccatcatgaactaatgtccgaatcacgatgttcatatccaaatccatttctcgactcaaccaaccttgcatccctgtataaattcctctaggttgtttttcaacttccttaataatttccattgcccgtttcttaggtgtacctgtgattgaacctcccgggaataaagccgtcataaattcggaaaaagtcaaatcttctttaattctactttttattgaagtcaccagttgatgaacatgagaaaaagtttcaatttctgcaaatttagggactgacaaagaaaaaggttggctaattcgggcaatatcattacgcaataaatccgtcaccatcagtaactcagtccgttctttaatactgttggaaagtatttccttttgtaatctatcagttacaacatcttctcctctggcaattgttcctttaattggttttgaaattaatgctccatcatgaatagaaacaaagcgctccacagaacttgaaatttgcgtcattttccattcaggatattgtaaaaatgatgagaacggagcaggaatttgattccttgttttcttaaaaacatcaataggtttttgatcggaccaaatttcaaattgttgcgtcaaattggcaacataaatatcgccagccttcatataatcttgtaatctttttattgaagcaatatattcttgccttgtttggtcaataaaaacagcccctatgccattctgaccatcaaactcaatctctgaatccacttcaatttcttccgattcagtcagccaatattggccatcagtttgttcaaattgcacgacccgtaaccgttttgttctatggtcaaaaagtaaaacttcatcataagctgcaaaacaagcaggatcttgctcataacttacaaaacccaataattctggataaaaaggccaatttttaggccgttcaactttctcattcttcagcaaatctaccgcatctaaaaaattgaacttctttttttcaccattaaaaaacacttgacccttatattttgaaacctttttataaggtttatgagctaaaatactataatgctcattttcggtcgcttgactactatgtaaaaaaacaatttcttcatctgaccgataatattttaggaaaattttccaaatatccgtattttttattataaattccttcaaaagactacaccactttcaaaaaattatttaacatttcatgaccatattcagtaactaaactttctgggtgaaattgtaaagcccacaattttaattttggctgatgaatcgcctgaataacaccatcctcactttgcgcatcaatttcaaaatcattaggtagtttatcgacaatcaacgaatgataacgtgcaactttcaaattttgtggaagtcctttaaaaatcccttgacaattatgacgaatgacagaaatttttccatgcattggcctctcaccaagaacaacatttcccccaaaacattcagcaatgacttgctgacccaagcaaattcctaacataggaatttttccagcatatagttgaactacatccctactaaaaacggcttcttttggtgtttttggacctggagaaatggtaatcgcatcataattttcacaaataaaatccggagaaattctaattttctgactcattttatcttggtcattaaccactgttacactacaatctaattcctcgaaatactgtaccaatagataagtaaatgaatcataattatcaattaaaagcaatttcatttcagcctccttctttaattatactaaaatatttattaagttaagtattttaatcagtctaatttcaaatctataaagcgaatatttcttcataaattaattaatttacattttttaataaaccatttatgaatccaacaataaaatcataaactattggaaatgcaaggcctaaagctaaaaagataaagccaaaacgactccatttattcatttgtgaataaaaacttttaaaaccgaacatcataatgactaatcctataacagcaatgtaatagccaattgtataaatcatttaatttctcccagacctttattaatcattctgactctttgaattttttatccataaaaaatttaaaggttctgttgcgaagtttgttgattgacatcgataaatttcatgtttttttctccgtaagactatgatggaatatcctgagtcttttctttattgatttctttttctttaagtttttcttgaacaatttcctgccctgcatcataagttttcattttcttgatgacttttcgatattgagcttgtaaatcttttctctcaagttgaagagctttaattttgagtttattctcttcagttggattttcgtattttaattgctcattctgttttaaaatatgagcatctaaatatttgacattagtccagaacacttaccttaaagaaaattagacataaaaaaacggccccacaagaaaattgtgaggctgttttgaattatatagacgtcaaattactttttgaaaattttgtagttcgttggaaccatcatgaagttttcttcagtaaatgggccatcataaattttgattttgcaaacttttgacgtcacatcaaggtcgtgaacaaagtaaattttatatggtgtatcttccaaagaggatgcaacctcattagcactcatttcaaatccatcagagaagtttgtttttgaagctttcacttcaatatggatttcattacctgattggtcaaatgcacgaatatcatagccatgaccatctccttcagttttagaaacatgttcaggaagttttgttttgttcttttctgctttctgaatgagaaaatcaagtacgatttcttcgcctagagcacccgttttttgttttgctttgttgacacgttcccaatcagtatgacgtcctgtgaatttacgtttctgagtcccattcggatgatttggtcccacctcatctacaagaacagtaaatccttttgaacttgcttcttcaatttcttcaacttcagcatttgtcaaatctttttcaacgggtaatgagtgtgtgtcatcgattggactgagatgccgattctcaattagccccacaaaatcagtataggaaatctcattcatcccgtattgatcccagaagtaagcccatgaatttggctttttacgcttcttcttgttaggtgtattccaatcaaagttttcaatgaatgaatcgccttgcttgattggcggttcgattgtaaatgcgtgtgtaattactgccgtaacatttccattttcatcttcgtcagatacactttcgacgtatcctcccccataaatttcccacttacggtctttagtaattttccccggatgacgattcaaaacaaccgcaccggctttcaatttaccatattggcgcatgttccaaccgtaacttttagcatcatcagcgtatttcagctgaccatcatcttctgttttcccatggtccaagataaatgcttgctggttttctgttggttttggtaaaagatctgtgtaagtaaccatattgatacctctttctataattcaatcagaacaaatttccgttccggttgaatcaataatatcacgttttaagttttaagtaaacgttcggatggagctatactataaaagtggacagaaaattgtgtgttataatctgtctattaagacacaaaaatgaaaggacttttatgtcaggttttaaacgttacgacgaggatttcaaaaaatctctcgtattttgtttgttcatccactaaaaatatgcgaacagtatggcttcattcaatcctgttcttacaagtcaaaagcgaatcatttacatttctcgttcattaacccgtaatttattctatgttcatttatatatatatttttaagttatgatacaataaattagaacaaaggagaataaaatgaatatcggatatgcacgagtttcaactggacttcaaaatttggatttacaaaaagatagtcttaaaaaatatgattgtgagaaaatatttactgaccatctgtcaggaagtaaaaaagatcgacctggtttaaaatccgccatcgaattttctcgttctggagatacaattgttgtttggcggttagatcgattaggaagaaatatggaggacttaattagcatagttaattcacttaatgataaaggagtaagcttccatagcttgcaagaaaatattacaatggataaatcaagttcgactggacaattgatgtttcatttgtttgcggcttttgcggaatttgagcgaaatcttattttggagcgttctgccgctggtagagaagctgcacgtgcaagaggacgacttggaggaagacctgagaaattttcggagcaagacgtaaagcttcttaaaaccttggtagaaagtggtacgccgattaagtcgattgcggattcttggggagtgtcgagaacaacgatttatagatatattaataagttttagaataaactaaaaaaccagctcacaactattaaggtgcaagctggtttaatttttttactttggtataattagtaactcatactaattttacaatcttcgataagatattgactgatatttctaacaaaagatttcaagcgttcctttttgttatgtaaatctaacgctggttgattttcccaattttctgcaattacatattgagtactgtcttggacaacgaactgaaccaactttgcaataggttgctttcagtgaatcttgggcgaaacgaatatgaattctctccaaggtcaataagttaagcaagatacaaaaagcttatcattatgataaactttttacgttttcagtttaagtattgcatattttcaactcgtttttccgaccatttgtggcatacttttaacaattctactttttgttcttcattcaattgctcgaagtaagctcgtgggtcattggggacatgattggggataactcccatcagatatcctggtggaagttggaagtattgggacaaaactaaagcaattttattagcaatagcttttcctaaagttttcataattcctcctctatcaataatataacaagcataattataacccttttgagagaagttgaaaagtttgagctaaaaattcgataaattctttttcagtcattatcattattcgttgtccttttcgtttagattgcttagcctctgatattttatgcgaatgatgatagccttttattaaatcaatcggaaaattgcctgtgactagtctagtcgtttttttagtcacagcgttctgattatgcccttttaaacctataatgattgattgtgcttgttttcttgtcatcgttgtaagggtgccagtaaatacaaaatattcattctctagcattaaaccacctctgctgtttttctgaatggactcgatgatcaacttatttgaccttctaggaatccaattatatcagaaaataaatataaacctttgaagtatactctggtatcctaaccgtgctagcaataactctttttataatatatcaaaaagtggaaaaagcactcataactttgtggttataggtgctttttctaaattatttgactcaatttaaatatatcattaatataaattcaatgattaccaaattttaagacgattttctggtgcacgatacatcttatctgtttctttaacatcaaaagtatcgtaaaattcttcgagatttgttggaggaatatttgcacgaagtttagcgggtgcatgaaaatccattgacaaaagcatttgttggaattctttacttgctttcatgcgccaaatcttagcccactgactaaagaaagctttcaaatcaacgtctttctcatctttagctgctgtcagtgccgctgtaattcctccttggtcagcaatattttctgacacaatgagttttccgtttgctggaccagcttcggtttctacgccgtcaaagagtgcaatcatttctttttgcttttcttcaaaagcttcataatcttcatctaaccaccatttgttcaaatttccttctttatcgaattgggcaccgttgttatcaaaagcgtgagaaatttcgtgagcaataactgtgccgattccaccgtaattttgtgatgaagattgttcaagagagtaaaaaggagcttgcaaaattgctgctggaaaaacaattgtattactatcaggactataataagcattgaccatatgagcaggcatatgccagcttgttttatcaacatcttctgagaatttttcaaaagttcgagcagtcaaaatttcatcgaatttaagggcatcttcatagagagagccagaagttgtttttaaacgactataaatttcaggcaatttatctgggaaaccaatgaaaggagtaatagcatccaatttttcaatggctttttcagctgtttcttgactgagccactcatttttagacaaacgtgcttggtaaactttaatcattgcagtgaccatccgtttgacatcggccttaccagcttcaccaaaatattttttaccatagaataaaccaatcacttggctaaaataagactcagtcaaatcaagttgatgtttttcttgacttcttgcttcttgaacatttgaaaggaaacgtccataagctccaccaagaattctaaggtcttcattgaagaaagaagtagcgccacgtgcaattttagtcagcatccaagctttaatgagtgaccaattttcttcattgataagtgaatcaaatgattcataaaaacgatcttcgtaaacaatgactttatcaggctcagtttttactaaatctttaattaaagattttaaatccaggtttttaactttactgacaaagctgtcagtagaaattggatgataaagttcagcatattttgcccactcttcagaagtatttgctgatggaactaaaagagcatcgaatttaagggcagactttgcaatctcttctgcattttcaacatcaaatgtctttaaaatttcgcttgtatttttagcccaaaaatcaagtaattctttttttctagggtgttcatcattataataagtggtatcaggtaaaatcaagcccggaccagagaatccaagagaatagtgaatagcatctttcatatcaggttcaacactaaaagaaaatggaagaggagcctgtgaatggaaaacgagttgagtcaaattatttttaaaatcttcaaaagtatttaaagtttcaactttagcaagttcattttttacggcagaaaaatccgctttttctcttgcttgccaatctcctgctttattataaaatttgattgcttcaagcaactctggattatcagtaggtaggttttgtgataaatcagctaaatctttagccaaatttttctcattttttagtactaattcatcaaatgcagaaattcttggtttgtcagcaggaatttctgcattttctaaccattcagcattaacagtagcgaataaatcatcttgaatccttgtcatatcaaactccttttttaataaaagaagctcaaatcataaatttgaacttctgtgactttagaattgcgaaaactaaagtgagggtatttttacaaaaaaacttgtaaacaaaagttaagtaaaactatttggtggccaacttagcagaagaaacaccaatttctgaccaagtatccattgcaccataatcaagcgtcattccaactacacgtttgttaaccggcgtataacttaacgagaagtttgttggaacaacataagcttttttattcatatcttcttgatatttaacgaaagctgctttacggtaagttggattttcagacttggcagaatcaatatcatttaaatccttagtaatttctgaatcattaaagtgaccaaagttataaggtgctgatgctgagaacaaatcttgttgagaaggttctgatgccaatgaccaagaaccgtcagtgatatcccagtcatttgctcctggaggagtcgtcatatggtcgacccaagaattaaattccatcaatttaccgttataaagactcacttttaccccaattttcttccattgttggatatagttttgggcaatggtttcagcgtttgcatcacctacacgagccgcataaacaagcgataattcttttccatctttttcacggtagcctgtagatttattcaatttccatccgtcttcatccaaaagtttattagctttatcaagatcttgtttttcatatcctttaactgatgaactcgtaaattgtttaaagataggtggaatcaaactatttgcaggagttgaaagtccgtttgagaacttattagccacttctgcgacatttcgagcataaccaatggcttgacgaacattttggtcttgcaatggcgttttacgatcttggacattaattgaatttttagcatcatagtgccctaagttatagtacattaaggaaatagccatcgcttgttgtcctaaaaccttgtatccctttaagtttttcacttgcttatactggctactaaccatgccgttaataaaatcatatttacttgatgaaagtgctgcgactgattttgctgttgatacaacttcataagtaattgaatttagttttggttttttaccccaatagtaaggatttgggacatatttaatagattcaccagcaacaacattttccggtttaaaaggccctgtaactaatggtttcgttgtcgtttttggactagaagccaagtctttaggagcaacatctttcaaatattgataaggcgctaccgtttcaaggaagtaaccatttccggattgtgtcatccccggtttcatttctttaaattgaaccttgatgacttttccattttcaccatcagggaaagtaatccctgagattgttttagctttacccgcatgataatcactcaagccaacaatatttgccagagaatcagtccaacggtcggaaccataagcaggattagcaatcgtttcataggtaaattcataatctttagccgttacttctgaaccatcagaccatttcaaatctttacgaagggtaatcgttgccgttttagactctttatctagagcaacatcggcagctcctcccttaataaatttgaatccactgtctgtgaagaacaaaccatcttgacctccaccaggaccagacattgtagcaaaagttgcatcattagaaagtcccgataaccattgtgctttcattggagaatcactttgatatgcgacttttaaatttccacctttgattgccttgtctggattttgataagcaacgtcaaagttccccgcttttaatttttttgtacttgtacttgagctttgattagaaccacaagcacttaggagtgtagctgctaaaactacactacttgccaataaagttacttttaatttgttcatcttagtttctccaataatttctttttatttcttgcttgcttcaatataatatttaatttatcatatccatttttaatagataaacatttttatcactattgaatgttgtttatcttgtagcttgtctttggtcagccactcgtcttagtgcatttccgataaagataatagcaagcaccacaattaggatgaccactgttgctggaacccaagtccaaggcttatcagtcattgtttctggattagtcgcttcatttatcattgttcccaaagatggtgtccccgctggaagtccaaaacctaagaaagaaagccctgtttctaaaccaatatttccagcaaaaacaagcgttgcttcagcaatgactaaggtggacaagttgggccatatttcccgaaacataattttaaaatcagaggttcccgaagtttttgatgcttgaacataatctcgattgacttccgtcattgttcttgcccgaatcagacgcgttgtccctatccaactaaagatactgataatcccaatcaaagaccaagaattaaaccgtgggatgatagttacaaaaacaataatgatcatcattgatggtaaaatcatgacaaaatcagtgaaacgcatgaagattaaatcaaaccttccgccaaagtagcccgtaattacccctaagatatttcctacaactaaagtaatgagtgtaactgcaaaagcgatattgaaagagtttcgtgcagaaatcattaacatcatgataatatctcgtccaccattatcagttcctagtaaatgtccagtcgtcagcggtgccagatattggtccatgatattcacatcaacataatttgattgttttaaaaacatcgagtaaatataaacgattagaaagacagcaactagaaaaattgttgaaatcatcgctaatttatctttttttagttcttctttgattgagtgaactaatgataaagaatttttgtgttttttttctgtcattttcactccttattgaatccgaattcgtgggtcaaccattgccatgataatatccgacaggagggctccaagaagtcccaaaaaaccatttaataaaatcaaagccgtaatcattgaataatctcgcccactgattgaagtaataaaaagttgtcctaagccaggatagccgaaaattgtttcagcaaagattgctcctcccaagagtccagtaatcacaaatccaaaattagaagcaattggtaatgaggcatttctcaaaatatgacgtctaaaaatcactttttccttaacccctttggctcgagccgttcgtacataatcttgtgtttgttcatctaaaattcctgagcggaagtaagtaaagattccaactgttccaaagaccgccaaactaaaagccggaagaatcatgtgataaatcttactaaagaaaacaggaattattcccatcgcatctggacttaccgtcccacctgtcggaaaccaattaagactataaccaaagataaagataatcaagagatagaatacgtaaggtggaataccaaaagtaattgaattataggtcaaccacaattggtcttgccattttccttcatttcgagctgcaactatcgacatcggaatagcaaataagtaagttaaaataactgacaaaagtgacatccaaaaagtattaatcgctctatgtccaatgacagtcatcacaggctctttgagattataggacattcctaaattcccatgtatggcattccctagccacctgagatactgctcccaccaagggtcatataaacctgctgcccgtcttaatgcttcaacttcatgtgggtcggtatgaggaccaatcaaccctgaaaaaggatcaccaggcatcaatttagcaaagaagaaaacaagaatactcaagataaataattgagggatcatcaataaaatacgtctaataattactttccacattttcccctccttttggcaaagcagcccaatgactttcacttaatttttttaagggcaaagcgtgtccatctttgtcataaaaatttgcttttttatcctcaaagtcttgttcaacttttagacggtttttccgattttccgctcttcttgtaacatcaatcgaagggatagcagataagagtcgtttagtataaatgtgctgtggctcatcaaaaatatctcttcgtgttcctttttcgacaattcgaccgttgtgcatgactgcaatattatcagtcatatggcggacaacccctaaatcatgagaaataaaaagaaatgcaattcccaagtccttttgaatgagcttcatgaaattcaaaacctgagcttgaacagataagtctaatgctgaaactggttcatctgccacaattaacttaggattagtagcaactgcccgtgcgattccaattctttgttgttgacctccagaaaattggaaaggatactgttctaaagcttgtttaggtagtccaacaatatccaataattcatgaatccgtttattttccgtattagcatctattttttcaaaatttcgaataggctccgcaatgatatcgtaaattgttttccgtggattcaaactcgaaaatgcatcttgaaaaatcatttgaacatctttattgtatttgagctggtttcttatcttttttttgctgacatcttgtcctttgtaaatcaattgtcctgatgtcatttgttctaaaccaacaattgttttgccaatcgttgattttccagagccagattcaccaactaaaccgacagtttctccttcatgaatcgttaaatctactccatcaacggctaaaacattatctgtcactcgattaaagaaaccagatcgaataggataataaacttttaagtcctttaaattaagaatttcgctcactttttaccccctttcaatttttgatctggaaattcaaattttttccaagcctgacctcgaacaaaatgatttgaagaaatttcagtcattttttccgaaattactttttgagcttcttctttcatccaaggcactcgagcgagaaataaatctttgtcatactcaatttctgacagagaaggcacagaccctggaatcacatataaatcatccgaaactgtttcggcagatggatttgaacgcaaaagtgaccgggtgtatggatgtttgggattttgaaaaagctcttcaacagaagctttttcgacgagttgtccggcatacatcaccgccactgtatcagcaacttcagcaacaactcctaaatcatgagtaattagaataaccccagcattcttcttcttttgtatttctaaaatcaagtctaaaatctgagcttgaatggtaacgtctaaagcagtcgttggctcatcagcaataatcaaatctgggtcattggcaatggctattgcaatcattactctttgtctcatcccgcctgaaagttggtgaggaaattgattaacgactcttttaggatttggaattcctacttgttctaaaagttgaaagattctactttcatactgattttctggataaacatcatgcacggccaacatttccttgatttgctgcccaattttcatcaatggattaagcgcagtgagtggattttgaaaaatcattccaactttacttcctcgaatacttgccatggagtcacccgttttaccaatcacttcttcctcatccaataaaatggatcctgtaatttgagtttgatttgggttgtgtaatcccataacagcagttgccaaagttgatttcccagaacctgattccccaacaatggctaaaacttcaccacgtctaagacttaaatcaatatcataaattgctttttgaaatttaccagcaatccgaaaggcaacactcacttgttttgcttccaaaatattttcactttccatatttacctcaatgaaatctttctaaatagacttaataaaagtatacttctttttctgtatatttgcaaaaaattatcattttggatatcttcatgaattttctgaacattacgggaaatgaaggtaaaacaacagttttggaggaaataataaaagcagtaatcatattaaaaactgcttttattatacccgaattgctagaggaattccatgaacggaattactgcgtggatggagaaatatctcgtccctgttgcggcaaagattgggtctcaaaaacacctagttgcgctgcgtgactcatttatcggtatgttgccagcaacacttgctggtgccttggctgcaatggtttcggctattgtaacaacattcccatcagctatccaacaaatgatgttgggagcaacagcattctcaaaattagcaccagaaaaagtctggacacttgctaatacaccaattattggtgatttgaacaatatttcagcccttgttaaccaaggaacactgacagttattggtcttatctttgccttttcttggggttacaatttggcccgtgcttacggagtcaacgacctcgctggtggtatcgtatcagttgcaaccctatttgcaggtttgccaaaccaaatgggtaaatttacagcagcccttgggacaggtaaagctggtgtagcagcaactgacaagatcaatggcgtacttggagatcaaggacttgccgcttggaaaccactctttgcctcagctcacctcgatgctggagcttacttcacagttattattatgggtgcccttgcagttattatttatgcaaaactcatgcttgctgacatcacaattaagatgccagaatcagttccacctgcagtagcaaaagctttcttggctatcattcctacaatcgcagccctttatatcgtcggcttaatctactacatcattggtaaattaactaatgactctgtcattaaccttatcactcactacatcgcagaaccgttccaaattctgtcacaaaatatcttctcagtactgattgttacactctttgtttcagtattctggttcttcggacttcacggaccaaacgttttggcaccagtacttgatggtatctggggacctcttggacttaataaccaagccctttacttccaagtacactcacaaggtatccgtgacttgattgctaaaggtgcggttgataaagctcatgccattaatggtgactatgttaacctttgggtacgtggttcatgggatgcctttgcatggtttggtggatcaggtggtacaattacacttgttattgcaatcatcctcttctctaaacgtaaagactacaagattgttggacgtctcggacttgcgccaggtatcttcaatatcaacgaaccagtcctctttggtctaccagtcgtcttgaatgcgatcttctttattccatttgcagtcgctcctttgatttctgtaatcattgcctacactgcaacagcccttcacttggttgacccagtcgtcaatgccgttccttgggtaacaccaccaattatgaatgccttcatggcaaccggctttgactggcgagcaattgtccttacaatcatcaacttaatcatcaccttcgttatctgggtaccattcgttatcgcagctaacaagttggaagaaacagaactcgactaaatttgaaattaatggtagagcaagtaagaaaacttgctctacacattttttgttaaatctggtaagatttataaatataaaccttatcagatgtgataaaaaacattcatagaggaggagatactatgatactcgtaaattctgcaatgatgcaaaaagaaattattgaacttttagaagaaaatggctttaaacataccaaaaaacaaggattaaaacttttctttgaaactccaacggacgatgcaacgactgacgcagccatggctaaacaattaattaaaggaagctcatttggagcggctgtcttctttaatgtgagtgttgtatgagtacctggggaatagcttttatcagtttaggcctattgcttgtggcttatcataactggcttggtctagcgattgtattaattggtttcgtgatgatttttattgcacgcagtcaaaaaaagaaggccaccaaaatagaagaagaaaatagacaagaacacaaagacataaagataaaaacaagaaaataaagttgtcttttaaggcaactttttaaatttttttgtctaaaattaaaaaacaaattccaaaatataaaacaaaataaaacggttacaaatgttataattgtagtataaataaccagtgggggaataatatggaacacaaaaaattgagctcatttccaagtgattttctttggggttcagcttcagcagcttatcaagttgaaggagcaccttttgaagatggtaaaaaagcgagtgtctgggataactttgtccgcattccgggtaaaacttttaaagggacaaacggggatgttgctgttgatcattaccatcgttacaaagaagatgtcgctttgatgaaagaattaggacttaaatcttaccgtttttcgattgcttggacacgtattttacctgacggacgtggcgaagtcaatcaagcgggcttgaaattctatgaagacttgattgatgagttgattgctaatcatattgaaccaattgtcacgatttatcattgggacttgccccaagctttagaagacctgtatggcggctgggaatcacgagaaattatctcagattttgttaactatgctgaagttttgtttaaagcctttaaaggtaaagtaaaatattgggtatcgcttaatgaacaaaatatctttacaagtcaaggttggtcactcgcgactcacccaccagggaaaagagatatgaagctcttttatcaggtcaatcatatcgcgaatttggcaaatgctgcggtaattaataagtttcatgagcttgaaatggatggacaaattggcccttcattcgcctatacaccgcagtatgctaaggattctgaccctttaaatgttttggctgctgagaacgctgaagaactttatagccacttttggatggatgtttacctttatggtgaatacccaattgcggcaatggcttatctgcgggaaaatggtttagcacctgaatttgaagcaggagatgctgaactcttgaagtcggccaaacctgattttctaggcattaattactaccaaacggcgactaacgcttggaatccaattgatggtggggttggagttggttcatttaatacaagcggtaaaaaaggaacaaccaaagaatcaggaattcctgggcttcataaaaaaattcaaaatccattcattgaccgcacaaattgggattgggaaattgacccagaaggtttgcgaattgcactccgtcgaattacttcacgctatcgtattccggtcatgattacggaaaatggtttgggtgaatatgacaaagttgaagagggcaaaattcatgatgattaccgaattaaatacctagaaagtcatgttaaggcaatcaaagaagccatgactgacggtgctacggtcattggttatcacacttggtcttatactgacttactttcatggttgaacggttatcaaaaacgttatggttttgtttatgttgaccaagacgaaacaatggaaggttccttgaaacgaattcctaaggattcttattactggtatcaacatcttattgaaacaaatggcgaagagctctaaacaaagagcactcaagtgagtgctctttttatgttataataataaaaaaacaaaagaggtgaagaatgaaaattcgtggatttgaagtagtagctaaatataaaaatgctggaattaacttaccaaaacgttcaactgaacattcggcaggttatgatattgaagcggcagaaacagttcgttttgctccaggtgaaattaaattaatcccaacaggtttaaaggcttatatgcagacaggcgaagttctttatatgtatgatcgctcatcaaatcctcgtaaaaaaggcttggttttaatcaattcggttggtgtcatcgacaaggattattataataatcctgataatgaaggacacatgtttatgcaaatgcgtaatttcactgatgaagaagttttagttgaaaaaggagagcgcgtggttcaaggagtatttatgcccttcttagttgctgatggcgatgaaaatcaagaaaaagaagaacggacaggtgggtttgggtcaacgggtgcgtaattcaaattaaagtaatttaagaagcgcaatcgcgcttcttatttttgtgaacggaggctttcaaagcttattacttatgatataatagtattatgaataaactgcgtatcctccatttgaatgatttacactctcacttggaacgtttccctgtgattgagcgtttttttgcggaaaaatcacaggaaaaagttgaaagtttacgttttgacttgggtgataatgtggaccgtgtacaccctttgacggaggcaacagaggggcaaattaatgtcgaattgatgaatcgcttaaatttaacagcggcaacaattggcaacaatgagggtttgggattgacgcatgagatgctttcccatctttatgatgaggctaattttccagttctcttatccaatttgataactgattttgctcaaacagagcctttgataatgaccacttcgtttggcttacgtgttggtttgattggcttgactgctccttactctcgtgcttatcctcaagcaggttgggagcttttagacccttttgttgtattagataaacttttacccaaaatggattgtgattttactattttgctttctcatttgggtaagaatgtcgatgaacaaattgcaaaagactatgatattgacttgattatcggagctcatacgcatcatttgtttgagcatggcgctcaagttaatcaaactttgcttgctgctgctggtcgctatggtgagtatgtgggacaaattgatttggcctttaatgaaaataatcaattagttgatgcgcagattgaagcaatagcaaccaacacacttccacaaaaaagatcagatatagtcgaaacaaatggttgggaactaagaggacataaacttttagaaggaacagtagttactaagttagctaaacccttgcctaatctatctccggattttacagcaagtcattatctggcaaaactttttgcagattatgaaaagacagcactctgtctgataaattctggtctattagtgacggatgaattaccgcaaagtttgactttggatgatttacatgaatttttacctcattcaatccgcttggttcgcttcacatttacaggtgaggaacttcggcaagttttacttgaaattattgatgtttcggcttttttacccactcaaaaaattcaaggaatgggttttcgtggaaaaacttttggttcacttatttttcaaggaattgaaccaatcaatggggacttttacctgaaaaatgcgaaggatgattcgctcgaaaaaattaatgatgagcaaaagtatcaaatccttttacctgaccaatatctatttgcttggtatttcccattactgaaaaaattaggtcagtcggaaattttatttccctattttttacgggaaattgtagcagaatattttaaaaataaatagaaatagaaaaattaatggctaaagtaatagatgaaactaaattaaattataacaagtaccctggggaacatgttatggcatcaggagaagtcgttcaagttggaaaacgaacttttcacattgttcataattatcgagaggcttttgacgcggaaaaattggagcaacgtttttctgatgttttagataaatatgattatatcgttggagattggggctttgaacaattacgtttaaaaggttttttctcaacgagtcgcaaaaaaatgttagcagataataaaattgaccatcttgaagattatatcaatgagtattgtaattatggttgtgcttactttgtcttacgtcgaattcggacaagggacgaagcctttgtttctgaaaaactttttaccgaaaaagaattaaaacaaggtttagataagccacgtcgcaaaagaaatcgtaatcgaaatcgagcccgtgatgagcaaactgtgaattctaaagatgagaaacgttcagaaaacgcctcagaagctcggaaagattttaaaattcgtgataaatctgctgacagaaaagcaaaaccaactgacaaaaagataaataagccgctcagcaagaaatcgcaagaaggacgagctgacaaagcagtcaataaaaaagttacttcttccaaagaatctgataaaaaatttacaatgaaaaaacgaaatccacggaaaaaagttgaacaaacagagcctaaaaaccaaggaaatcaaggttttgttattcgtaatcggaagaaagactaaagctttgtaaaagttatttgacggtcagtgaacttgttaaagattaaaaattatcgtagaattaacatttatggattccttaaacatttggaattgaaaataattagacgaatataaagtagttttgattgtgtattcaagggatatgaaatcgttcacaattagaattctacataacgataaggaaaataatgacagagaatataacaacagaaacacgtccgtctatctatggattgacacgtgatcaattaatcgaatgggccattgaaaatggtgaaaagaaattccgagcaacacaagtttgggattggctttaccgcaaacgtgttcaatcttttgaagaaatgagcaacttatcagcggtatttattgataaacttaatgaagctttcattttgaatccattggaacaagtggttgtgcaagagtctgctgacggaacagttaaatacctctttatgcttcctgataaagtgatgattgaaacagttttaatgcgccaatcttatggtttgtctgtctgtgtcaccactcaagtgggctgcaatatgggctgtaccttctgtgcttctggtattttgaaaaaagaacgcgatgtaacagccggtgaaatcgttagtcaaatcatgcttgtacaaaagtattttgatgaacgtggtttagacgaacgtgtttcgcatgttgttgttatgggaattggtgaaccctttgataattatgaacatttgatgaactttttacgtgtgattaatgatgataacggacttgctatcggtgctcgtcatattactgtttctacttgcggatttatgccagcaaaaatcaaagaatttgctcatgaaaatcttcaaatcaatctagctatttcactccatgctccaaataatgaattgcgtacttcattgatgcgaattactcgtaatgcccctcttgaaaaactctttgaggcgattgattattatacagaaacgaccaatcgacgggtgacttatgagtacattatgttgtctggtgaaaatgacagccctgaaatcgcgcaacagctggcagatttaattaaaccccgtaataaattgtcttatgtcaacttgattccctataatccagttgctgaacatatcaagtatgaacgttcaacaaaagataatactgcaaaattctatgatgttttgaagaaaaatggtattaactgtgtcgttcgtcaagaacatggaacagatattgatgcggcttgtggacaattaagatcaaaacaaattaagaaaaacaaggccaaattagcctaagaaaaaactgctgatcaagcagttttttttactgacagttctgtcagtaaaatatttcggaaatagcttaatttttaataaaaaataagaacaatgaataaatatgctatgcaaaagttacaaaaatttgctaaaatatagacaagtaaaagaaaacaggtgtctgctctactagacttagaaattgcttagaccaatttcatagcgactattcagctgcatcctataagagaaatagaggagtatcatggattacgtaaagcttaataaatctcggcacaaagtaaaaacatttgatggcaaaaaaattcccacagttgatgttaaacaaatcatctcggcggcaagccttgcaccttcagcacacaatattcaaagttggcactttgtcattgttgaatcaaaagaaaaacgtgaagctttactgacagaagtagaccctggaaatcatgaacaaatcaaacaagcaggagcggtcattgtccttttcagcgatacagatttggttgagcgttctcgggagattgcaagagtaggtgctggtgaattggacgatgaacaacttttgcgtttcaatagtcgctatccacaaatgtatgaaggttttgaagaacttcatgagagtaattacctttcaattaatattggtctagttacaatgaatctcattttggctattaaaaattacggatatgaaagtaatatcatcatgggctttaatcggactcaaaaagtgaatgaacttttagaagttgaaaaacgctaccgtccagaattaattattccacttggaaactcagaagacaaaggaaaaccaagctatcgtcttcctcaaagtcaaattatggaaatcagataaaaaagaggttcagctgaacttctttttttgattatgaaaagaagccattatgttcgcaacatttggtctattttgctaaaatagagtaaagtatttgataaataattatcaaaagaaatgaatgaattatcgagaggaaagagaaaaacattgctcacattttggcaggattatcccgaaattcagaataaattaaaggatgttcaagcgctcatgattgagcgtttaaaaattaataatcaagaaatagaagtagcactgcaaaaatttgcatcacgtggcgggaaaatggtgcgtcctgcgctttttttgctgttcgctggtattgttcctaatggctcaaaagatgaggagaaactaatcaaaattgctgcctccttagaaatgcttcactcagcaacattgattcatgatgatattattgatgactcacctctgcgtcgcggaatgccatcagtagaatcgcaatttggcaaagatgtggcagtttatgctggagattttgtttataccgtttattttgagttactgattgaaacgatgaatgggacgagttttgttgctaaaaatgctcagtcaatgaaaagaattcttcaaggggagttaactcaaatgcagtctgcatttgataaaaacaatacggctcgccgctacatgaaagctatcagtgggaaaactgctgaattactcagtttaagttgcctagaaggtgtttattttgcaggtggtgacaagaaactacagcattcggcacggaaaattggtcgagcgattggtctagcttttcaagtttacgatgatattttaaatttcactgtagggcttgatgaagccgataaaccaattttaactgattttcgtcaaggaatttataccttacccttgcttttggctagagaagttaatgaagcagcaatcgctccatatctagaagcaccagaaaagctatcgagacaagaatgtttagatttagcagaattggtgacagaattaggtggaataacgggttctcttcttgttgcaggaaggctgacggaacttgccttgaacgaaattaaaaaattaccagaatcacctaaccgtcaaattttagaagaagcgacacagattttattagagcgaaattattaaaagcctgtcaccgataggttttttaattattataagtgtcgtcaactgacgaagtttgaataaaaatatctagtttttttgtagaaagttttatattaatattcttctataattgcgttatggaattatgactttagtctagcataacctcgtaaatttttgaaagaaatacttctacatctgttttttatcttattttttataacttatttttgaaatttaacgaaatcaacgttttgatgggaattccaacttaataatctccataatcaaaacttattatttgttcttttatattgacctgcgcattaattccaaacggaattatacatctaggagtagcatgaccaacattaacattataaacaatacataaagttttatttgaaatttcatctaaaacaattgttttatactcctcgtaatatgtttcattttgaggtttaccaacaagtaatccggatataacatcaaataatccaaattcttctagtttcttaatcatttctctaaaaatgtctggggttggtttttcttcacttgtttcaagaagtaaaatctttcccttccactcctctaaactaggaaataattcatatttgtcacataaactaattgtatcttcatatcttgaattatcaaaaaaatcaaatatagattctagacatcctcccaatattttaccttcaaattctgaagtacctctaattaactcaaaaccatgattgatatgcttttttaatgaagtccctaaagactctttgctataatcaagtcgctcttcataccattcactactcggctgcacattttgtatgctttgtttgtttagtaattcttcaaaataaaactttgtataaggaagcatctcttttgatagttcacagatatcaggtataaacgcttgtccataatatgaagggatgcctattttattaagcataaagtgattcatggttgtatctgaaaatcctaaaaaaattttttgtttagccgcttttcttaatctatcatcttcaaataagtatggaagcaaccgataggtatcatctccgccaattgcacataatatcatatcaattgtatcatcactaaaagcgtcaattaaatcgtctgctctagcctcaggatggacttttataaattcaactccttttaatgagttactcataaatttcaactcaatattatagttttttaaacgctcgactcccaaattaacttcatgttgaatatattcttcacctaatatgccactagagagactaacaattgcaattttttttatactcatatctcacctgtaaagctttctgatttttaatttgattatattgaaaaacgctagaagtaatgttcatctccataaaatttgtttaagtaagtattattttttattttgttaaccttttcttcataaaatagaccatcttcttttataaggatgtctcctacaagctgaactttgaagttcactctttatttaaacaacttagttacatgtttttgagtgacaattttgttaaaaaagttatcgtgcagaaaattcttatcgttttttttcaatagagtcaagaacccacattcccacagtcatgaaaatcactgataatataaaccctagaattaaattaaaaaaaggagcgccaatattttcaaacttttttaaaacaaaatctgataattttattgaaatgaaccaagtcaaagcctgctctccgaaggacatttgattcattctctgatacgctcgtcttaagtatttatccattctttctcctctctccttaaacttataattttcttaaatctattataccaaaagcataagaagtatgttgaacatctagaggctactcaaggaattttaaaatatattgagacctactgcaatacaaaaaggatgcattcagctcttgattacaagttcccaaaaaattttgaaaaatatgattattaaattcgcttaacctcgtgtctagtttttcgttgactttccaaattggactactattaaataattagacatgaaatgatattttctctcttataaaaatcgaaactttaccgaaaatatatattcagctcataacttaacagttttgagctctttttgtgtatactataaataaagagattttgacggatcataactaagggttataagtagaggagaaaatatgaaatttggatacgctcgagtgagtacaacagatcaaaagctagaaagtcaaatcgaaaatttaaaagctgcaggagcaaaaaaaatatatcaagaaaagtttactggaaaaacaacagaacgaccagaatttcaaaagctcctcaatcagcttcaaaaagatgatatgcttattgtgacaaagttagaccgatttgcaagaaatactcgagaagctttagaaatcattcaacatctctttcagaatgatataaaagtacatatattaaatatgggaattattgataacacacctactggtcagcttatctttacgatctttagcgcttttgctcaatttgaacgagatatgattgtcaaccgtacgagtgagggtaaaaagtatgcgaaagacaatgatccatcatttaaagaaggacgtcctccaaaatttactgaagaacaaattgcttttgcttttgaactgaagacgcaggggatgacttataaaatgattgagcgaaaaactgggataagcattgccactcaaaagagaagatttcaaaagttacagtaaaaaaagaagtgggtaaataagttgagcaggaagcacttgttctgggtaaaattgaaaagatgtaataagtagtattataataatttaatccatcagtaaataaaaaaatcatctagtccatttatattggatttagataattttttacaactatttcatacgatttttatttaaaagctgccacatttcatatgttttatccagttctttatctgacatttttgtatgcccagctattattgaatttacccatattactatttcattgattgactccccttggcgaaaacgcatatcaagctcctcaagtaaaatattataatttaagttgttatctactattggaaactttatatttcgtaaatctccaggtaatatttcaagtgcaccacctccaaatattcgaccttcaagttcaaaacttaataatgttacagatgaataaaataagaacatgaatttggaaacattggtatcttcaaaaaaactaattctatgaaaagtatcagtgctagtcgcatcaatttgatttttcacgattctcggatattccccaatgcgtctaagtaaaaatgcctgaggtatccagacagatggcacatcataccatcgatttcttattctaagcttgtagcctatattttgttctgtttctattccaaaattaatatacttttgagcattttccgataattcacgtccattaaaatctaaaagccaaaccttttgtccagaaataatatttgatttcaaatcttcatcaatataaaatattccttttacctcaacgctccttcccaacaaagggcgaacatattctgaaagaccatattgttgaactgtatcatttgatattgcaaaaaagtcattattaccagtcgttacacctacttcacccttagcaaaatcattgaaacttgatgttttttccatgaaagttgtctcgtaaaaaaaacgtgaatcacgggagagataaaacttcgtccacttatctgaatcataatttttatactgatcaaatggttcattaaataagtcaggagataagctactgagattttctatatttagtacccttaaataatgctcgtttatatctttcgtacttttttcccccataagtaaaacaacatcttgttgaatattatcaaatacaagctcttgaaatgtaacaaccgttagagttgagagattatcgaataaaaattttcgaagttgtttcgcataggtaacctgtaataaatctgtcggaagaacaagagcaagtttccccccttcttttagcatttcaacagatgcaacagtaaaagccatccaagcatttatcagcttattaggttttatgttgttattttttaatatatcactctgataatttctttgctcttctgtaagatattgatagcgaatatatggtgggtttccaataactgcatcatatttttcacttgaattttcatgaaaccgttcataataatcataaaaatcttctacaaaaactgaataattctttcgttcatttatatgctgtaagatttttagagcttcttcttcaaaaagctctacagcaaaagctgttcctttaaagttaaaacgaagtaagctttcgataaaaacaccatcacctgcagatggctctaatatccttccattttgcttatccttcaagatccagttaaccaaaaaatctgctaaatcattgggagtataatatcctcctcttagtttttgagcagatggctcattacgaatattcattatttcaccactttctcttgaagtaaatcatcaatataatgattaatcttcgaaatcaatacatcaatctgtgtttttacaaattttttcttgttccctgatgctaatgattgtattttcttgtttaaagtctcaatctttttaacattggtaacaatagcattataaactttcttctcttttttatttgaaaagtcaattgggagtagtgggattgcatcatacatgtctgtcccatgagtgtaaaaaccaccttcaaacgaacttcctaccactttaaaaatattgtctgtgaaagagtgacttaaccaagcttgaatatactccagttcatattttgacttatccttcattagaatcgcaatatcaccagctgttgatccagatgaaaataacatattagttctgtcgatattaaaattgggatgttttgacatcacaccaacaataattttatctttatctgactcctttaaaaactgattcctaccaaattgataccattcagtaggatctggaacatctcgactcccccccatttcttttggcaataatttatctttttgtgattcaagataagaaaaggcatttgggtattccctagccattgttgctgagtcaatcactttgccatctttatatgggaataatacaaacatatctgcaattaacatttgatatgatttccccggtacttttggattctttttataaaaatctcgaagaagttctttctcaatgctgaatgagttttcttttttatttgaaattacagtaaagtgaatagtatcatctgtttctccagtaataaatttcttttttaacagatagacatcatttttactcgtctgtatcccattcacagtaatgatttcttcctcaatttttggaaatttatttatagcaaattcatacaagtcacgaagttctttatcctctgtaagaaaccaatgtgaatttagcaaatcatctgaattgtattctaaataggtacgattttgaaaagcattacttactgaattaacaacagaatacttgaaaaaggtagaattaaaatttccaaattgaactattgcgacatagttggtaaccccttcaaaaatctgtgtatatttgaaatcaataatctgattcaatccattcttgttttgtattaattttcttaaatttagagctgcaccaatagtaaagaacttatttggaactaaaagctctgctattccatctgacttcagtttagaaagtactctttcaataaatagaaaatatttatcatattgcttataagcagagttgtaatttttcttatagacatcaagttcttgctttaatgttactttttttatttcttcggttttcatatatggtggattaccaagtatgatgtcgaatttttcattgctgaacccagactcttcttccattggtgcgatatctacagcttcttcaaaagaaagtttggtaatatcgatatcagccacatcaactaaagtattaccccaaatgaccgttctttcaagtgagggaagaataggggttatttcttcaatacgttccgctttttcaaaagaaagtaatcgaagcaacaaagaaaatctagtcaactgtactgctaaaacattaatatcataaccccggaaaacattttggataatttttttcttaacttcaaaaggaactaaaaaatgattaacaacgctccccttttcagttgcataccaatccacgagatattcttcgatataattataggcctctatcagaaaaatccctgaaccaacagcaaggtcagcaatccttaaattttccaattcatcaggttttaatcctataatttttgacgatattgtttctcttaccattaatttaacgacactatctggcgtagaaatgacagctttgattttcgcacttttagttttttgcaggattagtctaccctcaaactcggtaatttcctgttgaagaaaattttcataaatccgactcaagatagacaagtcaataatcgaaaaatcataggatacatttggaaaatataaattttcaacaatttgtattaaagtattatcagatatattagctattacaacagggtctttgaatattccagcattgtattttttatctaaagactcaaaatatgatcggtagttaacatgagcctcaatattacgctttaattcttcgtgctcttcgaattgattatcttctgcaaaacgtaaaaatataagttgattcaagaagagttgtactttttcgtttaactcgtttttatcatcaaatatttgattcccacttttaattaaatcgttggctaccaataagcgccaagcattcaattgttccaaaaatacttgatccaacgagagcttagtagcatcttcaggagtaatttcagaggtccagcgttcaaattcaccgtttaatacactgtcgcgtgacaataaatgataaatctcatcaaaattattaacatagtctttataatgataaatcttgtatctttcagtagaagctgtatctctcgaatttggctgtttaaaagttgtataaatgataaggtattcaaagtttgtcaaaatagagattttatgtcctgcattccagccatacctccttgcctgtatagcaggttcaatctcatttataatatctacactaacttttttagcttcaacaaaaaataaactaattccgttcatacgaatagtataatctggtctgtcacctcgttttgaatactcttcagcaacaatttctctctctctaaatgaaagattgttaggattagtaatatcccaacctaaaagagctaaaaatctatccagatattgttgtcttgtcatttgctcattgaaggagattctatgagatttataattctcaatatctttttcaaaagtgtctactattgcttgtagttgtattttgtttttcactgaagttctccctgatgttgaaagatatgaaggagaaaagcccaaatgatcttttgggcttctccacgggtattatcatatattttatcacatcagaaggggaaataccattatagtcatattttcatgtatcgaaaacataagtttttacaatactaaagtgattattagtagctttaaaaattattttgcaatatgctttaaattattttttttaaaaaatattccaaatcatttagtttttgagattgaatgttgaatgctttatttacaagtagaatacagaaattatcattttcaagtggaattacaatttcagttccttcttgacattctggttggacttttgacaatagcagtgattcgttagtgctaaagacttgatgtctaattattgactctaaatattgttctcgtggttcaaaatcaaaaacagcatgctctttttgatagactcctctaaaatttattagttttaagtagccttctgtgaattgatatagtccaataaatataatcataggtagtgtttcttttataatttccaaagtattactttgatgataagagggttctgttgcaaagtttcccaaaagagtatagaagtcctagtttaacattttgactatgctgggatccccatcagaactttaatttcagtcgacaccgaaaatccgaagagcgttccgtttcttcggttctttttgtatattcctcgaatagtctccatgcccttaatcgtggttgaggcagttcgtaaacttcgataaaatttattacggcgcttaattggacgatggtcctgctcaattaaattattgagatacttcactgtccgatgttctgtcttggtatataaaccgttaatctgtagctttctgaatgcagaactaatcgatggtgctttatcggttacaatcactctaggttgtccaaattgtttatggagccgttttaagaaagcataagccgcctgagtatcccgtttctttcgtaaccaaatgtctaaagttaatccatcagaatcaattgcacgatagagataatgccaacgtcctttaattttgatataggtttcatccattttccacgaatagaaggactgtctatttttcttcttccaaagatgatagaggactttactgtactcttgaacccagcgataaatcgtagtgtgacagacattgataccacggtcatacagtagttcttgaacttcacgatagctcagattgtaacgtagataatatcccacagcgacaataatcacatctttttgaaattgtttccctttaaagtggttcattactctgtcctcactgtctttttactgaattttatactaaaatagatttattggtcaactttgcaacagaaccgatgagacctatatagtaccggtgtagccaacaagccatgttgcgtggtacaataggtatcttcccggagcttcgcagccagaggaagatgccgatttttcgtttcgaaaggagcacgcgatgctgaatccagcacagtttccggccatgtcaatcaccactggcgggcacaccaaagataacctgcgccaagccctcgatcaagcaggtattcagtgcaacgcccatgccgatgcgctgttcgatgacccacgctttacgatttccccagagccgcacgcggcgaccgtactgtttatcaccgttgccgagctgcggttgcctaaaggcgccaacttgccggctatcttcgcccaagcagagaacagcggcttgactttatgtcccctggaactggccgttgatctgcggctccaatggcgtgaccaaggtcagagcaccaatcacgacctgcaccggcacgaggcaccccagggagccgtgacggtggcttccccggtggccgatccggatcccgggcagcctaagggctactacctgcgcaacgtgggcgggcagctttggctgcgggggtatatttgtgatgatgagtatatttggcagccagcggatcagtttgcttttctttctagaaaataataatagcaacatcgagcctgctcacacgccataatgacgtgtgagcaggcttttctgataccttgaagaagcattgaaacggtatactgaataaagaaatggagtgagttcaatgcgcacttacaccccactataaaaacgagtggggtaattgctaaaaaacgtgtatcagaagttgcttatagcaacaacaaaaaaatcaaattaaccgaagtcaatttgatctaacatcgtttcacgactggcttgatctaaaccaagataagttaaggtcattgcctcacttgaatggtttagtaaatgcatgactaagccaatgttataattggattgcttcaaagttttgtcgtagtcgttcttctaaaacttttgttcttcttctgtatttttcacccgttttggcttcgaactcttctttactaagagtcatcgaatccagtaaatgggttaaataagggatcgttttcttatcgccttgatattcattcattgcagactgtaaaaagtcgaaggataatccaaattcttcagcttctttttgaagttgtctttgaatttcattttgaatcgaagtctcttttaattgagccacatcgatctcttcagtagtattgacgagttgatctttcaaggtgtgatacatcttttgaatttgaggatccttttgttggatttctttttcaaatttttcaacggcccctgcttcgtttaattggatcgctttcaaaagttgattaatataaaaactatccacgacgtctttatgtgtcgcattgagctgcgaagaaaaagcaatctcttgtaaaagcttctcgaagtcctcctcaggatgctcctcatcctcgatcatttctttaatctttgttttaacattttccgttttaccttgatattgtggcaactgctccaccacttctgaaaatgcttcaaagtcctcttcgtattgatcatagcttcggaacgctttataactcttttctagcttttgataagcactcacttgcgcaatcatcgttttaagatcgtggggattatccgataggtcagcttcgctttgtttataaagtgttgaacattcgataaattcttttttgacttcttcatattctcttggaatcagttgatcaaagttttgattttcatttgagaatagacgaaacgtgttttgcacattctctttcatggtgaagggttttctaaaagagacaatcaaaccagaatcttttcctgtataaatacggttggttcttgagaacgcttgaaggagcttttgatagttcatttctcgatcaatatatagggtttgaatcgttggagaatcaaagcctgtcaataaacgatcgacaacaataacaaaatctagccactgaccatccgattgatattgcttttccttacgggccaaccgtttattaatattttgattgtagagtttctcatcttgataaggagaagcatcaaactgtttcgcatactctttcatgatctctactaattcatcgtcttgttcatttttttctaattgatccggattggttgagaaggtaatagctactcttgggaaatctttatcaatcagttgatgacgttcatcaaattgtcgcccattcaagagtgtcccattatctttcatttcctttaaaatccggtaaatatgtttggcttgagcaatcgagtgagtggtaagaatggctgacatcgtaggaaaaccattctttaccttgaactttttgaccacactcctccgattaaagattttttgtaacatggtacgaatatgttcatctttttcataaagttccgtaggcaataatttttcttgttggagggcatcgtctggcaactttcctttattgagttgggtgacaatcacctcttgatcctcttctgaaatcagtgaatgatactcgacttgaaagcctaacacagccccatcatccatggcatttttggttgtataggagtgaaggagtggcccgtattgctggctcgtcgttctggcaaaggttccattttcttgctttttatttgcttcaaaaataggcgtccccgttaatccaaaccaggttgaattgggtaatattttcttaattcgtttcatttcctcatcactaaccgcacgatgagcctcatcaacaataaaaacaatatgttcttgccgtagcttctcaaattgattcgagcctttttcttcactctcttgttgggcacttcgcatagccgcagagagtttttgaatcgtggtcactaaaatcgtattattattttttgatgataggaggtttcgagccaactgtttttgatttttgatcccaacaatcaaagtattggctaccgaatttccggtcgtttgtccggtatggtattccgaggcaaacttcgtaaactcatcctgcgtttgagcatctaagtctgttctatcaacaaccatgaccgtacgatcgacaccgatcgcattttgtgctaataatttcgttgcgacaaaactggtaatggtctttcctgaacctgtcgcatgccaaatgaatcctccttcatgctgtgccgctttttgacgaatcttacgaatagcatgaatttggtaaggccttaaagccatgaggaatttttgatttttttgatcatcgacgagaatggtatattggctaatcaattcatgggcatcgggtatccgcaaaactgtacgagtaaaatcaaacaaatcggaaaccgtttgattgtcttcagtccgccaattaaataaaaacttcttcatccgagcataggcttcagcggtatcttcactaggtcttgcaaagtatcgggtatcgactttattggaaatcaccatgatttgagtggttgcgtaaatccctttaaaaaatccatcttctgcataacgctgaatttgataataagcttgcatgaaaccgtctttagcggactcttttttgagctcaatatgaatgattgggagcccattaatcagcaagctcacatctccacgatctactctagaggaatctgggaccacttggtgaactacctcataagaagaagttcctcctgagatatccttatttctaaaggcttctaaagtcacttttttcccatcttctcgctctaataaaacttgagccaccccgttttctcctctaagccattgagaagctaaaaaaggtgttccggtcaaacgtgaaaactcgactttgacttgcttaaattctttgtccgttaatagttgctcttccaatactgctaaatttattcggttcaaatggcctctaaagttttgccaaagtgcttcttccgacttcaagtccggacgataagtccactgattttctttctcacttaagatctgtatgaactggttttcaatcatttgttccgaatgactcatttgatccccctcatttccatagttgccaccattttttagattctgtttttaccggctctttttcttttgccttgtttcgttcttcttctgataacttcaattgagctttcagtcgttcaatttcttcctgcgcctcaccccttatcgacgagccatctttcatatcctcctgagccattttaagagctttcaattcattgatttctgatttatactcttctagtaattttttatcctgtaaggctagacgttgttgttggtctaagaggttttgagtttgttgaataattttttttaattccgaatttgatgtttgttctttatctaagaatttctctaaaacagaaattctttctttaaaataggatttttctttgtcttcttgcttatcttctagactgtctgctttgtcttcttgcttatcttctagactgtttgctttgtcttcttgcttatcttctagactgtctgctttgtcttcttgcttatcttctagactgtctgctttgtcttcttgcttatcttctagactgtctgctttatcttcttgcttatcttctagactgtctgctttgtcttcttgcttatcttctagactgtctgctttatcttcttgcttatcttctagactgtttaaccaactttttattaatgtttgttctttgtcagataatactattgtattttttccggatatttttttccaatttccgatagataaattttgtttctttttttcataactaattttgttttgtaaatactttttactaatacctaattcgtccgccagctcttttatcgtttttaattcttcactcatgataaatcctgccttttaactgttggtaagtactgctcaattgcttttttgagatacttcgctacattacgttttgaatagtcttcttgtttgctggcgacataagacaagtggtctttgactccattcaatcctcgtaagtctttcagttcgtcataaagagggtaaacatgggcttgtaagcctgccataagtgcggtgtccgtcatttcataagggcttaacagcatgttttctaataaaatttgagtatatttactcttcatagcttcaaacacaaggtctttttcggtctcttctttttgttttttgtcctcaatataggcttggtcgtccaacttgtagctgttatcatctgcggttcgtttcttctcaatatgaaagactatgctatcaatcgaacgcccttttttaatcttgtcataagtcacgttaaaatgcgtgtgagcgttaatttcttcgattggtttttttaatatccatgtttcaaaattatcaaatcttgggtagtcttttacagtatcagtgattactcgcaattctttgacggtgattgaggggttgcggtaggattccacttgctccgctcgccgtccgcttttggcactgtaatgctcgtactggttgtaattcatcgacaaccatttataaagaataatgctgtacttactgtttaaatctataaggtcagataaggcatattgcgtgaaattctgctttaactcaatcagataaggcataatatcttgattaaaccgtatcatgaccttatcgtcatagtccgtccattcaactgttggaatgggtagtatccgtctgaatttaaagcctttattttttgcttctctgacttcaaaaaatgcttgttcttgcatttttgaaatggcttctttaaaacgactatgtttcccattatccgatacatcaaaaaaagtaaacaattcttctttagacaaataaatggtgttgtctttaggtagattttcagtatcaatacaagacacggctaactcaaaaatctttaagggtgttttatccattttagcaacacttgtgattaagtcgttgtgttcaacaattttccgtttctcaatttctttcaaagaacacactgtcctttcattgctgttacgttcgttttttgatataatttccatgagaagttgctccttatgagtaattttggtctagcatagagaagaaactttagcgagattttctctatgcttttattatatcattatatgcctagtaatacaattacctttctaggtataagcattgttttttctaggtataagcattgttttttctaggtataagcattgttttttctaggtattaaaatctgtacacccttgaaaacactgacttttttttcacgcaaaagaacaaaagattaaaatatataagataaataataataggcttcgccttttttcactccgtttaaaaatcttaaaattaaggtcaaaagaaaaggtcaaaatcaaaagcgttcagcaaaacaacatagaccaatcctaaaagctcctattctgctttctaagcaactttacttgtcattgagtacaaaacatcaaacaaacacctatctttctaaataccctaactgaaaggcttgtcaacggtttgtgttggcaagtcttttggttgggcttcgttggtctgcttgacgacagaagcagttcgcttgtcaaagcgaaagttcgtttttaaagtgctaaaggattctacaatagccctagaagctcatattttgcattttaagcaacattagaacgttgctagtataaatttaccgcttaatagtttaacgctgtttataaggctttattttgcttatttacaaacgtggggaatgttgacttttatttttggtgtgttcttgctggtaatcttcgtaacggtcaacggacttgtcatagtaaagcatttctttttcgacttgttttaaggtcttgtgtaaatctgttcgttccttttgtaggttttcaattgtttttaatattcttgtgtttggtcgtgcataggctttattttcttcgacatactcaagaattttcttatctaggttttctaaaatgctttctgtttggtaataggtttgttctaattcttttccgatagcttcaaaagaagtatcaaaatctaatcctttagaaataagaaaatcaaactcattaaacagttgttttaacttgattttggcattgtttggaacgtttatattttgccctgatactaattctccaccttttgttttttctggattgacaatataattcagcgctcgtgagagttgccctttactatgaattactccacttgtatctctaggcatataaattacggtcatggcattatccctccgctattttttttagcatgctttttaattttttatctaaactttgaatttcattttggtactcattgagtaattctcttgtttgattttgttcggattcatttaagtgtttggcaatttgattgagattatttccaatccgattgacttctaaatttgcctgcgcaatggtagacataatttctttaagagaagaaaaatccaccgtgtaaatttttttatctaagcaagattttcttgcgtaagtagaaaaattttgtaggtttgcttccctcatatttttctcaataattttattttctagctcagaaacaaaaaactttttttgaatgttccgttgtctgtttgcttttttatccatatcaaaacctccgcaaatctaagaatagtaattcgattataaagtattgtagtgaacttactatgtgtgtacacacatagggtaaaaagtaatcatcttccactcggtcacacctaaaatttacattttagtttgttcctcgtttcagacgattatttttatttttggggcgttgccccaatccccattttttagaaatagctaggataattttcaacatctccgtacaagctttcaaccgtaaaacacaattcttcgacttcattttctggaattttttcaacgactttttttgcttttttgtagtcgtttaattcgtcttcgtcaattagttcggatagttcttcaattaatttatcaaacataattaataacttttctttaacaactggaaattcatttgcgtaggaaatagcttcaaaaatttgtcgtccattgaccagaaacacactatttaaggtacctttctcttttcgctgagattcaccaacttcaattgcacaaaaaagcgtgagcacaaggctcacactttttctagttaactatcctaaaaattcgaaaacatctttacgatcatacaatttcaagattttttcaaataagatttgacctacgaaagcagctacgattggtacaacaaaccagctgattaatagtagaataatactcaaaccggcgtccaatgaagccaacggacctaccaaccctaccaaaccgaaaccagcagaagcaggagtccctgagactgagaataacgctactggaattgctgagatgatagcggtgaatagacatggcaccaagataattggtttcctaaacaagtttggcatcatcattttcatagcacccaatgcgacggccaaagtaacccctggtttgttgactttccaagaattaactaccaagacaactgttgttgcggcaacacccatagcggctgcaccagcagaaacaccgttcaattgaattgccataccaatggcaactgtagagatcggcgagataatcaagaaagcaaaggaacatgcaatcaagattgacatcaaaattggttgcaaagtagtaaaggtattaattaagtcaccgatagcggcagtaatcttggttacgtaaggatataaataatagccgattagaccagcgccgataccaacaacgattggtgttgcaacaattgccacggacccaaatttttcgccgatcaacaagatcatgccgacagcgattgatgcagtaatcatggtattgatgatgtctccggtaccagcaccgatataagtagctgtgtcaggattgaatttcacaacaccggagccaacgaaagctgcaccggcaactactaacatttgcattggtttgaagccaaactgcaccgcaatcaaagcgccaatcaatagtggagtagctagttggaaaataactgccatttgtgtgatcgttactgctaaggtattttcaccaaataatttcaaaattgctgccaataccgcgttaggaatcaaccctacgatgatccccgttgcggtacccgctaatactttatttaaaaatatttttggagttaatttttcttccattttctcgtcctctttctaatgattactatttcgctcctagaatttcttctttactatgaaccagttgcgttaagaaatcacagtaaggagttactacgccatattttttacctttacgagaaattgctccgttgatgtagtcaatctcggtcaaacggttattttttatcaagtcttggtgcatcgatgggaaatgcataccaatcgtagtcgggtcaaaacaagtttctacatgttcgattacttcgggaatgtctaagttgacgttttctttggcagcaacagctgcaaattcgttaacaatagtcactaccatgtcatgagcaggtttggttgcaccaagccccgcaatattgacgtctaaaatcgtgcataagccattcatcgtaccattgacacaagctttacgataaattgaataatgaatgttgtcggaatatttggcatttaaaccagacgcggacaaagtttccgccaattttttcgctgattcttcttggccaatacctagattttgcaattcaacagacccgctgccaaataatttagccttgccgggaccttctagaccagcagtccatatggtgttgccgataaagattttttccatcggtacgaatttttcgattacgtcttcatgaccgataccgtttaaaagacacaaaacttctgtgtgatcagcaattaatggtttaacatcctgcagcattttttccaactgcattgccttcgtgaataagataatcaaatcaaattgctcaccagtgggcacctcattctgattaacaattgggactttaacagtaatttcttcgccattataattagccttcaatccgttttctttgatggcattgatatgctcctgccatccgtcgattagcaaaacatcgttaccaccttgtttcaacatcagtccgaaccgggaacccatcgcgccggcccctgcaattgcaattttcataaataaaagtctccaaacttagtttataataagtgaacattttcacattcctcattatagagttttcattcggaaacttcaagtaggagagtgtaaaatattttgtgtaaatagaaaaaaggaagtcccttctgtagaatagagttaccacaacacattcacagaaaagaggacttccatatgaacgatttcactacagaaattctaaagactctaagatattctatcgggtatcaagtcatggctaaataatcaactagcaattcgggtttattaatatatctataaattgttgttctagaaactcctcaagaatccgcaatcgatttaattggtgttccactttctaccaatgtcttaagaagctttacgtctttattcctccattgatactattgtaccataacctgaaagcacttatataaatgaacatagaataaattacgggttaatgaacaagaaatgtaaatgatcgctaaataatcaactagcaattcgggtttttgtataagtttgggtaatgtttttagaaacctctgatttcagttgattcatctcactttcactcatttttgatgaaatataattgtgaccgcgtgttgtttgataatctaactggactgtttttggctctttattcatcagcgtcgtcgcattttctgaaaagttttctgggaaagtaatgaccatataatagtcacctttttttattccctcagaagctttgtccttggaaacgaaatgatagtctaaatcctttgattttttcatctcagtaatgacatcatcaccaagtttgaattttttaccgttcaattcagacgtcttgtccaaatttacaactgctaccggtaagtcatttagcttaccagaggggtcccacatcgaccccaagaaaatatagttgtaaattgctggtacaagcgccaatgcaataataacaataataaaaaatttgtgttttaaaatggcctgccattccttttttaacatcatttcccctttctttatggacacaacgtccaaaaactgttacaatatgtattataaactttttagaaaaattgacaattattattcattcgcttttggacacatttaaatttttgtctaattgaagcactctcattctaaaaagaacggaggcccctattatgtctaatgacaccagaaaagatcgaacaaaacttcaattacgagatgccatgattcaacttttaggagaaaaatcttttgatcaaatttcaaccacagaacttgtaaaactagctaaagtcagccgaagtagtttttatactcattatcaagataaatacgatatgattgaagcttatcaacgtcgactctttgaaacaatccaatatgtttttgaaaaaaacaatggtgaccttcatgcaaccatgctagaaacctttgaatttttaaaagggaatcaaatctatgctgccctactttcagaaaatagtagtaaagaaatccatcaatttatgctccaaaagctcaaagaacttatccaaagctcttttttcccacaatctaaacatctaaaattagggaaattaggagaaatttatgcaacaacttactatgccaatgccatttttggcacaactcaatcttggattcgtcgcaagcaaaaagaaaccccaactcaaatagcagatttacttatagaactcattaattaacaaaacgcctctctttaagagaagcgttttttaatattaataatcaaaaataaatagcacactaacagttgtcaattttatcttggtgttgaactcccaaaataatattatttaattgttcaacaagcttatcctcatcagatatttcttgttttgtagctaattttaaagccttacctgatctaaaaacggggatattttgttcacctactaaaattttttcgcgcgaatgtacatcatgactaattctggctgcatgtttgcgaacttcaaaagtaccaaaatttgaaatatgtacggttgccccttccgaaatatagtaagtaatcgcctcaacaaaagcattaattgctttagctgcattcacctttgaaagttccgtacgatctgctacataatcaattaactcctgttttgacgccatttattaattcctccttattatttttgtcctttatgttcttttactaatgataaggaagattaagccttaaaaataatctacctcctaaagtaagggtatgtttttcattttgctattaatcctgtaaagtttcataaaaaatcccagcttacgctaagattttctggttattttacaaccatcacattgcatggagcgtgatttacaacataagttgttgttgaacccactaacatccggtctaaaagtcctttaccgttcgagccaaccacaatcaaatctagttcaaattcttttgcaaaattaacgatttcttttttaggattacctgtaaaagcatgaacttcaaactcaacttctttattaattagttgctctacctcagcaatgatttctttagactctgtttctaaatcatctaaattaattgccagagcatagggagttccccgaagtcttgtctcatcttttacatgtaaaacaaataatgaagttttgtttcttttagcaatggcaactgcttcatgaatagcctctttagactggtcagaaccatcaactgcgactaaaatctttttatattcatctctcattgtaaacgcctcctttactatattttatgataaaagaataaagaagtccaactaaacactcaatatatttttagatgtcattctgcctcttaaaatctcattttttattaataattaaggctaaaaatatttattttgaaaatctaaatcactttttttgatattttgatttctttatgctacaatttgattggaatttcgttatgaacctaatggttccctttcgtcaacatataaagaaaggagaatgtactatgacattcactaacaaaaataaatttttccaatatacagtcactctagatacttctcataatatctttagagcatcgcttgcaaatgattcaagcatctatggtgccggagatacaattgaagaagctgtacaaaacttagaacaattagtttaaggagaaaaaaatgggcgagtatcccaagcactagagcatctacttgatttcgagggtaggtgcttttgttatgccctcaaaactataaataaaaaagctgcccttaagcaacttttaatatttctatctataaagatgatgattaatccacttctacttcttgagcctcttttttgtcgtttttccaaatagagaaaaattttccatataaagaggtcactaaataaaaggtgatggtcaataacattggcaaagaactagcagaatagccagccactaatgctgttgcccataagacaatcatgaccgcatcagataagagccataatgaatagctatcaccataaccttttactactaaaatagaggcagcagctccaatgataagagttagtgcatcccataaaggattcgtatctcctaattttgtataaataagtgtaattggccaccaaaggattagcatactgattattgtcagcacccagcctctaagtttcataaacttgacgccattttcaatccggtgcccccaagtcttccaagtaaaaattaatggaaggtcaatcagtaatacaaaaacaatctggtctaaaactgaggcatagtgtcctgcggtccagttgatgtaaatgtacccaaaagcacttatcaatcctaataaaccattaatcggcttcccaatcatcatgtagaccgtacatgctgaacccattaatgtagcaatcagcgtgataactgacagcgtggtaatcgttgacgttaaaaagaaggccaactgtactcctataataaacgcaagcataatgcttccggctgtattaattgattttagctcatctttgagccatatgagataatttttcattctcatccccaatctaagaacgtaaaaaaacgtccactaaaaattatatcacgaatgaaaaattgtacgacccttccaaatatctttttttaattttattcttctatcagtaaattttacttttcagaaatttcatcagtaaaaaaatatttattttttaatgtattaaatagcacaacagcaaaagatttcgtttcttttggattacaaaatatttcttgatttactttttattaacatttatgctattatagtcctgaaaggaagattttatgaatcaaacaagcactctattttcatttggtattgtcggaacactgatacttttagtatggtatgtactaatcattgtccaagctttcttaggctatggaacggcttaccggaaagcaaaaactaatggagataacggtctctcactttttggctggctaattgtttattgcagtcttgcctccctcgtcccttatttagggatacatctttggaaaaagaataaaaacattgacaaaaaataggagatttattttttactttaaaaatttttaagtagaaaaataaaatcaaaaaaaagagttgattatccatcaactcttttttttgatttatcccatctataataatgaatcatcttgatgagtccaacaacaacaaattcaattccgagcaataaccacaatgttacggcgccccaaagtggagagaaaactagggtaaaaccagcaataatactgataatactcaaaataattccccagaatttactattaaaatctctcaaaacagtaagagtgacgattccatcaataatccaactcactcccacaaatattccgataagaacaaatagggattctgctgctgcatttaaatcagaaaagacgaaaattcctgcaaaaagataaatgaagcctagtaataaatgagaaattctccaaaaactgcctttattatcgctttttctaataagattcgctccaatataaatgacacccattatcacaagggcaacacccaccagtgcagccacaattgctgctgtctttgtaggtagaaaaagaattaataagccaataataattgaaacgattccactaaaaccaactccacgacgaagtttttcaaaatcagttaacataagtttacctcctaaagtattctaatgattctcatttaattataacataatgaatagatttcctttgctgcgttgattaaaaaattacaatcaatttcttgaatccactccttctgtcaatactgttactttttataaaataaaatatgatttatatctaatcaaatatttagaaatttaaaaagaggagtagttaaactcctctgcttcttttaatttatcaactaaaattacttatcttttttattagtcacttttattcctttgcgttcaggacttttccaagttccagagtctaaaccaagtatcgtttttactgctggaataaaagttgtcacaattgttaaagcattcatcatccaatagaaaagcatgtatagcggagcaaaaagtaaatatttaacctttcggccacgatcatcaacgattaaagaagcaattaattgaaaagttccagaaatcatttcaaaacaaacaaaaagaaaagccattgtcagcatgtgatatattcgttctagatttccacccaaagcaaaataaaccatagagtagataaatagtgctgatgaaatccaaaaaaataaggaccaaataatacttaaagtttggtcaataaacataatagtccttccgatattgtcaaaaggatgcaagaaaacttttctaaaatttgtcaaccatacttctatcccacccttagcccaacgttttctttggcgatatagcatttttaaggattcaggaacttccatgaaaaacataatttgaggagcaaaaagtgataaccaaccatccatttgatgatcccaagcaatactaatatcttcggttgctcggtcttgtctaaataaaccaacatcaaccagagcatctttacgatacatcgtatttgccccactataggcataaatacttcccaagacaccaagttgagtgcgcttaataattcctacaatactggagaactcaactgtctgtgatttcgctattaacttggcccgattttgaacatccatattagccgttacagctgaaatattggtagagtctgggcgaataaaataattgatataacgattgagagaatcaggttctggaaccgtatcagcgtcattactcagaatcaattttccttttgcaaaggccaatccaatattaaaagcatgtgcttttcctttatttttttcaatacgaaccactcgtaattttgcatatttttcctgtaagttttttaaaatttctggcgtacgatctgttgacccgtcgtcagtaaccaaaacttcatagttttcataattaattttcgtcattaaataattgattgtatcttcaatgacaacttcttcattatgggctgggaccataatcgtgacaaaaggctcaacttctactggaatttcatcccatgatttttgcttatatttaaacaaaaaactataacacaaaacaccaatgaaccaagcaaaaccacccaagataggataggtgaccaatattaaaaacattattgtcaaaataagatcaacaataccattacctgtttgaaaaaagctaatcattcttttctccttcctgataaagttttttgacaaaatctgtttctaaattctgctcctctttgactgaataaaaacaaaccttatgccgaaattcttccgaaccaaagcgctcatcataagctttatttaataattcacgccgtttatttagtcgttcatcatcatattgtttttccttttgcaaaaagtgtttaaaacgatagttattccaaaaggtcaaaagaatatataaaattgtcagaaaaacaaaagatacggaaagaaaaataagcagaaaaagcaatgtcgttttttcttccaaataaacgacaatatgattgtactgcgctcgattaggaaagacaaatggaaaaagaatccacaaaaatggaataagcactccaaaccaactcagaatagccaccaatgtttgaaatattttactcccataattccctttttcaaaatacgggtcataaactaaagattttttcgcctcttcacggctcaagttttgtttcatttccgacctttctgaacttttcaatcttttgtagtcaatacaatacattttctttaattatctcattttttgttcacaaaagccattttatgagtctattttttattacaaaaaaacagtcagacactctatcaaactgctttatatttattatttataatgataacagtcgattctccttttttatcaacttttgctttatgctataatttacagataagaacgatctacctaaaaaggttaaaggagtattatgataaaaattttaaaaatgactcaagacggctttgaccattatatgttgtccgctattaaaaattatgctaatgagaaagtaaataatggaacatgggagtctaaagatgccctttcaaattcaaagaaacagtatgcactcctgcttcccgacgggcttcaaactgctaatcattatttttactcaatttttaataaagaagaaaaaatcggatatatctggctggccaaagatgatgaaaataagcagagcacattcatctatgattttgaaatttatgaagaatttcaaaatctaggatttggctcaaaaacccttgatttagttgccgataaagcaaaagaacttggattctcttttttgggactccacgtttttggaagtaattctagagctttgcatgtctataaaaaaatgggattccaaattaccgatatcaatatgcgaaaagaactatgaatatccactccatttttggttgccatttgttaacgctgtctcctctccctagtgctataataaaaatggccaaaaaaaaaaccattttattgactatatttgcaatttatttacacattatcttttcagaaccaaaatctggcccattttggaacagacttctactattttgttgtctagtaggagcttttttgttttgggcaacttgttttcttcgtaatttctgtcagtggctgatgattaaatgttttacttttcattgctctaatcagcttctcataggcaaatcaaataaagtctgatataatactcaatagcaaacatcggaggtagatagaatgcaaaacttagatttaatcgaaaatgaaatcaaaacagtaattgatacttgtgacaagttaatccatcaagaaaaatttgatgaattggttaacttttatactgaagatgccgttttagttattaaacctggcatgctcgcgaatggacgagaacaaattaaatcagcttttataaaaattgcatcttactttgataattctattaaacctcttgaaggaaaaatggtttatcttcttgctggtgataccgttcttgttttggctcaaacttttattgaagcaaaccaatcagcaactgctcagtctgaattttcaatggagagaagagcaacttatgtttttcgcaacatagatggaaaatggttatgtgcaattgataattcttatgggacaactcttattgacgaaaaataaaatagaaagctatacttacaacttcattgaggttgttttttactttaattattatttattttatctgtttattcttcctttttcatccctaggcatttttttacatcttacttcaattttaaatataatcagaaaacaaaaaaaccgctcaacagagcggttttcatggtgtatcttaacgacgacgttcagcgatacgagcttttttacctgtgagtgcacggaggtagtaaagtttcgcacgacgtactttaccgtgacggataacttcgattttttcaacacgtggagtgtgaactgggaagatacgttctacaccaacaccgtttgagattttacgaacagtgtaagtttcgttaattcctgagtttttacgagcgataacaacgccttcaaaaatctggatacgttcgcgagttccttcgacaacttttgcgtgaacacgtacagtgtcaccaggacggaagtcagggatatcagtgcgaagttgtgcagcgttgatagattcgataaggttcatttttttctcctcttgcccatcataagcagcttttagcaaattaagctcagcggatgaacagttttattagtatgcaaaaacatactaaataagtataacagattatcagaagtttgacaagtgcttatttttagctcataactctttatcttaatgctgtcagtaaccaatcttttcaatatcaacttctgactgattaatcatgtccacaactttatggataaggtacattctctcatcaagagcatgaatttgttctgcacaattctgaagttctccactgagttgttcgggaatttgtccgtcatatttataacggactttatgttctagagtggcccaaaaatccattgcggaagttcttaactggatttcaactcgacaagtttcttcaccaaaaaggtggcccaaagggacttcaacaatcatatgataagaccgataccctgtcttttttacatttcttaaataatctttttcactgacaaccgtataggcttcttggcttttaataatctcgacaatctcatagatattttttgcataagaacagataatcctaatccctgcaatatctgataggtgctcatcagcagcttctgctgtgactggcaagcctttctttttaagttttcctgcaatactctctggagatttcaaacgatgtttaatatgctcaataggattgattgcttcaaagttattataataggtgtttaaattggaaagctgagttctgacaacatccaatgcacattcatatctgacaagtttcttttttaatttttcaaactcttctggctcgaatcttgtttttaaataatctttttccattttactttaattcctatctaatctcctttcttcttcatcattttttattaataataaggcccgactaattgtattattttctgtcttaatcagataatggacatgagaatctcgtgattctaattctaatagatttgttgcttcttttaaattactaacttctcctgcttccaaacagccaatgatatagtttatactctttgtattcatatagtcattaggaagctcagcattaacaattatttcgctctttaagatttcttgaatttgctcaataatttctttttgtttctttaaatatttctttttataaaaacgtgcaatatgttttcttccacctggtaaataattatgttgccaaagccaagttaagcccaaacgtgatccgtaacccaaaagtaaagaaaggaaagtaatcgcagacattctaaaaaacaggtcaacaggtcctgttcctggtacaagattactaaaaaatactgtcttatctggcatgaaataaacaatcattccaattgaaaccaaaatatctaaaattgaagcttgacgcgcaatttgggctgatatttttttacgatagtcttctcttaagtcttctgaaccctttaaaagtccttctagattctctaatgtatcaaacagttctcgacaataatcaagaatcacattctccctcacttatttcttagatccttaaatcattactgactataattttaacattaatgtcttggttttgcaacactttaattttacataaaaaaacacccgtaggtgctttttaattatgagacgaaacattcaaacggttgagagcgcggtgtaatgcaacttctacgcgttttatttcatcagattttttctcagctttagcaacttcaagtgctttttcagctcgaatttttgcacgttcggcacgtgaaacatcaatatcacgattacgttcggcagaatctgcaacaattgttacgagactatctttaatttcgataattccaccattaacagcaatgtaatctacatgtgtctcatcatctggacgacgaactttaagttcatcaatttcaagtccagcaattgtcgaaatcatgtttggcaaaataccaatttcaccatttgtagtccgagcagtaatatagtttgcatggtgatcataaaccacaccagcaggggtaatcacttgaagtgtcatgacgttttcagacattcgatcctccaattttttctatgaaaatttaaattataaagcgtaaaaatactttaaaaaacaaaattacaagagttaatcaaacttttaaaaagttgaagcaacttttactgacagaattattgtcagtaaattttgcgattcaataatgtattttcactttgtcatttcataagaaatcgaattaataacccattgattttgcttttgcaagtacgtcttcaattggacctactccacggaaagcatcttcagggacttcgtcatatttaccttccaaaatttccttgaagtcatgaactgttttgtcaattggtacatatgaaccaggttgaccagtaaactgttcagcaacgtggaagttttgtgaaaggaagaattggatacgacgtgcacgtccaacgagaattttttcatcatctgacaattcatccataccaagaatggcaatgatatcttgcaattctttgtagcgttgaaggacacgttgaacttccattgcaacttcatagtgttcttcaccaacaatttcaggtgtaagcgcacgtgatgatgaagcaagtgggtcaacggctggatagatacccatttgtgtcaaacgacgttccaagttagtcgttgcgtccaagtgagcgaaggctgtagctggcgctgggtcagtatagtcatcggcagggacataaatcgcttggatagatgtaacagaacccttcttagtagaagtgatacgttcttgtaattgacccatttcagttgcaagagttggttggtaaccaacggcagaaggcatacgtcccaaaagggcagaaacttctgaaccggcttgagtgaaacggaagatgttatcgatgaaaagcaatacgtcttgaccttgaatatcacggaaatattccgcaattgttaaaccagtaagggcaacacgcatacgtgctccaggtggttcattcatttgaccaaagaccatggctgttttttcaataacgcctgattctttcatttcccagtaaaggtcattcccttcacgagtacgttccccaacacctgtaaatacagaaataccaccgtgttcttgggcaatattgtgaatcaattcttggataaggacggttttaccaacaccggcaccaccgaagagtccgactttcccacctttaagataaggggcaagtaaatcgacaactttaatccctgttacaagaacttcatttgcagttgacaattcgtcaaaagttggagctttcttgtggataggattacgttctgcatcagcagggaaatcttctccaccatcaataacgtcaccaaggacattaaaaacacgaccaagagtagattcaccaacaggaacgctgaccgctttacctgtatcaaggacttcaagtccacgagtcaatccatcagtagattccatagcgatcgtacgaactgcaccatcaccaagttccaaagcaacttcaagagtaatttttgtttttaaaccattgacatctttgtagacaatcaaggcattgttaatctcaggcagtttggcatcagaaccaaattccacgtcaacgacgggaccgataacctgagtaattttaccagaactcaatgtttttcctcctgtttttattttctgtctaacaacagaatttctattcatttttaagttcatcagtaaaaatttactgacaaacgtaattaaaattcaaagcctttactgacagaacatttattcctcaagttgataaaatgtaacattgagaataatgtttgacagtaattatagcgctgaagcacccgcaacaatttccgtaatttcttgcgtaattgaagcttgacgagcacggttatattgaatggttaaatcattaatgacagaatgtgcattatctgttgcagtacgcattgcggtcatacctgcagcatgttctgctgtttttgcatcaacaattgagccataaatcatactttcagcatattgcggcaacaactgatttaagattgtttcacgatctggttctaattcaaatgttacaagagatgctttttcgtcaccttttttatcaaaagaaataggtaacattttttccatccgtgcctcacttaccaatgaattcacatggtggttgtaacaaacatagagttcatcgaattcttctgcttgatattcttccacggcttctgtaacaattgcccgaacctcttcaaaggtcggttgatctgaaagtccgcgaagaacataagaaactttgacgttacgggctttgaaaaagtccgctcccgtaccaccaagggcaagtattgtatactcactctcatttgtgtggcgtttacgtatattacttataacagacttcaaaatatttgaattataaccgccaacaagcccacgatctgatgtgataacgagatagccagtttttttgacttcacgtttaatcatcatcggatttttggccggctcattatcgcttgaaactaagtcagtcgtaatcttacgtactttttcagcataagtctgaaaagctttagcgtaagattctgctttttgaagtttagcagcagaaaccatttgcatggcacctgtgatttgacttgttttctttgttgacgcaatcttagtttttatttcgttaagtgaagctcccattagttagcctccttattaataattcgttgtatttttgaatgctttaattgcttcgtcaagttttgcttcttctggcaaatctttagtgtccgtaattacgttcaagagatctgcataatttgcatcgaagaaatcgaacattttagtttcaaaatcaagaacatcatcaactggaacatcatcaagatgaccatgagtcaatgcatagagaatcaaaacttgtttttcaacagccaatggtttgtgcaatggttgtttcaaaacttcaacggtacgacgaccacgattcaatttttcttgagtcgcttcatcaaggtcagaaccaaattgtgtaaaggcttcaagttcacggaatgacgcaaggtcaagacgcaaagtaccagctactttcttcatggctttgatttgtgcggcaccaccaacacgtgatactgatgaaccagcatcaatggcaggacgtacacctgaatagaacaagtcattttcaaggaaaatttgaccgtcggtaatagagataacgtttgttgcaatataagctgaaatatcacctgcttgtgtttcaatgaatggcaaagccgtcattgatccaccaccaagatcatcagacaatttagcagcacgttccaaaagacgtgagtgcaagtagaaaacgtcacctgggtatgcttcacgacctggtggacgacggagcaagagagaaagttcacggtaagcgaccgcttgtttagataaatcatcataaacaaccaagacatgtttaccgttatacataaattcttcacccattgcagctccagcatagggagcgatgtataggagtggagaaggttgagaagctgacgcagttacgacgatagtataatccatcgcaccgagtttacggagcgtttcaacttgtgtacgaactgttgactctttttgtccaatcgcaacatagatacaaatcatatcttgacctttttggttcaagattgcatcaatagcgactgaagttttacctgtttgacggtctccgataattaattcacgttgtccacgtccaattggaacgagggcatcaatcgctttaagaccagtttgtaatggctcagagactgatttacgttgcataacaccaggagcttttgcttcaactggacgagttttacctgtattaagttctccaagtccatcaacgggttgtccaagtgggtttacaacacgtccgatgagttcttcaccaacttggatttccatgattttacctgtacgtttaacagtgtcaccttcacgaattgagaggaaatcaccaagtacgataataccaacgtctgtagcatccaagttttgcgccataccaagtacaccatttgaaaactcaacaagctcaccgctcatcgcattttcaaggccataggcacgcgcgataccatcaccaacataggtaacgacaccagtttcagcaacttcaaaatctggtgtgaaattttcaatttgttttttaatcagtgagctgatttcattagctttaattgccaaaaatatgctcccttctagaaatttttactagttcaaggctatttagctttaaactgcagttatactttttgagcatgaataagcaagttttaaaattacctttgcatgttttcaaaagtttaacagtttgagtttgaaaaattctccactaagtttttaacaaaggaagaaaatttttctatcctgattagaggatttcagcggcaattttagccaattgtgtttttaatgaggcgtcaataatttttccacgagagttcacaatgaatcctccgagaattttttcattgactgtattaattactgttacttcgtttaaatcaaattttgctttagccattgctttaaatttttcaatttgagcttctgacaatgcaatacttgaaacaacttcaacgtcagcaattttgaacatgtcatctgctgcatttttagtttcttcaagtatttctccgaggtcagctagacgtccattagaacgaatagtattcaggaaatttgacatcacttctgatgaagtttgaagcaaagtatcaatcaattcagatttagcagagaatgaataaacttcatttgctaaaaaagcacctaagttattttctttgaaaagctgaatcatttcgctaacttcagtaagaattgcttcaagttgccctttttcttgggcgacctcaagtaaagctttactgtatttttgtgaatttacttttgtcatcttattctcctaacttagcgagataagagtcgattaattcctgttgtgcagaagcatctaatgattgtccaatgagcttttcagcaatttgaactgagatgtccgcaacatcgcctttaactgtgttaagagcttctttgcgttcttgctcgatatcttcttgcgcacgtttcttcaagctagttgcttcttcatttgctgttgcaagtactttcgcacggttttgtgaggcagtatcatttgcaacttgaatgatgttagcagcttcttctttagaacctgcaagctctgcttgacgttgtttaaccaagtcagcggcttgtttgttgttcgcttctgctgcatcgatatcatcagatatttttttcgcacgacttgcaaaaacacttgtaattgcattccatgcaaagaggcgcaacaataccaataagataataaatgcaccagatacaacgatgatgttaccgagaacggtattcggagcagcttctaataataatgttgacaatttctactcctttcttaatgttctgctatgattttgtggctaatgtacaagtttgtcaaaaggacaaagacataagcttggagggctgaaatgaaaagtgaaaagccaatccatgcaacttctagaatccacgcaactggaagcatccacatggttgattgaatcataccggcaataagaccaagcatgatttcacccgcgaagatattcccataaagccgtaaaccaagtgaaagtgcatttgtaaattcttccaaaatgttcattggaagaagacctttcggatctttccagaaggcaaccttgaggtaacctttaaaaccgaatttttgtacacccagtgtatttgacattacaacaacaagaagtgcaagtgtcaaatcgactgttggatttgcagttggtgatttccaaagagaaacatcacctggcgtactaattttagttactagcccaatgcagttggcaataagaaggaaagaaaagagggtaaagttcatgagcgcaaagcgtggtgcttcatgagggccgacgttatctttggaaactccattgacaaaatcaacaacccactcaagaacattttgtttacctttgggcttgagctgcatattgcgactcgcccagaataccagaccgaaaacaatgaggacagtcacaaaagtcattactgtgattgttccatcaaatggaattggcccaatattaaaggtccatgttgattccatacctgttcttcctttctgtttttaaaattttttgttgagaaaaattttaatggaaaaggaatgccatagcaagggcgatgaagaatgtaccttcgacgaaggcgatacccatgaacattgaaccacgaagttttccttcaagttcaggttggcgtgcaacggcttggaggaagtttgaaacgataagtccatcaccgatagcggctccgagtgctgcaagaccgatagcaattgctccaagagcggcaagtgtaattgtcattatagacctctttctatattgcgatttcgcaaatttattttactaagaaattctactactattcgtagtttttgtcaaagacaagcatgagaatttcatcatttcttttgtttttgtctttgtaagcgtttgatagacaaactttttagtttttgtcttgaataaaatgggaatttttaatattaactcaatcgttcttcttgcttataatttatagggagccactgtaagacagactctatttttttagtccaataataccattcatgaacaccatctgaactctcataagtaacatcaaatccctttttcttcaactctgctgttgcgtactcatttcctgggaaaagaaaatcttgttttccacaccaagcgtaaagttttggtcgttcctcattcttacgatcagctaaggccaaaatttcattatctgaacccttaaaagtctcccaatttccaaaaatcccgccccaataagctgggttttctttgaaattctcttccattccatcgaatgtcagaactcctgacaaacttgcggcatagctaaagtgatctgtacctagagcaagacggtaagcaccatatccacccatagataaaccagcaataaagttcttttctttttttgtagataaatttgggaaaaaattgtgaattacttttggaagttccaaggcaatcgcatcaaaataattcataccataagtggtattcacgtaaaaacctaaatctgtcgagggcattacaatcgccaaatttgtatgtcgaattaatctttcaattccagaacgaatcatccacgaattttcgttcccactcattccgtgcaaaaggtaaagaacgggtatctctgtgtttgaaaaatcttccaccttacttgactcagggtaaataacattgacttttcgaatcatcccaagaacttctgagtagtattcgatattgattactgccataaaaagtctccttaataaattttatgttgttagcaaatgttgttaactttctacctattataagttcaatttcttgaattctgttaaattaaaaattcctttctttttaaatctgaccttcgttttcttttttcaaagtctgcactatgacttttcctttcattttgtttttaataataaaaaaacgaaatgaaagaagtacttttttagtttccacaggcactcaacgtcttctttattgtaacattttatagatgtcttttgctctcttttttcctttcatttatctaactgttttgatttgccattgctgatttacttctgttaattttatcgcccctttttggtcagttctgagtgtctttacctgatttttggctaaggtttctaaagtttcttgattgggatgaccatagcgattagcttttccaaccgagattagtgcaagtttaggatgtatctctttgatgaattctggacttgaactcgttttactgccatgatgccccacttttaacacatctacctgtaatttgggataattttgtagaagctttttttctccttcttgttccaaatctcctgtaaaaactcttcggcttttcggtgtctactgaaatcaagggattaatgggaataccagcctaagatatttggagttcagaaagggcgcgtttgattttcaaacttcgcaacagaacccttacattcttggactgtatcctctatcgtttttatgctttttcttcttcaatttatgagcgggacgttcaggttcgctttcccctcgtaaaatcgtaaagagtagatttgttcctagtcctttgagcagattgaaattatttgtattgttgcggtagtagtttttttcttccacatttttttctttgttaagttcatctttgacattcgtatagtttttatcaaacacagcttttaatgtttgcttgcctgctttactaaaatctttcgtttggacacattcattgaaaaacataactttcatgcttggattttcaaagaactgtttttctacttctgataagtgagtgtgaccttcttctaataaacctgtaagcaagcattcttttgttgcggtatcgtacttcataggttttctatcattcaaaacatcaatcactactttttcttcgagttggtcgccaaaatagagaatagcattgcacaattgctctttttgtagttcattcaattgcttgctgtcaatcattggcaagtgttcttttatcgttgtttcatggtagtaatgaacggcttttattgccattttgtagcgagcaaggggttggataatgccttggaaagcttttttaacttcgtcggattgacgagcaacactttctttattctctaactgaatatcgtgtttagcacagaatgttttaagaatagcttcttgtttattcagtttttctttcatcacacgaacactgatatacgggtcttttaaaagcaaggatagattgtgtgacaattcctgttgttggcttttaagtaaaatttgttccgtttcttttaagtcaaaaagctgttcattatgaatggttttatcaactaattctcttgccatataaggactaagtgcgtttgtattgacttttggatagtgagcagaaataaaccgttgggcttctttatttaaaagaatttctgcttgttcaaccgcttctttttggtctttaattttacttaaaatcggttcttgttcttgcccattcgtcatcgcttgtttagctagtgcagagtttttccagttgtttaacatacgctttttatcttccaatttctcaaaggaaataaagacgttaagttctttagaaaggtcagataaaatacgtttttctttgggcgtaaaatgacgagtaaatggatttgtttggttcttttctttggtttctttttctaattgttcttgtttgtataagagttgattatactttttaatttctctattgatgtccccgttttcactaggcaatccttttaattcaagttgatgggcatagcttccaaggtgttttgttgggagttctttctttccttgttctttaaaacttttatccgttacggttatgtttaatccttttttttctaaagagttattaatcgcaactgcccaattttcacgccattgttttaagcgttctttactatcccaatccgttgttttttctgtggagcattgataagttttcttttctttatcgtaaattttattgccttgttcatcatagtgataaacttttttttgacgagttccccaatccccgttttctttaaatgggcggtttgttgtcataatatgagcatgaggattaccgtctttatctctatgaatggcaatatcagccaccatgccatgattgacaaaattttcttgacaataatttaaaaggagttcttcttgttcttcttcgttcaattcagaaggcaacgctaaaataaaatctcttgctagttgagcattttttgatttttcgattttttctacttcgttccataatttctgacgatttaacgtccagtcaggtgcattgcttggttttaaaataaaagttttaggagcaacacttcgaccatagaaattaaatttattatagcgttcactgtataatttttccccactacgataagaggcgctagcaattgcagactgtcctttccctcttgaaataactttagcttcaaaatgataaatagccataagaagtgttctcctttcttttttattttttacacgagcaaagcgagttttttcaacacgttcaatctgaaagattggcaatttataccatgatttttcatggtatataagtgcgcccttatatcttatagggatattctaccactttttattagtattttgtacttatctgtcttttgccttattttttggatttgatagaatataattatcaataagtgtttcaaataagaaaggactaggaagttatggcaaagaaaaaaagcttggaagatttacaaaaagaattagcaaagaaacaagaagacattaaaattatcaatagaaaaattggacaacaaaaacgatacattaatactcgtattggagaagaactcttaaaaggtttagaaatttctatttctgattttgattcagaagataagattaaaaaatttgtttctttagtcatttcaaattcaaaaaatgctgttcatcaacaatttaaaaatacacatttagaaaatgaaaataaacctttgaatgagtaatagttatgactattaaaaataaaaaagagttatcttcctcgattgaacagttagaaaaggcaatcaatcatcaagaaacaattttaaaaaaatttgataatgaacaacttgattttgaacaaattaagaaattagaaaatttgttaattcaagaaagagaaaaagcaaaacaagttcaaataaaaattaatcgttctgttttacagaataattctgaaaactataaagaacgaaaaaaacggacacggcaattaattcaaaaaggcgctttacttgaaaaatatcttgaagcaaaacatttaactgttgatgaaacagaacagcttttacaaatatttgcaaatatgataaataaacaaaaacctgataagtataaaaaaaagtttagagattattctaaactttttttatttcattatccataatttttttgccacaccttgggcaatagacaccaccatattgttttgctttttttacttttaaacgagaaatttctaaaatatactcacaatctttacataaaaatttttgtttgatactgattattttgttcatttaattttcaaattttgattttttatttttggttttttgctcgttatgctttattaaacacttttcaaatgtgataaaatttattgattttccttgtttttccatatctttattaaagcgtattaatatgtttttctctatccctagcatttcagctgtcttttcaatttgagtttgagtaaaattttctttaatttctaaaggattgtacactgtatcttctttttgtctaatatcaacaattgtttgattagtcattttatctttcattttaaacttctcattacaaattcctgccttttaaccgtaggtagatattgctcgattgcttttttcagatacttcgctacatttcgtttagaataggcttcttgtttgctagatacataaaacaagtggtctttgaccccattcaatcctcttaattcctttaactcgtcataaaggggatagacgttcttttgcaaacctgccataagtgccgtgtccgtcatttcaagagggaataagagaaaattttcaatcaataatcgtgtgtacttactttccattgcctgttttaataagtcagcttcatttcttgatttttcctctttgtcggattgataatctttatcttctaacttatagctgttatcgtctgctcggcgtttcttttcaatatgaaactgtatgctgtcaatcgaacgccctgctttgattttgtcatagaacacattaaaatgcgtatgggcattgatttcttctaaaggttcttttaaaactcgtctattgaagtctgtaaaattcttatattcgttcattgtgtcagtaagtatacgtaactcactaactttaattgacggattgcggtaactttccacttgctccgttctccgcccccctttgacactgtaatgctcgtactggttgtaattcattgataaccatttataaagaataatgctgtacttactgtttaactccatgacatcagataaggcatattgcgtaaaattctttttcaaatcaatcaagtaaggcataatttgcggttgaaattgtaaagtaaccatatcattgtagctattccattccacataagggataggaacgatactttttacgttgtatcctttgcccttaacttctttaatttcaaaaaaagcttgtttttgcattttttcaatggcttctttaaaacgtgtatgtctcccattatctgatacatcaaaaaaagtaaacaattcagcctttgataaataaataatattgtctttgggtaagttttccgtatcaatacaagatactgccaactcaaaaatctttaaagggactttatccattttggcaacacttgtgatgaggtcgttatgctcaacaatttttcttttctctatttctttcaaagaacacactgtcctttcattgttgtttcgttcattttttgatataatttccatgagaagttgctccttatgagtaattttggttaagcatagagaaactgatttttccgtctgatttctctatgcttttattatatcacataccaagacatttttttataaattgtcttggtatacattgttttttgtcttggtatacattgttttttgtcttggtatacattgttttttgtcttggtataatttatataattggcggaaacattgactttttcaccacgtaaaagaacaaaagattaaaatatatatgataaatataaataggctaacgccttttttgataaccttttaaaatcttaaaatcaaggtcaaaatcaaaaccgctccgcaaggacggattgggtttagtctgtaaatttttactagccgtcataccattagctagtatgttctgcttgtcttgtttgttaagcgaacagtgccgactgttcggtcagggttgcaccctaacaacctaaaagcggtttgaaatagtcctaggaactcatatttacgcttctaagcgattttagagtgactttggtagaaataccagatacaaaagaaaaagccctcaaacagccttatttcgtcatctgcttgaaagctcgttgttgggtactaatactgattcctgtttttcgttcaatcattttataagttaagccttgctgttttaactcatacgccagttgcaactgctcctttgtatatttctttggtcgtccttctcgaaacttggggtcgtgggctttcgcaaagcgtttcccctcttgggtgcgttccagtatctaaggatgagctacttgagcaaagtgaagtagtcgtttcaacatcatcgattcaaaaaaataaaatcctcgataataagaagaatagagctaactttgttacttcctctcagcttattaaggaaaaaccatcaaattctaaagatgcatctggtgtaattgataattctgcttctcctctatcttatcgtaaagctaaggaagtggtatctcttagacaacctttaaaaaatcaaaaagtagaggcacaacctctattgataagtaattcttctgaaaagaaagcaagtgtttatacaaatttacatgatttttgggattatcagtgggatatgaaatatgtgacaaataatggagaaagctatgcgctctaccagccctcaaagaaaatttctgttggaattattgattccggaatcatggaagaacatcctgatttgtcaaatagtttaggaaattattttaaaaatcttgttcctaagggagggtttgataatgaagaacctgatgaaactggaaatccaagtgatattgtggacaaaatgggacacgggacggaagtcgcaggtcagattacagcaaatggtaatattttaggagtagcaccagggattactgtaaatatatacagagtatttggtgaaaatctttcgaaatcggaatgggtagctagagcaataataagagctgcggatgatgggaacaaggtcatcaatataagtgctggacagtatcttatacccgaattgctagtcttttttgcctgtgttccctaaagcagtattactttatcaagagaaaagtatttgtaaagtaatacctttttcttaacatcatccttgattataaatgctattactcttcgtttactacctacttaaattaataaactattcttctaactcttttaaactatcatctatttaagcctctttcataattcaaaggataacctatgaggtgctatcatgttcttaccaattaaataccaaaggcacaccttagcaagataaaagcattactttagtaatacttttatagttcacttttttcaattagcatatcaataattactgaccttgatttagcattaaatttttttactaattcatctagtttttctgaattacttttttttattgaaaaactagttttgatttttttctcccaacccaaatttgtgttattatcttccgaaatattttttactacttgataatcattattatcaaaggtcatatcttcaaacttgtttgccattttactctatcccctttgtttctatttggttgaatactttttttaatgatgcaatgaatttattttgtgtatgagtttgccctgtctcttctaaataatcaaatattccctttttaagaagcatacttgtattaatagcttctttttcaggtacaattccaattacatcatttatattttttaacgcttctaaaaattctttagatgaattagtattgtgtttaactctatttcctaaaaaatagatttttgcgctaacatatgatttaccactgacaggatcaacaacttcattttttaaagttgaaacgctttgtaataccttggtatgactttcgtatccaaaacgacttggttccattggtgatattaccttatccgcaactgccacaccatttttggttaataaattccatgcaggcggtaagtctaaaataatataatcatatttttgatttagttcttttgaattttttacaaaccacataaataacaataattctttattaggtttagttgccaagttatctgcgatttcttctaaattactagttgaaggaattacatcaatatttttttcaaccgtagtagcaatgattccaatttggggattgctgagaatttctgaaatattgtgtttatctttaaaattaaaatcttttgtctcaaatgtaccagttaaacttttttgtgaatccaaatcaattaataatgtacttttattattttcttgcaaatattttgcaaattggaaagccattgtagtctttcctacaccacctttaattgccataaaactaattacttgcataccttattctcctctttcaactactttagtattccataggtattacttaagtcatacctatatcttaacacttgcgtaagataaagtcaagaaaaaagtcatacctttacacgacctttttctttcttttgtgttaacttcttccttactctttcatttgctgtttactcaaccttgaattaagatattgttttgctgatatacttaaatactttacgatattctttttatcatttgaataatctaccatctttcttcgtacatagtccatatgcgtttctaaggcatcttctccgagttcttttacaagtttatcatacacaggataaacactctcagcaagctctaaaatcgtgtcctggtttgctatatcagttgcatacaacaaagaggaatttataagtttcatggtaaaaggatttgcaactgctactgcataattaacctgattttgagcttgattttgttcttcagttaattgtgcttgtacatcattacgtttatagttctcatctttccaatttgctttcttaactatatgaaactgtattgaatcgattgaacgtcctttttttatttttttatactcaacattaaaatgagtaaaagaatttatttctttaattgcatcttttatgactcttttttcaaaattatcaaatctactatagtcatcaacagtatctgttaattctcttaagtcactaattattatcctaggactcttgtaatcttccaattgtttcttcgttctattaggtttatattggtaatgctcaaattgattataagacatagagaaccatttatataaaataatactgtacttgctattcagttccataatatctgatatggcatattgcgtaaaattattttttaaatctatgagataaggcataatagcttgatcaaaacgtatcaaaactttatcattataatcattccactcaacataaggtataggtactatccgtttaaacttgaaccctctattctttttctcctttattctgaaaaaagcttgttcttgcattttttcaacagcttccttaaaacgacgatgtttatcattatcagaaacatcaaaaaaagtaaataattccttttttgacaagaatactatattatctttaggaggagcatcagtatctatacatgaaacagctagctcaaacatttttaatggtgtcttatccatttttgcaactgagctaattaaatcgttatgctctgccaccttccttgaacttatttcctgtatttgtttatttctttctcctgtgtctatcttttgcataatccactccttttatgatttaaataaataataacacgaaacacctacaaacacaaataacttgtaggactatacacagttttttgtaggactatacacagttttttgtaggactatgcacagttttttgtaggactataatcctgttaccccttgcaaacactagattttttttttcgcaaaagaacaaaagacaaaatatataatataaaataattaaaagggactctaaggagtcccaattttctttttttaaaatctctggtcaggtaattcgcttcacaggcggtcaatctggggctacagcacgaacttacactgtacactctggcgataatctttcatcaattgccagtcgtcttggaacaacagttcaaagtttagtttcaatgaatggcatctcaaatcctaacttgatttatgctggtcaaactttaaattattaaaaattaactcccgcttcggcgggtgttttttttttatagaaaatacataacctaaagacatctttttgtaatgtaaaagaaatcaataattaattgacaaacgatattaggattgatagaatgtacatgtggtatttagatacccgttaatattgtaattcattctttgagagtacacaccctgttgatagagggaagtccgaaatcaaagaatttttttattttataggagaaattaatgaataaaagagtcgctatattagttgatggtggtttttatcgaaaacagtcattcaaagttaaaggagaactttctccagaagcaagagcgactgagttgtatgaatattgctggaggcatttggctgaaggaaagaaaaaagaaaagcgatttgatgaattatatcgtattttttattatgactgttcacctatctcaaaaagagtatacgaccctttaaaaaaggagacaattgatttctctaaaagccatacaaaagagtggacagaagatttttttcaagaattatctaagaaaagaaaagtagcattaagatttggtgagttgagtgaaggtagcgtagggtattcttttactacggaagccacaaaaaaattgctaaataaatcaataactgtagatgaagtcaagagaagacatttaaaactatccgtacaacaaaaaggtgtggatatgcgtataggattagatattgcaagcctttcttttaagaagcaggttgataaaataattttgatagctggtgatagtgattttgttcctgcggcaaagttagctcgaagagaagggatagattttgtactagatcctttaggaaaccatatcaaatcttccttagcattgcatattgatggtttacgagtttgtgataatgactatgcagattattttaaaaaataactcttcgccctccggggcgtttttctttgttctcgttaagaagtttgctataattaaatttctaacactgataccccttaattgggggtctttttttgttaacaaacgttactgctttcattaagataaattagtataatattcttatcgtgaatgctattccaaatacaaatacaaataactaagtattttgggagagataaagcgtccttttccaaagcgagggcgttttttctttacaacggaaatggaaagttatataatgttcttattccgaaaaacttttttcataaagtttatcctaagcgtccctctcctaactggggcgctttttttgtgctataatatagtcgggatgtttgtgagatttcatcctatttctagagtcaagccattcttcggagtggctttttttgtttgttgtaaatttacaacaatactatcagaaacataatgatatgttgtaattttgttgtacgagttttttatttctatattttttagttgttttaaaaataggaaaaacggctatattaagccgtttttattttatattttttctattattgtttattatcgttcatgaagaataacaaggtttgcaattctttagttaaatcaatagattgaacaacaacatctgaagggactttcaagcgaataggtgcaaagttaagaaagcctttgattcctgctttaacaagggtatcaaccacttcctgagcgttttccttacgaacagatagaatggctgtttttatgtctgatttcttaacattcttctctaaatcagaaatattataaattggaatgccatcatctgtttgagttccaactagtggatttccagaaatatcgtaggcctgagtaattctcattttatttctgtcttgaaattgataatgaagaagcgcacgtccaaggtttccgactccaatcaatgcgatatgagtttcttgatcttgtccaaggagttctccaaagaaatcacgaagaacttttgtttcatatccgtagcctcgtcgtcctaattccccaaagagagaaaaatcacgacgaattgtggcagcatctaccccaattttttcagaaataagttgtgaatttgtgcgtgtcacattctcttcgactagacttttgaaaagtcgatagtattgtggcaacctttttgcagttgcttttggtaagcttttgcttggtttatggtcagtcattgttatacctcaaaaatgtaattcgtatttattaaaactaatcatgattagtttctttgtgataattttatcaaaaatttgtgaaattatcaaacaaaaggaatgaagaaaaggactaaaatgagtaaaaaataaaaattcttaaaaaaattaattttactcttttaattgtggcgctttcatggtagaatagatttatgaaaaatagatagggagaaaatatgattaaaatttatcttagtggttcatgctcgtcttgtagaaaagctaaaaaatggttgagaaaacggcatattgaatttgaagaaattaatttaactaaagacatcatggagaaagatgatttaatcaagattttgtccctcacagaaaatggtttggaagatgtcattgctacccgaggaaaaacttactctggtttaaaccataattttgatgaattgggcttagaggaggcttatagattgattcaagaaaatcctcgtcttctaaaacgtccattaatttttgatgagcaaagattattgattggtttcaatgaggacgggattagagcatttatcccacctgaagttcgtagagtagaattaagagaaagattaatcttaatttaataatatttttaaaaaacttatcaaatttgataggtttttttatgacactatttgagaaaactacaaaatatatcgtttaaatgctataatagaaggactgctttttctatgaaatataagaaaaaaatcagggataaaaaggtttaagatttaacgaagaggattaataataatgattttattgcaaggaaatggaatcgcacgaacttttggtggcgatgtcttatttgaaaacattagtttcagcctacaagaccattcaagaatagctttagttggacgaaacggtgctggtaaatcaactttgcttaaaattattgctggggttgaagaagcaagtcgtggaaccatttcaaaaacaaaagacttaagcatgaattatttggctcaggatactggcttaaattcgcaaaggacaattttttctgaaatgttgtctgtttttgaccagcttcgtcaaatggaaaagcaattgcgtcaaatggaactgcaaatgggagaacttggcgctgatgaattgacgcttttaatgaagcgctatgactcattgtcagaagaatttcgcatgaaaaacggctttacttatgaatctgaaattaagtcagttttaaatggttttcgttttgatgagtcaatgtgggaacgtgaaatttcaagtttatcaggtggacaaaaaacgcgcttagccctagcgaaaatgcttttagaaaaaccacagctgttgattttggacgaaccaactaaccacttggatattgaaactttggcttggcttgaaaattatcttaaaaattatgatggtagtttactaatagtcagccatgaccggtactttttggataaggtagtcaatgaagttttagagttatcaagaggcgagttgactcgtttttctggtaattactcacggtatgtcgaacagcgggatcaaaaacttctattagaacttaaaaactttgaaaagcaacaaaaagaaattgcaaaattagaagactatgttgccaaaaatctagtgcgtgcttcaacgaccaaaatggcacaatcgcgtcgcaaaaaattagaaaaaatggatcgactggatgcgccaacgagcgatgacaaatcggctcatgttactttcacgccagaaaaaacctcaggaaatgttgtcctgaccgtgtcagaggctacggtaggctattcagacaatcgtctatctggaccaatcaatattgatgaacgcaaaggggaatctttggctattgttgggccaaacggtgtgggtaaaacgaccttaatcaaatccattgtcggtcaaatcccttttttggctggccaagcaaaactgggtgctaatgttaccttgggatattatgatcaagaacaagggcgcttgacgacttcaaataccgttttggacgaattgtggaatgaacatcgcttgcttaatgaagtggaaattcgcaatatgttaggtgcctttctttttagcggtgatgatgtcaagaaaacagtgggaatgctctctggtggggaaaaagcacgtcttttactcgcaaaattagcaatgaatcatgataatttcttagtcttagatgaacctacgaaccatttggatattgactcacgggaagttttagaaaatgctttaattgattttcctggaacaatcttgtttgtttcccatgaccgttactttattaatcgtgtagcgacaaaagttttagaaatcgctccagagggaagtacagaatttttgggcgattacgactattatgttgagaaaaaagaagaacagttagcccagagtgatgaatcagacaatggggggcttgtagaaagtcttgctcaacaagattttacggctcagaaagaagcccaaaaaaatcgtcgaaaagtggagcgagaaattacttcttgtgaggaaaaactagcagagttagaaataaaaattgaaacacttatgcttcaaatgcaagaaaatacttctgattttgtgaaattaggtgaattacaagctgaaattgaccttcttaatgatgaaaaagacgagacagagatgactcttttagaagcaatggaagaattagaaagtttgtaagcataatagaatattgaggaaaagaatagtgtttctattctttttttctaggctaaaaaagaaatattgaaaaaactaagacttgcaaatctctcttaagtttgttaaactaataagcaatgtaacttttaaactagtccagagaggctagcaaggttgaaatcaggaaaaactaattttatttttactgacaggattttctgtcagtaaaaatgaacttgttttgatactttttacacttgctaagtctcttggtaagtgttttttattgctgacaactaccacgactgtgacgtttgtcattcatgctcgaatggtattctgtcagttcaatacgaccaaaggaagtcattgaatcggtagctaaatgaacaatcagctttgctgatagttctgtcagtaaactataaaggagaaatcatgtcaatatcaaaagccattgctgcagatttattagaaattaaggcggtcagtctttcaccaagccaaccttttacttgggcctcaggaattaaatcaccaatttatactgataatcgagtgacattagcctatccagaagttcgtagtcaaattgaaggagcttttgcggaattgattaaagcggaatttccagaagttgaagtgattgctgggactgcgacagccggtattccccatggagcgattattgctgactatctcaaattaccatttgcttatatccgtagtaaaccaaaagaccatggggctggtaatcaagttgaaggtcgtgtggctaaagggcaaaaaatggttgtagttgaagatttgatttccactggaggttctgtcttagaatcggtcgcggccgcagaacgtgaaggcgctgatgtccttggtgtggttgccattttcacctatgaattagaaaaagcgaacagtaaatttgctgagtctggagtgaaattggcgacactgacaaattattctgagttgattgaaattgctaaagaaacaggatatgtcaccaaagaagaactcgagttacttaaaaaattcaaagaaaatcaagaaacttggcaagcataatttactgatagaagttaaaaaatctttgtcagcgaagttgattgtttgctgataaagattaacttaggtacaaagctgtcagtttgatttaactcacagaaattattgaattggcagatgacagaacttgttagtaaaattgaaaggtgaaaatgactttattaatcaaaaatggtcgtctgattgaccctaaatcaaatcgtgatgaaattttagatgttttaattgaagagaataaaatagctaaaattggcacaaacttatcagaagaaaatactgaaatcattgacgcaagaggtctagtgattgctcctggattgattgacgttcatgttcattttcgtgaaccaggacagacccataaagaaacgattcatagtggcgcaaaatcagcagcggcaggtggttttacaacggttgtcatgatggccaatacgaaacctattttatctacgccaaaagtattgacagagactttagcaattgccaaaaaagaagcaattaagattaaagcagttgcatcaattacgcaagattttgatggggaaaacttgacagattttgctgaacttatcaaagcaggggcaattggtttttctgacgatggcattccgttgacagacgctggagtcttgcgcaaagccttacagaaagccaaactaacagatagtttgctttcgattcatgaagaagacccaaatctaatcgggacacttggagttaatgatggagaagtggctcataaatgtggcttcacaggagcgccaaccgtttcagaatatagtatgatggcgcgtgatgctatgattgcctatgaaacaggcgcacgcttgcacttacagcatctgtctgcaggagaatctgtcgaagtggttcgatttgctaaaaatttgggcgcgaaaattacagcagaagtgacaccacaacatttttcaattacagaacagatgatttttgagcaagggacaaatgcgaaactcaatcctccattgcgtagagatgcagatatcagtaaaattattgcgggcttaaaagatgggacaattgatgtgattgcgactgaccatgcccctcatactcatgaagaaaaaaatgtcagcattgataaagccccatcaggaatgattggcttagaaacttcattgcaacttggtttgacgaatttggttgccaaaggtcatttgactttactcgaattactgacaaaaatgaccctcaatccagctaaattatatgattttgatgcaggttaccttgcagaagctggtccggcagaccttgtgatatttgatgccgaaaagacctatcaagttggtgaaacttttgattccaaagtgaccaactcaccgtttatccatcaaaaagttcaaggacaagttaaatatacaatttgtgacggaaatatagtttatcaagcaaaataaaagcgctaagcgcttttattgttattttaatgaaaaaaagatgattgaagtgtgtagaattgaaatttggcttttaagacattttgaggttgtaaggctttcttatttcaactaaaatttctcattgtaaactttacacattgctttttaaagcagtaatggtaaggatagagagaaatgtagttttaaaattaaaaattcagaaataaatcgaatgtgttataattgtatcaaaaaaatgatataaggattattctatggataaaaaaataagcatttaaattatgaggatagacgaaaaattgaaaaattattcaattcaaacgtcacaatcacagagattgctaaagaaatctcacatagtcgtgttgccataacaaatgaagtaagacgtggtttgaaaaaaatgagaacttctaaaggtaagattgtggagcgttattatgcagaatatgctcaacaactttatgagtcaacacagagcaacaaagagaagaagcctcgattttcagagaccattaaaagtaaagtcaaagaaaaacatcaacaaggtgattccgacaaagtgattgttgtagatatccaagaagaatttggaacccttgcaccggctgaatcgacaatcagaagatggcttaaagcttttagagatggacaaatgtctactattgatagaagctactcacgtcttggtgatgaggcctatttcaatgatgaccttgataaagcgaccaagtattatgaaaaaggggttcaattaggcgatacttatgcaatgactgccttagctgatttttatcaaaatggaaaaatagttccacaagattggcgaaaatcctataatctttatgaaaaagctgccagcctaggcgatacaaaagctatgtatatgttaagtatctatttggataatggtttaggctgcgaagttgactcaaatcaagcaacttttaatttaattaaggctgcgaatgcaggtaattccactggaatggtgattttagcttccagccttgaacacgggagcaatctaataaaagacctccgtaaggcagtctattggtatcgcagagccgaagaagcaggaaacgtttatgccaaaaaatggttggaaaatcatcaagaagaggtcataaatcatcttcaagatgaagtaggattcacaaatgaagaatacctcagttacacctggtccaaagcccatgaagaatttggacatcttgataaagaaataacagacaaagaacttcaagatttgagagattcaggtgtcatttcagaaatttcctcacaaaagcctaaaaataagaaaaaggattcttaagaatcctttttttaagcatcaaaatttctcattaaaaatcttaaccaaagctaaaaatccagtaaagacaagggatgacagagaaatgtaaagtttgctaagagaaaaaaagagtttgaaattaaaaaagtaaagaattagaataaggacgtaaaataaaatatcataaatacccgaattgctagttgattatttaggataaagatacctataaataatttaaaaactgaaaacgtccaacatttttgacattttagaataaaaaatctgctttttaaccttgttcccaatcaaaaaatattacaattccttaaatattgcaagctaccaattatcgtaataaaaaaatctaaaagaccttaaaaaagcctttattatcgagattagatgcacttttaaattcaatttgacgatatttttattttgcactataatgagcaagctttgtttatttattactcattttttaattaaataaacagtaaaactaaaaatagaataggaaaggtgtaatgacagtgctagtattagctggaacaattggagcaggaaaaagctctttaactgagatgttggcggaggaattgaaaacacaggctttttatgagagtgttgacgataataaggttttgccattattctatgaaaaccctcaaaaatatgcctttttattgcaaatatactttttaaataagagatttgattcaatcaaaagagccttatctgataataataatgtattagaccgctcaatttatgaagatagtctgctttttcatttgaacgccgatttaggacgtgctgatgaaacagaggttgaagtttatgatgacttactcaaaaatatgttagaagaaatcgacagcttatcttttaaaaagaggcctgatttacttattcatgtcaaggtttcctttgataaaatgctagaaagaatcaaaaaaagaggacgacaatttgaacaattagaatatgacccaagtttatacgactattataaagaattaaatagccgatatgatacatggtttgaagctttcgatatttgccccaaaattcaaattgatggcgataaatatgattttgtagagaatgagcaatcaaaaatccaagttctgcaacaaatcaaagcaaaactaaaagaaattgaaggagaaaataattaatgaatgttactgtcttcttatcatcaagggatggaaaaaatccaatttataaagataccagtgaaaaattagggagattacttgcacaatcaggtcatacccttgtttatgggggctcaaaagaaggttgcatgggtatgggtttcagattctgttattcaaaataaagggcaagtgattgctgtctatcctgctggagtcctcccattagaacctcctcgtcaaaatgcctctaaactttatttaacaaatgacatggctgagcgtaaacgcaagttgatagatttaggcgaagcttttgttattttagctaaaggatttggaacattagaagaaagctttcaacttttaactgaaatgtccatcaatcaaactcgcgtgcgccctgttatttttgtaggtcaaaaattttatcaaccactttttgacctactgcgcctgcaacttaaggaagggatgatttctaaagaagtcattgatgccatttctctcgttgactctgccgaagaaacaatcgaattattaggagatttaaaacttgaacaagttgtttaataaaccagttaatgtttaccttgccgccccatttttcagtcagacacaaataaataaagttgaactattagaaaatgcactttcaaaaaataaaacagtagcaaacttttttagcccaatgagatgtcaacatcctgaatctttaccaaaagaagttgaagcttttaccccagaatgggccaaagcgacaatggaaaatgatgttaaagaagtcaataaagcagatatcatcgttgctatcgttgactttgataaacaagataccgattcgggtaccgcttgggaattaggatacgctattgctttagaaaaaccgacctacctcattcgctttgaagaaagtctagcaactaatattatgttgactgaaagaaacagagctttcttcacagatgtcaaacaaattgaagactataattttctagaatctccaaaaattccctatagtggaaaatatcaatagtaaaaaaataacaaataaatcgtccttcaattagatataaaatttgaaatttgacttgatttgtactatactataggcggatagaaaatatggaaagaagcgtaattatgaaacttattgtcacacttttctggtcgcttgctcttggtcaggttgtaggctatgttgctactgcccttgctggtgttccagatcctgaactttggacaactattatctcgcttatctttggtctctttgtatatcttttccaagctgttgctgtggaaaaagaagccaaagcaaactaaacaactgatgatttatcagttttgtgcggtataaacgcctaaactcaaaataaaaatccttattgctatagggatttttattttgtttcttgaggcttgcaaatttcttaaaataccttataatttaatatggacattgttatttaaaccgtcccttagaacctaaaagaaaggagagcgctcaagctttgaaaggtcgacccaaacccgcaattatactgattacttattctgtcaaattgaccaagattagattagcgctcttcttgcgccatctttttgatattagttctaacgacttgatccatttcacaaaataagaaatttgattttttaagcttgaaccatgctataaaatggctccaactccaattaataagaacaaagtcgtctgtctcgttaacggtcgtattcaccgtagatcaggaggagactttcttgagaatcttgaccctagccttcaaaccgtcattatgcgtgactatcctgaagcgactagtcatgacttcatttgtaatgaacatcaggttaaatttcggttagaggtcttagatacattgtttcaccttgaccttcaaaaaaacttcaccgtcaatgatttgcttaatgaagaattaactaaagcaaactttgaaattcacgacgttgaagaacagctccaaactcaagaaactattggtgaacgagtggctgacaaagtcaccgaattcgtcggttcgtgggcttttattatcacctatctcggtattttagtagtctggatgtttgtcaatgtgactggcctctttggcgttgaatgggataaatatcctttcattttactcaatcttttcctctcaatcactgctgctatgcaagcgccactgattatgatgagccaaaaccgcgccgcacaccatgaccgcttatctgccaaaaatgactttcaagttaatgttaagtcagaaaagggtgttgctgctttacatgaaaaacttgatcacttaatgatggatgatcaagcttcaaatatgcaaatccaaaaaatccaaactgaaatgcttggggatattcaaatccttctaaacgaagtttatcaacaaaaccaagatatccgtgaacgtttggatgatgttgaagaccaacttgatgattttgaagaaacctttgatagttttgaagaaactcttgatagtattgaagaaaatactgatgatgaggaagaagaaggcattgctaatgctgctaatgctgattaaaaaaagtctgttcgattgaacagactttttacttttaactaaaataatttattttttcctgaatttcaaccactgaattttttaatttgccttcttcttctaaagttagtggaagttttatcaatgcttctatcccatttttaccaatcaaggcaggtgtcgaaatatatgaactaaaattttcgtcataatgtgagcagatagcaatgttttttgcatcagaaagcaccagattcatcaaggaaaccgttgctgcggctatggctacgttggtatatccttttgtgttaaatacagcaaatcctccttgacgggctttttcttctaagtcttttaaatttaaatttttttctttagcaatctctaaaaaagattgaccaccaactctgaccgttgaccaagccgtaaattgtgaattaccatgttcccccaaaacataaccttcaacacttcgggcatcaatttccaacgctcgacttacttgagctttcatacgagccgtgtccagataagtccccgttccaataatctgtgatttaggaagatttaataattgagaataaatattaacaatcacatcgttcggattggttgttgcaatcaaaattcctttgaaattaatcctgtttaattgctcagaaacttctttaatttctggaatatttgcttttaattcagtgaatctatctccgcccggtttaattagttcgatatgacccagtgtagataagacaatatcggcagtcgctaaatcatcatattctcccacgtatattttgacatagaatggaagcaaagcaagggcatctaggaggtctaaaacctctgcctctgctttttttctatccttgtcaataattactagctcgtcagcgaatcccccctgaacgatatccaaagcaactgttgccccaacatgaccgcaaccaattaatcctacttttcgcattttttctcctttttcagctactttttatcataatattcttttaagaaagtagcaaattcttcaaaagttccattttctaaccaagttcggtgcaagaagaaaccctgaccttttgatatataaatgattataatgtccttatgatagccaattttatgaatgtaacttttatcaaaagtcgcttcgctaatatttgatttttgataaatatattcttcatctattataaactcttgaaatccctggactcccttattgcttttatataatctcactaaccaccaataataagcccaataaaaatgagtggcgcagcaatcccaaagaccaatccaactatagactgactataaatggcataaatttcaagaataacaaataccacgatagaagcaaaaaaaatatttttcatcacaaatttcatataaattttttgagttaatgtcccagagagtttgtatttcataatttttcacctttcaggcttttgcctttttcctgtagccccaatattttcatctaacatttcttgcgcgctctctttcgctttctcttcatcaaactccaaatcatctacccactgataataattttgaatattttccgaaagactgaaaagcataatccccaacatatcttgaaaatcatattctttgagcagttctatataatcgccacaagccatttttagaatagaaccatcacctttttcaggaaatacggaaaaatttgtcaacattttttctttccaagcaatttctccaaaaacaaattttccaccagaaatataaatcactattttttcaggaaattcataatttttatctaaccatacgaaataacgaaaaatttctttttttattaagcgatgaacggtaggtgtgaaacgaagaacaatatttttattgagcatcattttcgatattcctttccaaacgtatgctttttcacgtcccgatttgggttttttattagagcgtctttttatattttctatattttggaatgccggaccaaccccaacgatgaatacgattttctccgtgaggaaaacctcgatattccacatattcattagttaataaagtagcttttttatcagtttcatttccatgcaattctttgtcttccaaccattgatgataatgtatcagctcatgagaaatactgttcaaagtagaataaatcgcactatctttcccccatttttctaactcccagaaatcgcctgttgatattttcatatagcatgcctcttctttatcaaacggcgcccaaaaagttgagatcacatgctcttggtcaatacttctaataaaacttacacctgttacaataattcttagttctttaggtaatgagtgattgacttcaagccaagctacatacttttttatttccttagcaatgaaacgattgacagacgggcggatatcaagatttatatttccaattattttcatttccaatgttccttcgtaaaagctccaattcaagcgaatcaaccgtcaaatagttaagttgttcaaatcgttcattatctaagtaagatttttcgtcaagggattggataataaagcttgaccccatcacttcatcactgactggaaaaatatcgaacttatcattttgtgagtgacctgcaattaccagcgtttcttcctgattttcatcattttcatcaagaaagctaataagttgatgattgagcagatttaacgtgaaattctgccattttttcgtaagctcaaagacatcataattattgaccgagcgattgatatctatataatcttgcataatatccaaataagaattttcagctgtcataagctctattttttctttattaacaagttttaaactctcaaaacgtccccaagcatcaatcaattctacaagataaaaatctaaaaattcctgacgaatataacccacataaaattcgtcagcaaaaaaggctaagtctaatctgtaaagtttattttctaacatcatgattttatcattcgctttcctgtctgatgaccgcctgcatttgattaagcgcaagcgttacaccatcaatcatgtagacatctccatattctctctcgtacttttcatcaaatttgacaacatctgtgtcaatatcccaaatggtaaatgcttcatcaaaaacttctaaaattttaccttcgttatagttttccaaatccatcttacccttagcaagcagcatgacctttacaaaaacttctttttctttgatgaaattcaaaaacattttacaaatagtttcatctgtcaaatttttcaaatcaaaatctgtcagtaaactttcttgaccaaatgggtcataaaatcctagctttttagcatttttggcatattttttaattgctacaatataattatcttctgagattatttccaaattatcagttggcaaaatccgttgcagactaactcctccaaacattcctggaactgtaataaaactatacagtaaccacttcttactttgataataaatatgaccaatattgagatactcattatcatcatttgcaaaatttattatttgtatgttgttcataattgttcactttccataggtcctgtaacccaattttttactcaacaattccaactccaccgacaaaatctcgattgtgacgaaattttcaagaggtaaatctttttctataccatttacggttgaaaacaaaggtgtttcaacagctttgagcgttattgttttatcattgacctctattacttctgacaaatcccaaaactcttcatcgccatacaaagtattgacaagctgacctttaagttttgaaaaattaaacctctctacatcaaaattttgacgtaatttaagtgggtcataggcattcactttttcaagagaatttttatagaactcaatataatctaagtaatcatctttttttacaatcttagttattgcttcatcgttgattacggaaatacttaaaagtcgtccacgttcgtcagtcatctcgtaaagtcgaaaattatcatgtttcccgaggaaaacaccgacatcaaactgttcatttttctcatcatcttgtgtgaagatttcttcaaacatgtttttcatttcccctttcttagattatttttaggtttgtaggttggtttttgacgatttttatttttagtagaatcttgcctattttgatgcttattttgagtagactttctagcattgctagtatgttcactatttttattacccggattttttccatgacgtgccatcgcggcaatcatagccggagtggccttgatatctccgcctactttgtgtggaaaaagcaggtcataacctacggtcaatcctccacctatgagaagtgcagcaccagcgctagcgagagtacttgctcctcctaagcttcctattgcaacagctcctttggccgctgctccaccaatatctggccaattcatagtcgaggctatccttgtttgagaatcaatgacaatctttcctgacgcgtccacatgaaattggacttgcggattagggacaaagtttttctcaatgtattttgcaaattctgcttcggtataaaacttgttattaaattttacaccaccattaacatattcaatcgtagcactaggctttgccttagtaggagcggggagttggggcgggaacatctggtcaatcatgccacttaaggtgcctgattgtgactgttgtgaagtggttgatgtcttggtctgttcctgtgcggaagaagattgcgccgtttgtgagggagcatgtgcttgctctgttgaactttgactttgctctgtgcttgccgattgacttgatttgactgtacttgcttgttcagatgacgaacttgatgtctctgtttgcactgtttcatctgctttgacttttagattgccaaattctccagcataaggggcaagcaaaaagagcgttgacgttatcagaataattttccaatgaagctttttcatgtgattcctttcgttttaaagcgctttattgtttattaaaaattaaatgaatatcatatttctcaaagccagtactcaggacagtccattttattaattttgaaatagaatagtcaatatatcttgactgtacccattctctatatcatatcttcatttatttacactttattgagtggaatatctggacaaaggctataattggtttcttagtagtttttctcactacttcaatattcgttccagttctgcttaaaatatccctctaaccactcgctgtctttatcaatttcaatctcatgaaattcaaaacactcctcactcaaacttttaaaacctttaaggtttcgatatctttcaatagcatattttatttggtcaactgatgaataaactcctaaatgataaaaatcattatattcatattgttctccaaattcgtacaaaaagtctaaagcaaaaagattttaattctatggaatatttgaccataagaaaagacctccgaaatatagatttgaaaagtctatattttgggggtcactacaactcacggctttcttattattaagttctcattcaattaatcaactttaacaatttttactgtcatttcgccaaccggcagtgggacattaacgatatctccaacttttttaccaatcaaaacgcgagcaattggtgattcatttgaaattttacctgtaaatgggtctgcttcagcagtaccaacgatttgatatgattcttcgtcagtttctccgacttccacaaaagtaacatttttaccaagtgccacttcatctttagcaattttagcattgtcaacaatttcagcataacgaatcattgtttcaacagttgaaatacgtccttcaataaaggcttgttcatctttagctgcttcatattctgagttttctgaaaggtcaccatagctacgcgcaactttgatacggtcaataacttctggacgtttaacgagttttaaattttcaagttctgcttttaatttatcaagaccttctttggtcattgggaatgttttttccattttatttctttccttttattataaacttttctttttagttaaatcaaaatcaatcatactctatttacttaatttatcattcacatatttttgaacatttgcattttgttcttctaaggttttcgcaaaataaactttaccagttgttacatcagcaacaaagtaaagataatcattttgcgcaggattaagcaccgccttaattgatgacagactaggactatccacaggaccagggccaaatccagtattggcatacaagttataaggcgaatctaggttagtatcaatattagcatcttctgccaagcttgttttttcacctaatttaccttcagcatagagaattgataaattagaacccaaagtcattccttgattcatgcggttgtagaaagtagccgcaacatttcgacgatcatcgtcattattggcttctttttcaaccagcgcagctaaactcaaaacatcattaacagtcagatttttttgcgtcatcgtgtcgtagtaaggcgtgagttgagcattcatcgtttcaatcatattttcaatcacagactcaacagttgatgattttgtataatcataggttgcagggaataaatagccttctaactgatatttgatccctgaatcttttgtaggtaaacttgcaaaaagtttaggataagcttttaccatttttgcaataaaagtaggatcttgaacagtcttcataaagtcagcttctgagaatggcgttttagcatttttttcttgactgttactattgactgtaactgctttcgctatttgtgtcaatgtatagccttcaggaattaaaattttacccaaggtaggggaaacaggtttttcggttcccccttcttccagtttggaagcaatagtagataaactcatgtttggcgaaaggttataatagccactcttaaactctgagtaatttttaaattttgtgtaatactgaaatatcattccatttttaataatggactgtctttgcaaaatttcaccaatttgtttactacttgaccccgctggaatactgattgatttaactgttgtatttttagaatcaagaggttgaattccagattttacaaaattataaccataccagcctgttccaccaactaccaaaattaaaagaacaacaattacagtgataatttttcctgccgtaacttttttctttttcttatttttgtttttctttccagaaaaattcttcttagatggcgcagtcgttcttcttgcaggttggtgtttcaccattttttctgattctcttttttctgaaatattttcctgttcaatcggttcttcttgaactactgattcacttcttgaaaaaggaggtgggacagtttgttcttggttttcatcagaaactatttcttctaatttttgacgcagtgaacccgtttcttgagaagtgttttcttctacttgtgcttgaaaatcttcttcttcatctgcttctgggaatttgaaaactggaagcttgaacggttcaagttcaactttccgtggttcaatttttcgctcagaagttactggctcactccctttgggacgttcgaaatcttcagggtctgggaacttagtttctgcttgtttcgctgcattttcttcaagttgacgaagtattttttctttaaaacttcctcgagaaaattcagttgtttctttgtccaccaaatttgttctccttatgattagctctcgctcaataattaaatttttctttttataattgtaaccgttcttttaaacttttacaaataaaaagaaaatattcataaaagtgaggctgatgcctcacttttatgtgttttagtcttcatcagtatcgtctaaatcgtctaaatcgtcttccacttcgatgtcaacttcttcatctacattatcaagttctacctcagcaagttcagcatcataagcagctacgtcatctttatcctcatcttctgcttgagtatcataagacatatcttcttctgttgtttcttttgtgccttcttcatcttctgggtcgatttcgtcttcgataccaaaagcgttaacttttttgcgttttttagctggtttttcttcttcttcgtcttcaatttcgtcaagagcgatgacttcttcatcaatttcatcaatggcataccatgaacgaagcgcccaaacgttatttcctaatggaatgaaacttccgtctgtattgatttctgtataaaaacgagaaatactagctttaatttcatcatctgatttttccaaataatcttgaatcgctctgatgatttcagaaaattgcatttctttgccattttgctctagtaaagcatgggcaacttcaatcattgaaagttctgagattttttgtccttctaaggctgtaattttcaagtttttactctctcttttcctaatataatatgggctcgtttcctagaaagcgaacgcctctgtagattttctttttatagtgtatatcaaaattggcttgctgtcaatattttacaccaaaaaacctctgtcctcttgccattagctcgaatgtatcctttaacttttagtaaaggaatactgacagaaattattgggtgactggctgacagaaattaataatgcattaaaactttatagtcgtaatttccgattttttcgcgacctttaagctcgtcaagttcgataaggaaggcacaaccgacaacaactccacccattttttcaacaagttcaattgttgcagcaatggttccacctgttgcaagcaaatcatcaacaatcaagacgcgttgtcctggtttgatactatctgagtgcattgtaagtgtatctgtaccatactctttttcgtaagttgcttcaataacttcacgaggtaattttccaggtttacgaactggcgcaaaacctacaccaagtgcaaatgcgactgggcaaccaatgatgaagccacgtgcttcaggtcctacaaccatatcaatttctttatctctggcatactgaacaatttcggtagcagcatagttataggcattcccatctgccatcaaagggctgatgtcacgaaaaactacgccttctttaggatagttttcgatggttgcaatatagtcttttaattccatgtttttgttactgacagaattgtcagtgctcctttttctaacataagtccgttgtttttactgacagaattaacattaacagtctaattattttctgtcagtaaattttatataaaaacgaaattatttttctaataatttttgataaatttctttaactggcgctaaggcaaagagttcttgcatttttacaattttttctaattcttggtaaattgtactttcagaaatttcacgtttttgagccgctttattaacggtcattaggccattgtcaatgttgacaaattcaagttcttcaaagatttttatcatcttgacaagcaagagatgaggaatattcaaataatctgcaagagactcaagcttataacgaacatcaaattctggaaattgataaatcgccttatagagctttgcaaattgttcacgtgttccgcttcctgttaaataatagctatcagtgattttatttttaaaatagattattttaaaatcatccgatgctgctttactgacagcttcttctaatactgacaaacctgctaaatctacaggtgtctcttcgatgacaagcacatcttccattataccatgttttagctgattttgagaaaaaatattagcctctttggggatagaaatttgtctgctccgtatatcaaggagttccacacctattgagtcggcatcttcaatcatcagttgaagactggtgttcccattccaactattacttgaaagtgtcaccacaagtttagtttcggcttgttcaaattctagctcttctgagccatgttgaaaataaacggcatcaatttgttgcttttcttcttgaatttttaatttaagatgtgcattatctttgcccatgctacgactttgaatgactttataatcttctactaagaatcgcggtttgggattatccataccaaaaggggctaattttgctaaattattaatagtagcaagtgaaatttcagccaaatgacagcgatccgcaacttcaagtggactctttttagaaagatctaaatgattatccacaacaaaatcgctcattgcttttttaaccgcttcaacattttccagagctagagtcatacctgccgcctgtttatgccctccaaaggcaataaaaagttcgcggtgggcatttagtgctttaaaaatatcaaaactaccaattgagcgagcagatccgcgcaaaatcccctcttcttcggcgagcataattactggtttatggatttgttccagtaaacgcccagccacaattcctaaaacacccttatgccaatctttgtgatataaaatttggacagactcatctgtcaacattgctagagcttcattgtggattttttccacgatatcttttcgctcagaatttttttggtcaatcattttagcaatttcatgagcttcatcttcgtcccaacctgttaataactcaattgctggattagggtcatcaagccgtcctaaagcatttaaccgtggcgcgatttgaaaaccgacagtttcctcagtgaccttgtcaaagtcgacgccggcgtatttcattaattcttgcaaacccgcacgttctgtttgggcaagaactttaagaccatgagcgactaaaattcgattttcgtcagttaaactaaccatatcagcaatcgtcccaatggccaccaaatctagcatttcgcggggtgcatattctaagagggcacaggcgactttaaaagcaactccaacaccggccaaatatttaaaaggatattgactttctggatgctctggatgaataatagcataggcattaggcagttggtcaggcattgaatgatggtcagtaataatgacatccactccattttcttgagcccaagcgattgcctccacccctgctaccccattatccacagtgataataagattgatattttcattgttaatataatattgataaacatcaaggtttggaccataaccgtcagtaaatcgatttggtaagtaaacctgagcttcggcgcctaattcgtcaagagcagatttcatgacagaagcagctgtcattccatcagcatcataatccccataaatcagaatattttcgccttgttcaatagctgataaaattctttgtgttgctttttccatgtcgtgaagcaaaaatgggtcatgcaaatcttccaaattcggctttaaaaatttttcaatttcagattcatcatgaatccctctttgataaagcactcgacttgttaattcgtctaatttatgttttttgcttatttttagaaaatcttccgaaaggactgtctcgtccaatttccaatcatatttcgcttttatcattttcgttctctttatctttttctgtcttcaactcaattattttagcacaaattacttaaaagaaaaatggctgcaaagcaagataagttttagtcttctttatcgcaaatgactgctatttttttactgacagaagaatgaaccgcttctatcaaaaactgttagtagaatactatttaaaattaaaaaatcttgttgataaaaaatcaaccagtgagggaaaaagactgcgaagtttggcagctgtggataaagtccatggtaaatttagttctctttttcttttcccgaggttattcacaattttgtcagcaactttagcggcagaaatagcacttttccccactttattaagataatctccattatccttatgaaatttggtcagaactggaccagtattcacagtggtcacaatcaattgtggattttccatgcgcagggcatctgaaaaagtaattaatgctgctttactggcagcataaatacttgattttcttgtcggtaatttcccagcaatagaagcaatgttaatcagctgaagtcttggttttaactgtcttgtcagctgaatgggcatcaatgtattaatgacaaattgctcagtaatctcagagtctgtcagttcagtaaaatctttaaaaataccaaagccagcattattaattaaaatgtccacatcataagattgctcagcagttaaaagttcatcattggtcagtaaagtgacatttgctaactgcccatacaatttctctaaagccgtacgacttcgtgataccaaaatcaaatggtcatttgtcttagataataagctgacaatttcttttgcaatatcaccagttgcacctgtaattacaatatttttaaccaattttttcctcgtataaatctttggccacaaaagtattcgcgtgaacagcttgcgcttcacgaaccaattgccctaccaaaggaccaacataacgtgcactaatatgggtcaataacagacgattgacgcctgcttccttagcaacatcagccgcttgcttagtcgttgaatgcccatgagctctggccattttactttcactggcctcataagttgcctcatgcaccagtaaatctgcttgccaagccaaacgcaccgctgtctttgtttttcgcgtgtctcctaaaattgtcacgattttccctactttatcagctccgatatagtccttagggtcaaaggtttttccatcataggcgacgacttctccttttttaattttaccaaaaagaggtccaaaaggaagtccagcttcttttaaagcattggcatcaagctcacctacccgatttttctctactacgcgataacccaagcagaaaatggtatggtcaagcaaatccgtataaacttcaaaagaatcatcttcaaagatttttccggctgaatcaatctcatgaaaattaatccgataacctaaacgtgaacctgaaattctaagccccgttaaaacaaactctttaatccctacaggaccatagaggtccaaatcagtctgctcatctgagctttgaaaacttcggctagacaaaaaaccagggagaccaaaaatatggtcgccatgcaaatgagtaataaaaatctttgtaatttttcgaggtttaattgccgtatttaaaatttgatgttgactagcttcaccacaatcaaaaagccaaatttcattacgttcatcaagcatttttaaagcaatcgcttgagtatttcttgatttcgagggctgacctgccccagttcctaaaaattggatttccattgaccctccataacataagctttagaatcattagcttttaccgttattttctctaaactttgagaaatatttttcaaaaataagaaaaaattgtgagccatccccacaatcttttcttcaataaatttagtgacccgtgctgggctcgaaccagcgaccctttgattaaaagtcaaatgctctaccaactgagctaacgagtcatgcttaggcgtcattttcacaacgaaatatattataacacagactttcgcaaatttctagtctcaactgtaatttttctatttttttattcaaattcttgtctactaggccttttcccctgatttctaactaataaaattattattttcaaacaaaaaataaagcctgaccacatgtaaatttgaattctttggttgactcacgaatattcaaactacttaaaaagcttgttttgtcttatctctccccttctttctatagaaataatagacttaaatacttcagatttctctatttatattctcaatcgtgtttttttcataatcctataactattttaaacaagattaatataacagaaaataacataaatttcactaagatgtcaaaataatgaatcatctaaaataattgattcccattgcattcttgacttcatcaagcgtttggctagctacagcttcggcttttaaagaaccagccttgagcatatcgtaaacataatccatattttgcgcaaattcaatacgtcgttcgcgaattggtgaaagttcacgttcaagcacttcaagaaggaaacgttttgtcttcacatcgccaagacctcccgcttgatattgagctttcatttcggcgatttgttcagcatcttcagctttaccgaaaacatcaagataatggaagaccatgttcccttcgattttaccaggatcttccactttgatgtggtcagggtcagtatacattgacatgacttttttcttgagtgtatccatgtcatcagcaaggaaaattccgtttccaagagatttagacattttggcatttccgtcaagtccaggtaaacgaccagcagcttcattttcagggtaaattccttctggttcaaccaaaatatcagtatggtaagcattgttgaatgagcgaacaatctcgcgtgtttgctcaatcattggtttttggtcatttccgactgggacatgagtggctttgaaagcagtaatatcagcagcttgagaaacagggtaaaccaagaatcccgcaggaattgattccccaaaagctttttgggcaatttctgttttcacagtagggttgcgttcaagtcgagcaagtgaaactaagttcatataatacattgaaagttcagctaattcgggaatttgactttgaataaaaatagttgatttttcagggtcaagacctgcagctaaatagtcaagagcaacatcgccgactgattgacgaataagttcagggtctttggcatggtcagtcaaagcttgttggtcagctaagaaaacaaacatattgtatttatcttcattttgcatcttgacacgattttgtagggagccaacatagtggccaatatgaagttttcccgttggacgatcgccggttaaaatagttggttttgtcatttttttctcctttgtagatgagtttagtttgtttatttgaacagtgtaaactggtttacacctaataaaaaaataaaaaaagcacccgtagaactataaaaagtcctacgggcgcttttgagcgcggtgccaccgtaattttaaaatcaaatgattttcttaagacctgtcagtaaacaggttgctgtgtaacggaagcggccgtgattcattatttttttaaatcaaattcattagttaataacaagcccattcaccttgctgaaaacgttggtttacacaaccaccaacttcctagagatttcaaaatcaaagttactttcttgttgtaataaattttacactttttgactaaaagtgtcaaactaaaaaagtagaaaatcaatttcttgaattagcaaaggcaaaaagctatactcagattagagtaaagatttaaaaataaaacataggaaactcaaaatagaaggatagcaatagctattttaggaggaaaatatggcaaataaatcaaaggcatcagcacattgggaagataccctagaaaacggttttggaacaatttcggcagaaagttctcaaatttttacagaaactccttataattttaaggctcgttctgaaagtcaagcgcacatcacaactccagaagaactcttaggtgccgctcacgctgcctgttttagtatggccttttcaatggttttggggcaaaaaggtttggtagcaaaaagtattgacacaacagcggatgtcacttttgaaacgacagcagacggtccagcgattacaaaaattaaattaactaatcattcggtaattcccggaatttctgaagcagattttcaagaaattgcaaagattgtgaaagaaagttgtccagtttctaaggcattagccactgtaaatatcgaactcgaagctactttgggataagttctctttgaaatattaatctaaaaactaagttatcttaaatggcttagtttttttgcttatactggggaaataatgagaaaaaaggggagctttctgatataatttaactaataaaaattttaataaagtcttgtcttattaaagtaagagaggtttcgatgaaagaaaataaattattatcaccggctgccatttttttgttgggagtgaattccataattggctcaggtattttcttactttctggaaaaatatatgaagacgctgggatttggagcttgctagccattttatttgctggtctatccatttttgtaattgcttttgcttatgcaaatatgagtaagatttactcaaaaaatggtggagctcttatctatgccaaagaaacatttgggcgctttccgggttttattgttggaatggtgacttggttattggggacagtgacattgacaacggaagtttcagccttgctcacagccttgaaaatgattttaccgaatcttaatagtcgattaactggcttgattattattttagttctgggcttgatttcctattttggaagttcaattattgctggtttagataatctgacctcatttgtgaagatattattggttcttgtttttgtttgtacttgtttttggttagtgcgtgctgttaattttacaagtccacatttattgactgtctcatcagcaaatttaggtggtttcaaaggatttttatcagcttatggaacagttttcttcttttttacaggattttcttttttaccggtcaatgctgaaaagatgaaaaatccagcgaaaaatttacctaaaatgatggcacttgtgatgctcacatgcttaactgtctatttgattattcaagcaattacaattggagcacttggtcctgaattgactaaaacattggttccagcggcaacggcttttagtagagttgtaggggcaatcgggattccactctttgtcattgggatttgtttttcaatttttggtgtgattgtagcaactacgtttaatacaccaactatcctagcaagtttatctcaagcacatgaagatgttccaatgtttgttgcgaaaaataatcgctttggaacaccaagttgggcaattattttgacgacactgtgtgccatgggactttttctaagtggcaactatgtttttctgagtggtttaaccgtatttatgagttttgttcaatatttatcaaccggtcttgccaatattaagaaaaaattcctgtggattggaattggttcagtacttttttctcttgttttactgacaagttttactttgtctgttctacttttaggtctaggaataataattttattagtgattatttattttgtagtcaaattagatgatgatgaacgtgaaaaatggcttaaagagcatcaagaaaaatcaaaagctgcggctgttaatactgttaagcgtttataagtgctgtcagtaattctgaaattactgacgaacatttttaagaatttgtcagtaaaaaaactcggtttcccgatttttttatttgtccatattttcaaaatgtttgactaacttaccagaaacatctgactctaacattttgtgaatttgtttcaaagcagaggcaatcgccaattcacttgaatttccgtgagccttgactaccggtgctttaagtccaacaaaagcagctccaccagctccatctgtactcatcaaatctttaagtccagacaaaggttttttaatcaaaaccccaccaattttagtggtgacactaccggccatgattgctgattttatttctttcatgagaacagtcgctgtaccttcgattgctttcaaaatggcgtttcccgtgaaaccatcagttactacaacgtcagctccaccagagagtaaatcacgtgattcaatatttccaataaaattaatttcagtcattgctgacaaaatttcatgtgcttctttgacagttggcgaacctttagattcttctgaaccatttgaaattaaagctactcgtggtttttcgattccgcgaacattttcagcgtaataagaacccaaaatggcaaaatcaacgagatgatgtgcagtattttcagtatttgctcctaaatcaagcatatcaaacccacgtccatcagccgttggtaaagttgacatcaaagctggtcgtgaaacttgtttaattctcttgactaacattaatccagctgttaaaagggcgcccgttgagcccgcagaaaggacagcatcggcttccctttttttaacagcagtcactgcccgaacgagtgaactgtctttttttgatttgatggcagcaaccggatcatcatgaaaatcgatgacttcagtggtttcaataatttcaatagctgtttcatcatctaaaaattgacgaattttcgctccatctccgtagagttggaaagtaacatcagaaagttctttctttgccaagtttacacctttgacaatattttcgggagcaaaatctcctcccattgcatcaattgcaattttcatatttttattttctccaaatcaaataatatctcattaaaattataacaaaaaaagtgaccagatagtcactttttttcacaatagataatctattgaagtaatttactgctcatttaaaatattttcaatttcaacaaggacagcatcttcgtcattagaaagaatgactttgtcagcctgagcaagaatttcaggggctgcgttgctgacagcaaaagaagaaccagcgtattcaaacatttccaaatcattcatttggtcaccaaaaacagctaaattttcagggagccaattaaaatgtgccaacaaatgtgccagacctgaggctttagaaattccatttggtacgatatcaatactagtaaaaccagtcgttgtcgctctgacaaaagaaagacggtcagtaatccattgctcacagtcccgaacatggtcctcaggaaagtttgtggtaaccttgagaagtttgtcatcaatttcatctaattggtgataaagttgacagttaggatagtaaagtttggcatgagtcaggtattctttagaaattccttcggggtaatatgcccctttgagaccagaaatcagataatcacttttaggactgaatggcatttcttgcaagtcatcaatcaattcttgcgtttgggcaacagtcaaatctttggcaaagaggatttctcctttataagcaacaacgccaccgttttcggcgacaaaagccatctggtctttatattcagcaaaaacttctgttaaaccatgtaaagaacggccagaagaagcggcaaaaagaagatttctatcttgaatttctttaattagttccgcaagttttttgtgattataagaatggtcattgcgcagaaaagttccgtccatatctgtagcaaaaagttttaagtttttagtcatgacttctccctaattcattgatgatgctatcaatgaatgaaaattagttctgtcagtaaattttactgacaagaactcccagcaaagctttcagttcttttatgtgcagctaaagcgttctttgagggtcgcgcctaattagtgacagaaactcccagcaaagctgtcagttcttttatgtgcagctaaagcgttctttgagggtcgcgcctaattagtgacagaactcccagcaaagctgtcagttcttttatctacaactaaaacgctcccataggtcgcgttttactgacagagctgtaaacttagtttacacaagagtgtaaacgatttgaaaagtagtaataattgctgacagaatggtcagcaccaataattaatcagcccagagttctttaactttttcttgaacttccgcattatctaagaagtcgtcataagtttcaccgatacgatcaataacaccagatttaccaagaacaacgatgtggttggcaatggtattaataaattcatggtcatgtgaagcaaagaggattgaacctttaaatgatttcaaaccgtcattaagcgcagaaattgattccaagtccaagtgattggttgggtcatcaagaacaagcacattagcacgttgaagcatcattttagagagcatcacacgaactttttctccccctgaaaggacgttgacagctttcaaagattcttcacctttgaaaagcatacgtccaaggaagccacgaagatacgtattatcgtcttcttcttttgtcaatacaaattgacgcaaccagtcaaggattggttcaattgaatcaaaatctttgctgttatctttaggaagatatgaacgagaagaagttactccccatttaatatcgccagtgaccgtccagttatcttccacatcatccatcaatgcacgaagtaatgttgtttgttggatatcattttgaccaatgaaaactgttttatcgccaggatttaagatgaatgaaatgttttcaataatcatttctccatcaatcgcaactgaaagattttcaacacggagcaagtcatttccgatttcgcgttcttgttcaaaaccaacaaatgggtacttgcgtgatgaaggaacgaattcttcaacttcaattttatcaagcatttttttacgtgatgtcgcttgttttgatttagaggcattggcagagaaacgagcgataaactctttcaactcagcaattttttcttcagctttacgattttggtcgccttgcaaacgaagagcgagctcagaagattctttccagaaatcatagttccctgggtaaagtttgattttaccgtagtcaaggtcagccatgtaagtacaaacattgttcaagaagtgacggtcatgggaaacgacgataacggtattttcaaaattaatcaaaaagtcttcaagccaagcaatcgcttgaatatccagtccattggttggttcgtcaagaagaaggacgtcaggtttaccaaaaagggctttagcaagaagaactttcacgtgttcgccagaagtcaaattagccatcaaatccgtatgttgttcagctttaatgccgaggttttgcaaaagacgagcagcgtcagcttcggcttcataaccgcccatttcgccaaattcggcttcaagttcggcagctttcatgaagtcatcatctgttgcgtcaggattcatgtagatggcatttttttcttgattaatggcgaaaagtttttcattccccatcatcacaacatcaagtggtgtttgatcttcatagtcgtagtgattttgacgaagaacggacatccgctcatttggccccattgaaatatgacctgttgtgggttgaatttcgccgtccaagatttttaagaaagttgatttaccggcaccattggcaccaattaaaccataacagtttcctggtgtaaacttgatgtttacttcgtcaaaaagcttgcggtcagagaattgtaatgaaatatcagatactgtaagcattattttttcctttttactgatgagaaaaatctcaattatttttcgataaagtagtttgactacttttgtgcttaaaaataagcattctgcccttattttatcataaaagttggactttataaagcccatttttttaagagctattgacgaaactgtcagtaaaattaactattttttgagttttagaaatatcctatcagagtgaaaggatatttctaaaaaaatgaggcaattttagtttcgattcagtgtaattttagcaatacttaagcaagccacattataatgtacttattccaataaaatttttcataaagtttacttctaaacaaaagaatgagcggctggttaccgctcatttttttatttttaggttagcatttaaagaaaatgataatgtcagttgttttaagatataaaacaaattgacattttcgtaaaaattagtaaaattaatgtgtttaaataaaaaagacttaatacctaaggaagaaattttatgaaaaagaaagtttatcgtaatactgctgcttttaaattattggcttggggatcatttgccctttttgttattttgattcttattggtttgtacaccctaaaagagccactcatgtttttcatttgttttaacttttaatgtatttttgtatttctgaaaccaaatatgctggagctgtaaacacttgttctctacagttaaaccttggtttttcccctgatgttgtcaatgtgacaaaaccaattttttcagcgataatacttccagcagcatagtcccatggttgaagattactaaaatatcccagaattttaccttctaaaagttgaccgtaactgattcctgcgcttccaataatacgaacccctaaagtttgatggcttaaatctaataagccgccactattagtacgatacatataactgttcactccaagtaaactcttatcaagagacatctttttgctttcaagttccttttgattgcaaaatgctttatgactatcacaccaatatagtttatctttcatcacatcaagaattaagccaaattttccaacaccaaattcataataagcaagcataatggcaaaattatctttttgaacaatgaagtttgtcgttccgtcaatcggatctagaatccataaatgaggaatttctggatcaaactttattttttcatcatcttcttcggctaaaatcttatcctctggaaaatggtgcaaaatattgcttactaattgttcttgaacttctttgtcaaaattggtcactaagtcatcataacgtgtcttttcggtaatttcgagaggagagctgatattttcttttaagaaatttccagcatctcttacccaatctttagctaattcaagccttgtcagcactgacaaatcgtttcccactagcttctacctccttgagcgctcgataaagtgagtaaccactgctctgctcaaaatctcttcccaattgtttttcctgcatttttgaaggaacaacttttttgaaagcagcgtaagactcaagaaaaagctctttttcgactttactttcataaaatttctcaacttgattgaaaaaagagagcacttctgtcatttcagtagtactccaacttaaatcaagagggtaattataattttctttcatgatcctcctggctaggcctcggtctcttttatttatttcttataagcatgcagaaaaatttactgacggagttgtcataaaaaggctttcttccatcttccttataccgtttattcctttaacaaattagtaagttgactaacttcgttaatttcataaacttggacactggttaattttggcttttttgagttcttcatcagtaaactttgccgactttttaatctattgtagttaacatttctgcgcgacgatattctcgtggtaaaaatgcacgaatctcatcttcgttaaaaccaatctgaaggtgttttgaatccgtgataattggacgtcttaatagatttggaaattcagtcaccaaatctaacaactcatttatggttaaattgtcaacatccacagccaacttttgaaaaacttttgaccgtgttgaaataatgtcttctgttccattttctgtcttagtcaaaatttgacgcaaatcgtttgttgtcatcggttgtgtcaaaatattgtgctctacaaagggaactttgtggctttgcaaccaagcgcgcgctttacggcagctggtacatgatggcgataaatataaatcaatcacagtcctatttcccatccttttaaaattatcagtaagtttatttttctccctattgggcaaaaactaatttacatctggtaagtattataccaaaattaatatagcaaaaaaagtaacgtcatggtttttataaattattttcttataaaaattacaaaattagtcattcatctcttcaaaagtctcttgtaaatcttcaaaattaagtaaatagacttcgtaatttgaactttgtttcattttttcgaccatatattttaattttgtctcattttcttcatcgtagaaaacaaatgatccttctgtattttcaagtaaaaattcattatactgacgaaattgacccggattttcgtatgcttcaaaagcatacttaacgaaatcaacttgtttgaagcttgctaattttatttggttattctcattccaattttgaccgtgagtctcaaaaggaaagattgttccgatttgaaattcatagtctgtttgcagctctttagcgacttctaaggcccaatattcaaatcccaaatttcctgtaaaaatgacccagcgcagtccttcttctaagaaatttattaattttcttctgattgttttttttataattgatactttaatgtctttttcattgaaaatccctagatcaaaacttgtataacccatgatgagcagtgaattcataaatattttccccttgtaaaatttatgttataatagacattatataactaactgagaattttataaaggtagaagacagaatggttaattatcctaatggaaggtcgcagtcttatagcgctgttcctaaaaaacaaaaaacactgacagagctgtcagtagctaaaaagagtgctccaaaatctaaaagtcttgttgctttcggaaagcgagggatgaattttgaagcagaaatcaatgcaacaaatgattactatctctcacgcggtcttgccgttattcataaaaaaccaacaccgatacagattgttaaagtagactatccacaacgaagtcgtgcaaaaattacagaagcttattttagacaagcctctacgactgactattctggagtctataaaggtcattatgttgattttgaagcaaaagaaacacaccaaaaaacggtttttcctttaaaaaatttccatgaacatcaaattgttcacatgagtaatgttctcgctcagcgagggattgcttttgtattgttacattttgcggctctagaagagacatatcttctcccgtcttcctatttaattacgttttattacgaaaaaaacggtttaaagtcaatcccactcgcttatattcgcgaaaatggctataaaattgaaacgaaccacattcctaggattccatatctagaaattgtgaataaactttgtgaggtacagtaaaatttctactaaatctaagaaaaataaacaaaataaatgggcaaaaagcggttctgctaaatcaaaatggtggacagctgttaaattatttttgattgtcttcttttcattaattatcttggggctagctgccggtggcgctgtttttgtttattacgccaaggatgcacccgctctcaatttagataagcttgaatctactccttctcctaaagtttacgactcaaaagaacaccttgttgcaactttaggggcagagcaaagaaatttagttaaaacagacaatattccggttatgctggttaatgctgttacttctattgaagaccatcgttttttcaacacacgtggaattgacccgatacgaattgccggtgccttcgtcaacaacttaaaaggtggttctttaaacgggggttctacccttgatatgcagttgattaaactttcttttttctcaacagatgaatcggaccagactttgagcgtcaaagttcaagaagcttggatggctctaaaattggaccaaaaatggaccaaagagcaaatttttactgcttatgtcaataaggtaaatatggcaaatgggtattacgggatgggaactgctgcgcaagcctattacggaaaagatttaacagaactttcaattgctcaactggctcttcttgccggaatgcctcaagctcctaatacttataacccttacactaatgcaacttctgccaaatggcgtcgtgacatggttattcgctcaatgcgtcgttataataaaattacggctgaagaagagaaaacggcgctagctactccaattgatgatgggcttcaacctttgcaacaaagcgttacgattcctagttatgctgataacttcctcaaacaagctatagcacaagccaagaccttagctggtaatgatattttaaacgaaggggttaaaatttatacaatccttgatactacagcacaacaaaatctatataatattgttaatagcggtaattatattacctacccagatgatacactgcaagtagcttcaacggtcactgatgttaaaactggcgctgtaatcgcacaaatcggtggacgtaatcaaccaaccgatgtcacttttggtttcaatcaggcggttcaaacagaccgagattggggttcaacgatgaaaccaattgttgactatggccccgcttttgaaaataatatctatacctcaacgaatgattatgtttctgactccccaacgacttatccaaacggaacgcctttgaaaaactgggataatacctattttggttcaatgactgttaagagtgcattggccctttccagaaatattccagctgttaaaactttaattaatgttggtttagataattctagtaaatttgtggatggtttaggtattaatttgaacccgctgcaatactccaatgctatctctagtaatactgatacaaaaaatggtggggcaagttctgagagaatggctgcggcttacgctgctttctcaaatggtggtatctacactaaaccttactatgtttctaaagttgttttccccgacgggcgaacagttgaatacaaaccagttcgttcacgggcaatgcaagcttcaacagcttatattatgactaatattctccaaagtgttttaacattatcactttctgaatctgtcggttcatacgctgctgttccgggcttgcctgcagctggtaaaacagggacttctaattatactgatagtgaaatggaccaaattactgaaaaatacggctcactccctggaatgatttctcctgatgaaaacttcgttggttatactcctcagtattcaatggccgtttggactggttattcaaatcgaatgactccaatatatggtacaagtactcaaattgccacaaaagtcttttcatcaatgatgactcaactcaatcctgacccgtctgctgttgcaacttggacagcgcctgagggcgtcgctcaacaaggatctgctctggttaaaacagatagttctggtcaaaccgttacacaatcttctgctaatggtggctaaatgataattgaaaaaattgttaataaaattgctcaggaaaatacttatgtcctgagcaattctacttcataccttattattgacccaggaagtgattcagcagcacttcttgagtatctaaaacttactgacaaagcggtctgtgcaattttactaactcatgcccattttgatcatatcatgggattaaatgatttaaaaaaatatttcccaaacgctccaatctatcttcatcactcagaaaaagaatggatgaaaaatcctgaattaaatgcctcactattttttctgggaaaggcaattactggaccggatgctgagcaattttataaaattggacaggactataatttagatggatttagatttcgagttttagaaactcccgggcattctatcggtggagtaagtcttctctttgaaagcgaaggcgacttctgcctgtttagtggagatgctctctttaaaaacgctattgggcgttgggatttaccaactgggaatcaagcacaacttttagaatcaattcgtgaccaactttttagactcgataatcatattcgtgtgctgcctggtcatggaccagagacgacaattggcgctgaaaaacttcataatccattttttcaataaaaaaagcactgacagttctgtcagtgcttttttatttaaattttaatggtttggcccggatgaatcatatcgttaattccaaaaccattgagagcggccagttggtcagctgtcattccattggctgttgcgatagaatagatgctgtcaccattttgaattgtgtaactaccagatgatgctgatgtgcttgcatttgttgaactgtttgtactaacttgtaaaacttgtcctacttggagcattgtgttaacatcataaattccattagctgacatcaatgatgaaactttcattccatattgctcagcaattgaataaaggctatcccctgatttgatagtatatgtattagctgatgtgcttgaagcagtattacttgtgtttgttgtcgtactacttgctccagcaacttgtaagacttcctcaacatgaatatcgttagcactctccaaactatttgctgatacaagtgcctctactgttgttccatattgtgcagcgattgctgacaacgagtccccttcttgtactttataagttccgactgaatttggtgtggctgctgagcttgttgtaacagcgctcgcactagaaacctctcccccttggtcataaatactcaatccaagttctgaaatcacactgttcaatttagaagcataagttgggtcagtcgcataacgtccttcaagccaagcagttgcatctaagtaagaactggtattttcacgccaagcacctgaataatatgaagaaccacgcaacatttgagcttgggcaacgcaagcataataaactgaactataagattgaaatgtttcaacaacatttgtcattacaccatttaagtattcctgcgttggtaaataaactggtgttccagaagtgtattttactccaaaaatattattataattacttgctaaagcactttgaccaccactagattccaaaattccttgggcaatcattactgatggataaagcccatagtcattagctactggtaccgcagcattgatgatttcttgaactgatgctgcttgagctttgattccacctagacttgccaaagcaacaattgacgctccaagcgctaatttatgtttctgtttcatcgagtttcccctcttaattaaatagttttttggctgaaatatgccaattatatttttattgttacttactagtataaaaattttctgacgatttgtaaagtcttttctttattatttttaaaattttattgtcataaattttttttgagacatgattataatattaggaggcaaaattttttatttgagttataatgaaaataaaggagccaaaaaaatgacaaaaatctatgaaaatattaccgaactgattggacatactcctatcattaaattacagaatgtcccagccgatagcgctgatgtttatgttaaacttgaagcttttaaccctggcggttccgtcaaggaccggattgctctttctatgattcgcgccgctgaagctgatggccgcttacaggctggcggtacaattgttgaacccacttctggtaatactggaattggcttggcctttgttggttccgctcttggctacaaggtcgtgattgtcatgccagagtcattctcacttgaacgtcgtaaattgattcaggcttacggtgccaagctggttttaaccccagcaagtggtgggatgaaagctgcaattgccaaagcaaaagaactttcagaaacagaaggttattttctagccatgcaatttgaaaatccagcaaatcctgaggtttatgaaaaaataactggtgccgaaattatcgacgcttttggcccaactggacttgatgcttttgtcgcaggagcagggactggaggaacaataacaggagtttctcacgccttaaaaaaagtcaatccaaatattaaaacttatgttgtagaagctgatgaatctgctattctctcgggcgaacctgctggacctcataaaattcaaggaatttctgctggtttcattcctggaaatcttgataccaaatcttatgatgagatcattcgtgtcaaaggagaggatgctattttaattgctcgtcatcttgggggtaaagaaggatttttggttggaatttcttctggtgcagccatttatgccgctctcgaagtagcaaaaaaattaggtaaaggtaaaaaagtgctagccattgctcctgataatggtgaacgttacttgtcaactgctctttacgattttgattctgaaaaataaaataaatagttactgacagaaacttaagaataaccaccagctaaaaattctgattatacagcccctatgaagtcatccgtgcttatcacgatagagggatgatgaaatggggcgcatttgcgactggagaactcaccgaggctcaaaatacttttgaaaaagaaaaaaaagatgataagaaaattcaagctttaccacatcatgtagtcctttatcttctcaatcagtctttttcaaatcagctacaaatcaaagttaaatatcaatcaaaagataaattaaatgaagtctatggttttgtatcagaatttatcaataatcaagtaagagttaaatcaacggataaaatctatctcatatccattgaacaaattataaatatttcctaaataaaaaggggctaaatttagtcccctttttatttcatcaacaactcaatcaattttttcttgatttcttgttcttcttccgttccctcaaactctaatttttctaattgagtttcaattttctttaactgcgtgattggctttttagcggttttcttttgggggctaatttttgccccctcttcttctccaccttgttctttagcttttctaatcagtttttgagcggtataatgactgataccaaatctttcggcaattaagtccctagtctttcctttaacaggttttccgttgatttgtaacccttgttttttggctttatctaaaatatccatatagtcatcaatgatggctattttttcttcttctggcatttttaagagcgagcgagtttgtaggttagtttcatgcaactttagtcttgttacaagctcatcctcgtcttcatcaactttcttagcgagaacttcgtaatcttcagggagtctattttcactaattagttttttaatagcattaaatcgtctatgccctgcaatcaattcatagctatatttatcacgttgtttaacaagaacgggttgtaataagcctaactcgtctatgctatcagctaacttatcaatgtcaactaaatcatagttgttattctcattttcctttatctcctcaataggaatattttttgtatttgttttttttcgcttgtgttcgtccttgttcataaggtctgtaaatccgaaactattactcattttttaacccctttttactatttcatcaataagatttaaataatcatcttttactttagaacttttagaactatcaattaatacctcattctttaaagcactttctgtaactggcttagcttgatgtcgtattgttgtttcaaatctattcccagatatttcttgaataaattgtttatcaatattatttctgttgaccattgtgtaaagtacggtcacctctgtatctaactcataatcatcaataatttgattgatgttctttaaagtcgttctataaccttcaagtgcaaatttatcaatttttattgggatgataatttcatcactcgcaataataatattgagagtaattagattaattgttggagcacaatcaataatacaataatcatatttagaatctagtttctttaaaactttttttacaatgtttgatgaattacgattgaatgaatttcttactttcaattcactttcagcaactgctaaacttgaaccaatcatgtccaaattctcacttacgttataaacatactggtcaacatcatctagtttttcatcaactatcagttctgcaaaacctttataatcctctttcgagcgtttatcttcaagaaaaatacttgttgcattagcttgcatatctgtatcaatcaacagagttttgaaccctctatttgctaaaccttttgctatatttccacctgttgttgttttagcaactccgccttttaagtttaatagacttattgttttcatattttctctctattctttatttatattttcatgagtctttgcgaaatgataaagtccctctaacgtttcaaatttagtgttacccaatgtcgtttttttatttcttaggtttgaaatcgtcatcctagaaacttttattccaattttttcgagttctttctcaatataccaaccagaaaaattttcgtcatcatcgagtaatctctgtaccacgtttttaatttcatctgttactttttccatatcaacctttcttcacaaatatacgatacttgcgaaaactatatttttataattcattatttcattctcagccctctcacattttgtggtaaacattcttactttttctctgtccaaaggtttgaagcaagaagttgttttatttttactatacatctattgtatcgtaaatttatgtttacgtcaaaggtttttacggtttttcttaaattttttatataaaaataaagggggctaaatttagccccctttatcaattaaaaatcaacccgaattgctagttgattattcagccatgacttgatatccggtagagtatcttaaagtcattgaattcacggttttagctgatttcaatatttctaatttgactagaaaaccataagaagaacgacttttacagcgttcagctccgaggtttgtcagaaaagagaatacgcgttcaatgacttttcgacgttttgaaaaattaggaaaagttatgtcctttttcttcatgttcattctgacaggtgtaataagttcaatttccttgagttcaagcctatcatgaagcacttgacctaaatatcccatatctccaaggactatgggtgtgccaaattgagacaatacttcctcggccattgtactgtcagctattgaagcaggactaatcacgtagtcgatgacatagcctgattcactgactaaagcatgacatttacatccatagaagtactgtccctttgtagcattgtagccaacatttgcataatctccaagacctttgcttctgaaattacgaataggctgacacaaaggaatggggaagctgtcaataatggatacactaattccttcaacctctttaaagacgagtgcttggcgaatgacttggatactcggtaagagggcattacaacggcggacaaagcgagaatattctaggaaattaggaaataaactttgagcaagttggtgcttagctttaagcgtttcactaaaatgcagtacgccccataggtaacaagcgataactaagcaatctgatgttgcgagatggacgttctttcggttttgaacctcaaggggaacactcgtttgataaagcgtctcaatggttgtcagtaaataaacaaaaacttttggaagtgtgctattataagtcatataagtcgtgcgctttctaatgcttagtggtttaagattacgatagcacgacttatttattttccaatgaaattaactagcaattcgggtatatttttcaatgaaatcaactagcatttcgggtagaatcaagtttaattccctcatttttttggagggaaattttgtcgaatattgataagaacaattaattttgatatacttacttgtatcaaacctctctggtttgtggtagctttttgctctttctctgtccaaaaggttaagagtaaaaagttttttttagaggaaaagttcattcatatattcgttccaaaaaaaggagctaaatttagcccctttttttttatacttaatattgaaggtaaatatttagtttatttactatcccaaggaccattcattggtacatagaaatcagacgaactatcaaaaactaatttatgtatattttgagccttatacgttgttagaaatgctctgtattctgaaaatttatttccaaaaacaacactcggtctaaaattattaatcatttgattgctgtctagcttccaatcgattgctttcatctcagccacttgtaacaattcatctatcgctacaccactttcaagcaatttatgaatcggttgaagaagttgtatatcatctagttcaaattgaatatcataataatttggtaaatgtttaattattccgttttcatctaaattaaaatttacttttgataagtaattaaagtattctaataccattcttgcttcgtttataaatggactatctgtaccaggagaagaagtacgagaattcatagatatatgattgctgcctgataaatcagcattaaatggcgtatatgtaaattcaatagactgtattcttcgtccagaagtgtgataaatataatctaaatttttaacaatttgagttccttcaggagtatttaattctgatatttctttaaccgcagtttctaaatattttttacgattttttctgaggtcaaatacctctttggtgttaaaggagtcttcttgagtcttcaatattttaagtatttttttatcaaaatcatcaattctcatttttgtaccttttggaaaactcctaaactcgcttataaagcggtaaacacgtttggagtacttagatggcagactattgttgattcctctgttatattgtaagtgtttaaccgttctccaatctttggaattgattaagtcataaacatatagcggtttatcaatcacatgcccttttgcatcaacttgttctgaactaatttgagcattagaaattgtgagttttacttcttttttagtaccatcaaaatcaattacactgaaaatatttattgttttccatgatttgggagtgccatcatcatttgtttctcttacttgatagtatgagaaatttttcaatgcctcgtttaaatcatacattattttttgtagccgtttaccattgtagagcgatttcacaccatttttacgtgttacccacaatccacctaattccgctaattcctgataagaaaatgttactggttcactcccgttataacggtctctcagctctccaagtatagcataagtaatattttcacttgcagcatttatgtcttcagtagagaacatctcaggcaattgacggctgtatttaatatcttttctaaatttatcttcactatcaagttcatcaagtaaatcgtaactttgcattttaacccctctttcagtatcaagataaaataatatctgatttaatcgtaaaaattgtgtatttttcgttcaattcatagaagaaagatagaaaaacttatataaaatacaacatttttacgtcataacctttgtttttattaatatatactatttttttattcttgtctagtaataatacaacatttttacgatttacagcaacatttttacgtcacaagcaacatttttacggttatatacaacatttttacgtcataggtacacaatttttactccctaatacgcaatttttacgacgtatgtacaacatttttactccccagtacaacatttttactcctcagtacaacatttttactcctcactacaacatttttacgatattaatagctataaaccgtatggttaagccttaaaatagccccttaattgtaactgtaactataactttatatatataactataattcttattctataataaaataactaacgaattttcagaaaaaaataaaaggagctaaagctccaaatttttaaataaaaaatctatttcaattggagtaaatgcagcaactactttcccaataatccttgggttatcatcccaatataattttatatctggaaattttttttctccgttttgaccctcttctatatttaaagactgtagaagaagtccatcttcctctacagtgacacattttataaaaccatttcccatagaaacattatctactgcacaaacttgaccatcataatcaggagaactttgatattttattagcgcagtttgaccataatgaaattctggttccattgagtcccctttaattgggatgcctatatcataattaacctgtttatcccaatacacagtacatgtttcaatattatcagtataaccttcacctaaacctgcagataatgcttgctcagtcgcttgcttatatgggattaaagaatttctaaaatgaattatgttttcttgttccttttggctttttaatttatcctcagcataattaattgtttgttgtttattatcatctgagagttcttgataaattggcaaaatttctgtatctgttaaatattcaaatgaaacatttagtgcatcagctaattgtctcaaatttttatctttagggtttctggaccaatgtcaaatatttagacacaaaatgagctatattttcttaaaataattttcttctttctaatttggagttaaaccattgttggcggaatgaggattataattgttataaaattgttcgatgtattcaaagcaagagagttgaacttcttgaatggagtgataagttctgcgattaatttctcgttgtttaagatacttgaaaaagacctcagtaacggcattatcatagggatatccaggcttggagtaagaagcaagcaattgatgctcatctaataactttctaaaggaagctgatttaaattggctcccttgatccgaatgaaagataattggttccttaggctttctcttattcaaagctatttcaagagtgtcacaggcaagttgagcatcaatcttatcacttactttccaagcaatacatttccttgagtagaggtcaagaatagcacagagataaacatgtcgcttaggtcctatagagatataagtgaaatctgttgtccaaacttgatttggggagttcgggttaaattcttgtttaagcagattatcagaagaaaatacaggagatttctttgatttaaaacgaggtttgatggttgacattttagggagtgtcatagacttgagaagtcttaagatacggccttcagaaatattaacgccataatcacgcagaagaatgattttaaaagctctcgttccaattcttttcttggctttcatataaatctcaaggagtaattttctcaagcgttgattttctacttcacgcttcgaaggcctcttgtttatgaagttatagtaggtggaacgattgacatgtaaaacacgacagagcataactgtcgtgtgttcaaatcggagtctatagatggctttcactcttacttggagttttgcatgaatatggcactcgctttttttaagatcagattttcctcttctaattgtgcatttcgcttttgtaattcttgaatttgcttggcagtcattactgtattgtcttccagtttaacttgagagaattgcttaatccacttagagaatgctgtttgagagacgccatagtctttacagagttcggattgagttttaccagtttgatagagattaacgagcgattgtttgaaatcctcgtcgtaacgtttaaaacctgacataaaagtcctttcatttttgtgtcttaatagacagattataacacacaattttctctccacttttatagtatagctccaaggtttgcaaaagaacgtctatccgctttatgacgagttaaaagaattaagaggattgaatggggtcaaagaccacttgtcttatgtatctagcaaacaagaagcctattctaaacgcaatgtagcgaagtatctgaaaaaagcaatcgagcaatatctatctacggttaaaaggcaggaattagaccatgagtaagaatgtaaaaaccataaaagagctggctgacgaattaggcactaataaaactagaatttcaagaataataaacaaaaattcaatcccaactcaaaaaataaaaaataaaattgtgttagaggacaattcagtaagtcttatcagacagtattttaagaacgaaacacaactacagaacgaaaccgtcagtattcttagaacagaacttgataaagcccattctcatatagaaaagttaagcaatctttcagaccagcaacaacgattagctttgcaggataaaaaattactggaagaatacaaggcagagaatgatagcttaaaagcccttaaaatgcccacagaggatacaaaagaggaacaggtgaatagtcaaccaaaagaagaagttaaagctcttaaatttgaaatacgattttaagttatagttttttgctaaacggaagttgatatcatctgtattattaatcaaagcaaaaccgtgttggcgattaataattcctttttcttcaagtttatcaagatcttttcggattgttacgtttgaaacttcgagtaattgtgaaagttgagtgacttcgatttttttataatcactcacaatccggataatttcatcagaacgggacatttagtagcctttcgtcgtcttttttatattttaagactaccacaaaaatttaaaaaaataaattttttattagtatttctttcattcgtaagttaatgaagtaaaatatattcgtttttggtaattgcccaatagtctgtaagaataggctgcttaaacttaggaaaataggaataaacttttcctaaatgcttcattcctaatttttccatgacacggccagattttgaattttctgttaggtgttcggcctgaatgacctcaatccccaactcattgaaacagagctcgaaaggacatctggctgcttctggcatatatcccttgccccagctattttgatttaaaatccaaccaaattcaacaattttttctttgataatattaagaaaaatttccccaatgagttgtcctgaagtttttcaacaattccccaatgattgagaccatcaggcagaaaaaaattggcaattgtggatttggttgtctctaccgagtcatgcggttcaaagctagtataacgaacaacttctggattagaagcatagttaaacatttctgtggcatcctcaagttgtaattttctaagaatcaagcgctcagtttctaaggtctgatgctctgctaatattaaatttatatcaaccataataatttttctccttgactattttcactcaattatagcctctatttgttttattgacaataaaaaagaacctttaaggttcttttattttagagttcaaattctaagagaattgggacgtgatctagacgttcgccagaatcaaggggttcagaaactttaattgcatctgcaagacgattggaaactaaccagtaatcaattctccaacctgaattatttagttttgaggtttttgcacgttgggcaaaccaagtataaatactgcgtccttcttcataaaacttctcaacaggaccatgaagtttacggaatgtatcagtaaatccagcctctaaaagttgaccaaatttttcacgttcttggtcggtaaatccagctgagttgtgattgccacggggattggctaagtcgatttctgtataggctgcattgaaatctccacaaacaaagacaggtttttgagcatcaaggcttgtgagatagttacggtagttatcatcccaaattccacgtaaatcaagtcgcgtcagaccttcttgagcatttggtgtataaaccgtagtgacaaagaagtcaggaaattcaagggtgatgattcgaccttcggcatccataggttcaggagcatcaatttcaggaaaagtgatgactggttctggtagagtttctttataaagaatcattgttccagaatatcctttacgagcaggttctactgatgaacgccagacgattttataacctttaaacagatcttccaaaacttctagatgagcttttttaggtccagtagaaggaagtttggtttcttgaattgctaaaacgtctggttgtgcttgggcaagatttttaacaacagcaagagaaagtgcagcacgttctgaggttccagtcaatgcagcattgagtgagtcaatattccatgagataaatttatagttcataatcgttcctttattttttaaaagaatttccaaagagctgtgacttaaaggaattcttaacttttctatgataattataacatagccggtaacatgaaacacgttttatgttaccggcttttcgtctaattacgacctgataaaaatacaagcctatctgtaagcgctgaagcgccaacagctacgctttggcgaagtgaatcttcgcaactacattgctacgctgtcgatgctcgctaaaccagcaagctggtaagtcgcaatcgcaaccgatactttttcacttaggatagtcgttatcagcttgcctttttgtcattcgcttgcgattcgcgttggtgctttggcaccttacagcgaatggacattcgagcgtagcgaagattagcgaatagacaaaacggacagcgtagcgcctaagcgcgtagatgctgacttacgaatatgctagtagtttcatcagagaaagtagtaagactctagtcaatccccatagggattgacgtccgcccattcccgcttgcgactcgacttgtcgctttgccttttcatcacctgctttagcaggtagagaaaacggacagtgtagatagcgacttagcgagaaccactgcgacttgtgactttagttacttagtgagcacggatacctgtggtgtggacagcgtagctagcgggttatgggctgtgagtattataacaaacttaatcagacaatgcgattttagaggttttttggtataatatttagatgagaatgttctcaaatatcgagcctcatttgctcggaaagaggaaaatatgacagaaaacaaaactttttacattacaaccccaatttattatccatcaggtaagttgcaccttggtagttcttacacaactattgcttgtgacgtgcttgcccgttacaaacgtttgatgggctttgatactttttatttaacagggcttgatgaacacggaatgaaaattcaacgtaaagccgaagaattgggaatgactcctaaagaatacttggacccaatggcggctgatgttcaagaattatggaaaaaattggatatttcttatgataaatttatccgtacaacagacacttatcatgaggaagccgttcaaaaaatctttgaaaaattacttgaacaagatgatatttacttgggcaaatatgcgggttggtattctgtttctgatgaagaatttttcactgaaacacaattggaagaagtttttaaagatgaagcgggcaatgtgactggtgggattgcaccgtctggtcatgaagtggaatgggttgaagaagaatcttatttcttccgtatgggcaaatatgcagattggcttcttgatttttatgaagctaacccaacatttattgagccggcaattcgtaaaaatgaaatgattaataatttcatcaaaccaggattggaagatttggcagtttctcggacaactttcacttggggaattccggtaaaatcaaatccaaaacatgtggtttatgtttggttggatgcgctctttaactatgtaacagcactaggattttatggtgatgacgactcactttataaaaaattctggcctggggtaaatatggtcggaaaagaaattgttcgtttccacacgatttattggccaattttctgtaaagcattaggaattgaaccaccaaaacaagttttcgctcatggatggctcttgatgaaagacggaaaaatgtctaaatcaaaaggaaatgttgtttatcctgaaatgttgattgaacgttatggccttgatgcggttcgttattatttgatgcgtgcgatttcttttggacaagatggaattttcactccagaagattttgttggacgtattaattttgatttggctaatgatttggggaatttgttgaatcgtactgtttcaatgattaacaaatataatgacggaaaaatcgaagcaactggagtttcgactgaatttgatgcaagtttggaagaagtggttgaagaaacaatcagtcatttccataaagcaatggataaatttgaattcaacgtggctttggctgatgtttggacattgatttcaagaacaaataaatatattgatgaaacagcgccttgggtccttgcgaaatcagaagacgacaaagcaaaattgaataatgttttgtatcatttggcagaaaatttacggattgcaggtagccttttacaaccatttatgcgtgcaacttcaggtaaaatcttcgagcaattgggaatggatgaagaatcattttcacttgaaaatctagcttttggttattcatttactcatcctgtagtggcaaaaggtcaacctattttcccacgtcttgatgtggaagaagaggttgcttatattaaattacaaatgtctggtggctcagcggactccgctgaggtggcagatgaatgggtgcctgaagaagttgaattgaatttaactttaccacaaattaaatttgatgattttgaaaaaattgaactaaaagttgccgaagtgcttgaagtggaacgtgttgaaggttctgataaattattgaaatttaagcttgatgccggtgattctgaaccacgtcaaatcttgtcaggaattgcacaattctatccaaatgaacaagaattagtaggtaaaaaattacaaattgtagccaacttgaaaccacgtaaaatgatgaaaaaatacgtttcacaaggaatgattttatcggctgaatttggggatcaattgcgtgtcttgaccgttgacgctgatgttcctgctggttcattgattggataataaatataattgctgacagttctgtcagtattatataatctttgctacaagaaattgttggagtgaagcctacagaaaaaagtcgtgaaaatttgttatttttcacggctttttatgtatagtagattaggagggaaatctcttagtgttcacttggtttcatgtatcctgacaaattctagatgcaggaggtgcctatgaagtcaaggtgtttcttggttatggagaggattttatgctgatggtacttgggatgattgtcgaagttttgaacttcgcaattaacctagtcagactttggcttgaaataaaaaaactaatcgcaattagcgattagtcccaccataaccaagttttaacacgaggtctgttagcgcagacctttttttttgcgtgtcccactttgttgaaattactataacaaaaaattttaagggagacaaatagactataatttttgtgggctctttattagttctatctatcggataattaaaactggttttcatttatttaaaatctctcgaactttgctataatgaatttagtttatttttaaacaatatggaggaaaaaaatgacttttgaagaagcattagctttacttaaagctggaaaaaaagtagttagaactaaaggctggtctggtgccgaaaattatgtcaaactttatgattcgattgttttagaatctggtgaaaagttagaagtgaccccttatttcttgattaatgtctcaggagagggtgaaggtttttcaatgtgggcaccaacgccttgcgacgttttggctgatgattgggccttggttgaatagatagaatagataggctacaaaatgaaattttctgggaaaaaagtgctaattacaggtgctgccagtggtattggcttggctcaaacaaaagcatttttggccgaaggcgcacaagttgttgctgttgacttacaagaatttactgacgaatctgtcagtaaatcaaataatctgtcagtaaaaatggttgatgtttccaatgctcaagcagttgaaaaattgtctaacgaagtgggaacgattgatattttactcaatacagcgggcattttggatgcttataaaaccttggaagaaaccgattttgcagaatggcaacgtattttgtcaacgaatctcaattcgatgtatttgatgatttcggctttcttacttaaaatgaaaaggcaaaaatcaggagtcattatcaatatggcttcggttgccggattagtggcaggtggaggcggtgtcgcttatacggccagtaagcatgctattgttggactgacaaaacaattggctttagatgaggcgcaacatgggattcaaatagcagccatcgctccgggggcaatcaatactccgatgaatgcggctgattttactgaaaataacggtcagatggctcagtgggtagcagatgagacaccagctaaaagatgggccagccctgatgaagtggctaatctgactctctttttagccagtccacaggcttcttatatgtcgggagcaattgttccaattgatggaggttggacaattaaataaaagatattgaaagacttatcagcatgttggtaagtcttttatttattgtaggaaagtctgtattaattacaaaagtactgacagactcattgattttactgacgagttgctcaattggttgttttctgtgaaaaaaaatctgtcagtaatttttgagcttctttttggcacatctacttgatggtctgtcttgagagagtttttattgattacaaaaaattagcagctgtcagcgaaactaacctctctctatttattgatgaaagaaaatctttgtcactccttttcatttgttcaaaaatctgttaaaataaaaacgttgctcaattgcgagtcaacccttgagccttcttccctttgctcaagcatattaaacgcgacattttgtcgccaaaggagagtattttgaaaaagtctagaacttatgatattgttacgattgcgattgttgccgctctttatgttattctaacgatgacgccgggtctgagcgcgatttcttatgggccagtccaatttcgggtgtcggaaatgttaaatttcacagcattcttcaataaaaaatatattattgcagttacgattggctgtatgatttcaaactttttgtctttcacttgggtcgatgtgattgttggtggtttatcaactttaattttcttaagtcttggtcttttcttatttgaacgctttaaaggacagtatttttggaatggtcagttaaataaagcctttctgttttttgcaattttcttttcaattagtatgtttaccattgctctggagctaaaatttgtcgctggagccccattttttgtgacatggttgacacttggtctgggtgaatttgccagtctattggttggggcgtttgtgatggataaacttgggaaaagagtggatttaagccgataaatatagtaaagcagcacttgctgctttttttgaaccatttttagaagccaaaattacttaatttgttataataaaaataaataaaggattggagagtttgtaatgaaaaaaatagctgtgattgctgctactggtaaagctggaagtttaattgcccaaaaagctcttagtcatggtcatgaagtgactgccattgtcagaaataaagagcgattaaaaaatcaagtgactgctgttcttgaaaaagatatctttgcattgactgcagaagatttatctggatttgatgccatcgttttggctcatcgtgcaccagcaggtcaagaagaagattactcaaaagtagcagagaaaatgataaaaattcttgacggttcagaaagtcgtttaatcatcgtgggaggagcaagttcactttatcttgatgagaaccgctatcaacgcctactagatgtgacacaaacggatttgccttattatccaacacttttggagatggctaaagcaagcttgatttatgaaagttcaaaactcaatttcacattcttttccccagcagaattttttgacccagaaggtttagaaacaaatgattatacaatcaccggagatgttttgggatacaataaagccggaaaaagccgaatttcatatgctgactatgccgaagcggtcgtaaaaatgattgaagacggaaaatatcaacatgaacatattggaatttacgaaaattaaaatgtattaaaatacataaataatgatggatttaatctaaaaaagtagaatagcaattagatgaatagtttttattgatttcaaattccaatgtccaaattctgataaaaaatttttagtatagattacatctccctcatatgttccttcagatattaaaccagattctacttctagctttcttttagacaaccactctttaaatgcttcagatacactcacattaattttaaattcagaatatttataaattttttctcttacacgtttctctaaataattataaacttctgctggacattttttagtatgttttccttttgaaatagtctttgtcacaattaaccactcttgagttggttcattccaatattttaaatgccatacttgatttccattcttcgcttcagtagaaaacgggtctaaaacttttattccatcttctgatattttcatcttctaaattatcctttcattaaatgttagaagacttgaacattactattctaacattttttaaacgatttcttgcagtcgtccgcagtattttataaattcttcataacctacaacactcactagagtaactttataactttttctgatcacatactctgaaaattttggatttcgcctcatttttgtcaaatcattatctaaagttcccttttttacaccaaacatttctgctatttcttgtttagttccatattttttttcactcattcttacctcccaacgcaaaaaaaaatagagcaaggttttccctgctctttttcttaactactaaatatttctaacatatccgtgacttgtttttgcataatcatttatcgctaaatctcgaccataagaaccaaagttaaaatatctttgtagtgtttctacacttaaagtttctacaccgcccatttgttcaattaattcttgcgccaaatcttcagcatcaccagcttcaacgaagtccaaatcatctctattgtctataatatcatcaatactataaacttcaagaaactcttttatgtggtctaaatcagaaatttcttctaatttttcagcatactcattaagttctttgattgatgaatactcacctactttatatccgtaaaaattttcaaaatcatgtatagcaaattcctcaccatgttcttcatcaagcaataaatcacgttgaatttgtctgaaatcaactggtaaatcataccagcgccctcgagttttcatattattgtaactatttaaatttacaacataaatttttggtgtttccatttttctatcctcatattttctaattaataatttaagatactcaaccagttcatatcacttaaatttttactttccgcaagtatgccacttattgaaaatccttgcttttccaaatcatccgcatatttttttagatagcgaacgctattatctaaattgtttgcaaaaatgtctaatctttgatgatagcgttgttctaattgaacgaggaaaataatatggtcagaaaatacatgaataaatgctttatctatctgcaaatatgccaacattttttcttctaagctttcccatttttttttagattttactatgctgctttcttgtattagtttaattttcccaattgttatttttaattgttcagcccaagctataacttcagataaagtcgcataaggacagagttttagttctccctccatttctcgcagtctgtggtcaaaaattctgaaattattttctaatattctttctgacattttgccacttgctctaacctcttcaagtttgctcatatcctctcctcttcattgttcggaaataactttaaaagccctggaattttcaacgtgaaaactaggttaataccgaacgttaatcgactattttttattttcctatcacgtaatgtaattgactagcctgtgcttttgttaaaacttggaaagtataaaccgtactaaaaccagttcctgattgtgaaatcaaaactgaaccgtctgaatgtatttcttccacaaaagccacgtgaccgtaaactgggtctgcgttccattgaccacctacagtttgaccaccactaaagctaaccgcactatgaagaacaggagtagtggttacactataaccagcttgtttttgccaatcagcaccattacccatatacattccaaaagtaataccgaaatccttagctcgattccacgtgaaccacgtacattgtttgtactcataacttgatgcaatataaccgctagtattaattggtttatccaaagtccaacccgacggaatacctggagtaattcctgagccacctgaaccgccaccagttccattatcaccaccagtagtaaagaatgtgtaccaatattgagcatattcttgacgctgagaaaggctatcaactgcccccgcacgttcccatttacgcataatatcttctgtggcttgattaatattagtttctttaactaatttttttatcaacgtagaatcagaatcatcatgttcaaacataaattcaacttgaatattagtatctgtccaagattttttttgacttttagcgtacttaagcaaactaactcgcctaccactatcccattgtgttaaaccaaagccatagccaccgatactaccattcatagcttttgattcatcataggacgcttgactttgaatagcgcttggaatcaatccatcgctttcatgttggttattaccaattaaagcagcagctccttctttagttccgccctcttttagtgctctatcccaaatcgtttttgcgacttgttgctgtgtagtgttcacattaacattattattagaggaatcatccgcagtaacaacattaaaaaggacaaatacaaaagttaaaaggaaaacaaaaggcaataaaagaggaacaaaagataaagcaatttttcgcttcagtttctttttaatcacaactcccccttttgttacaactcatttttaatcttagtaggacgattgatttgagtattttctcgtttaatatcttctgacttaacagactgtttcacactcgtttttgtaggcttattactatttggactaaaacgctgtttatttttttcaaagcgttgtgccattctttgcgcacttgctttttgttcttgattcgcttttacacctttaacaattgcttgatttctgctttctgctgattgatgttttttctcataattttgttgcgtatttttcaccattcgctcagtttctgggcgtaattgttcaagttttttatcatgttcaactttttgctccgatttttgtttcaaatatttaagatttttacctgtttctgtcttaggttgtgctttattcatatcagaataaggagcaactttgtcacttgctcgtttctttttagtttctgaagtttgagtattttgttgttttttctccgcttttttattttgtttctcaaaacgtttctcaaagcgctctttttgtttagttgccttattacgttttttctcatcggaattagggtcaagaatattcttcatactttcaccatactttttaaatcgattttctgaacgacgacgattaatcgcacccgttccaactttataattaatatcttttgcaaaagttttaccagcaatgattcccgctgttccatcagccaatattggctgtaatgtccgttgtttagctcttgaaaatgctgtgtccattgcattaaatgctcgattgtttgtaatcgcacttgatgcattacctaaaacagagaagaagaaacctctaaatttaaacaagataacatatacaatcacttttgcgattgacataaacaaataatttgcaccagcaccaccaaagatagtatctaagaaattattcaaacttaaaaataaagttgtcgcataccctaaaagtacagacaaaataagggttacccctgttttgacaactaagtttttacccgcttgctcaaaaactgagaggaaaactaaaaaggctacaataggtgctacaagtaagaaaacaagaaatgcaatacccgcaataagtgctcctaacttgaagagtaaaacaccacatcctaaaacaaaattattgataactgccccaagagcaacagaaaacttatctccaatttcattaaagcgtaaatgacttactttttcggctttccttatgtccgctactttaccagcatctccgcctgaattaattaatttattaacattttcacttttagtaccatattgcttatcattatcgaaattcattctttcaaatggtgtaataaccattgtttgaagtaaatcaggcttaccgttagataccccaccaattttaattttttcaatcactgaagtattaatatctgccgatttagtctgaactgtatcaataacttttccgcccaaattgaaaaatgaactattcaatatcagtaaaccaaaaatcactattactgttttagcaagatgcccttttaagaatgctcgaagcaggctatacagtataaatgttgcaatcaaccaaaaagaagggttagacgggctgagcaaggaatcataaactgtttttcctgatgcaagaacaacttttccatagtctttaacaacattgattttagaaaacatgttatctatccactttgtaaaactatattcttgttttgcaatgtagaatacaccttgcacccccatattaacagtaactttaatcttattgtcagtatcaagataagatgtataaacatagagtggtgttttatcatcacctaattcataatttgttgaatcatcacctaactctttatttattgcatcatctgaagcatcctttatatcatcaaccgcattttgtgcatcatccgcagagttatttaaatcatctagtgtattttggtctggtaaatctataccaggtattgaaccacttgatgtatcagccccgactttggaaaggagaataaaacagaaaaacagcgccactaaaataaggactgttctttttttcatttacgctacctttctagtcgaagcatttttaccttcttgtgtttcaaaaagttttgcaatttcaggaaaaactccatctactgtcattcttgattttcgaccaaaacaatctttataaacacattgcgctcttgtcattgtattcatcatttttcttgattcatctgtcttcggaattttaagataagctaattcttcatcaacttcatttggttcaagaaaggcaaaggtttgaccaaaactagtgctatctttcaacccttcaagctcactcttatctttaaccgattgtgaaacttggaatgtaaaatcattataagagcgaccagttctccgtttttctttcaaaatatgcgcccctcttggtgtagattccaaaaaccacgcttcatcaaataacgtagatgtattttctgatttatctctacgaccaaaccatgtacaaaaatgtcctaaagcatacataatcgctaaggaattaatttgagaatctgtgaattgctcaggtttatctccagcttgtggaagtgaaagcccttgaacttctaaaatagtaatgcgactttccatagagatcgctttattttgaccatttgaaaagataagtgagagaacagagcggtgactattaccaattaaatatttagccaccttagaaattccttcaacttcattgtcttttagatattcaaaaacggaaagtaaaccaaccaattcaccacgtttacgtttttcaaggaacatttcaaccgcatttggaaattccgtgtcaaaatcgatatttcgatatttttcagggataacttgtttaacaagtgttttacttaaatcaactgcttcttgaccagttaaaaatacaatagggtcaagcaccccgtgatttttttcattttccgcatcaaaagtaatgaaattaattttctaaatatatcttacaatcgcttgtttgaaattataagaccaaatttccttttcgcttgcatcatcatcaggaataggtgcatttttgtattcttccatgacctttaaatattgatttcgcatctctgctttagggtcaatatataaatttttagatttcattaaagtcatatacaagaacaacagtttagccaagaaacttttacccgccccagtttcacctgtaacatcagtcgctggattattggttacttttcccaagatgtctttattaacagcaaatggattgacaaaaacaaggttattagaatcagcaagtgcttgcttaaaatctccaccataatttcgacttgaaccatcaacacgacctagatagaaaccgtagtcaaacccaactttttcggtaacaaaaaagaggttctcacagaaactctcaattgacattggctgtatccagtttttatccgttgccagtaaatcactagcaaaagtaagtttatcaagtaaatagggctggtcacccattgctgaagatagctcaacattataagccttcattttctccatcaaatggttttgtttccattcaacctcttctactgattcaccagtaataataagggtcatgagataagaaagaaaaacctcatttgcattatccctttgaataacatctcctaagacttcaactgaagctccaatattatcattttgaattgaatccttttcgtaagcttcaatctgtgtttgttttagtcttcctaaagcacgttcagcctttttcttaatagagttccaaccttttcgtttattaaaataatacttcgtattaacttcaactggaaaaggcatcgtttgaatatactctaccaaatgaaagtaacttacattatttggcaaataagcaatcggaagaacttttacaacactttctccataatcgttacctaaacggcttgtaccatccacaaagtatttcttacgaacttcttcaagattagaaatagagttttccaacatgttgacctcatgttcacgattataatataagccacgtaagtattgataacgattaataaactttgtttgctcaccatttgttggttttgcatccaacgttgacagagtagaggatagcgtatcattaagcccctcatactcttcataccaatcctcaaaaaattgtttttctttcaaatagcccattgcttgcgcttttaattgttcaaacgttgttttaatggtcttaataaggtttgtagaaataaagttattttttaatggaataaccataaaatagcgatattcataaggtgcgcccatttcttcagcaaataaatctaacgtaccatcaaacatatattctgctacttctcttgtatcatctgccaaatcatccgataagacttgataacgagagaacacatcaagattcataggcaaagttaggatttccccattgtgatatggaatgagttcaagaaaagcactatgttgaattgctttcgctgtttcctttgcttgttcatctgtacgagataaattcattgccggaacttcaaacatagcgtacacttgaccattttcttttaacatcaaatttttatgaaatgcgatgatgtcattatattttcgatttttaaacattaatcttcttccacctctctatgatgaactcctttcacccagtaacctttttttctaaaatatataatatatcatgtatattgtggtctaatgggtcgttttttattgcataattgtataaaacgtgtattttatcctctatttggttctaatgggtagctgtgataaaatagaactatgttaaaaaaaatcgaaaaagcttatttatttttagagaagaatttagaagtgctaagatgcccaatttgtcagggaaaatttcaattggaaaccaatgccttgaaatgtcaaaataatcatacctataatttaaataagaaaggttatgtgaattttctacaaaccaaagctgatacagaacattacacgcgaaaaatgtttgagcctcgcagacgtctgattcaagctgggatgtatcaacatttactgacagaaattcaaaaatattttgtcagtggaaatttgcttgatgttgggactggggaagggtcatttttggaactccttaaggtagatggagcaaaatttgcttttgatattgctaaagatgggattgaaatggcgactgaactagagatggaaagttttttaagtttagctgacttgactaatctcccttttgctgatgaaagcctgtcagtaattttgaatatcttcactccgtcaaattatgcagaatttcaccgtgtattagcagaaagtggtttagtcatcaaaattattcctgataaaaattatctgcgagaattgcgtgaagtttatcaacttcccgttgattataataatcagccagttcttgaacgttttagagaagaatttcctaatgccagtcaagaagaaattgaataccaattcgagattccgaaaaatttgcgtcatgattttttactgatgagccctttggaatggtctgtttctgatgaaagaaaaaaatttgctaaagaaaacccaccaaaaacggccacaattcatgtccagattctagtggggagaaaataaaaaagctgtcaatcagacagcttttatttttatttcattaatagtttaattgctttagcaattcctttttttacagaaatataaagaacaagcgaaagaacaaaagaaactggtacagcaatccaacttgtcaacaaacttacaagaatataagtgataaagacgagaaaaattgaaaaaacagcaatatttgcaaagaagtttaattcttcaattcgtttattaacttgtctttgttcacgtccttgagtttcgctataatcataatactcttgtttttcgtaaaaatctttgaggttttttaattccatagttttctagcactttccgatattatgtaattaattatagtataaaaagcaaaggtttacgttgctgtagctttaatgaaattacccttttgttactaaatgatcaaaataaaattaatctataatttttaatgaataaatatactttttacttatcatttttatcagagaatgaatttgaaaaaacctgagcgggaacattatgatataattatcactatgattactattacttctacggcagaaagtttggagcaagccaaagcgttgctcgaagctggagttgaccgtttatacattggtgaaaaaaattatggtttacgcgttccaactgcgttgaccaatgaagaaattcaaaaaattacagaacttgcacatgaagcaggaaaaacagtgactgtcgcagtcaatgctttgatgcacacagagatgatggcaaaaataaaagaatttttagatttcttagtggaaattaaagctgaccgaatcgcagtaggtgatgcaggtgtgatttttgttttacaacgtgacaaatatgagcttccttttacttatgatgcctcaaccatggttgcttctgcccgtcaggttaatttttgggccaatcaaggagcgattgaagcagttcttgctcgtgaattaccaaaagaagaactagcggatatgaccgatgaattagctgtaccaggcgaaatactggtttacggggctactgtgattcatcatagcaaacgtcctttggtacagaattattataattttatcaagacagaagaaaatgggaaagatagagaacgaaatctttttgtttctgaacctaagaaagtcgatactcattattcaatctttgaagacaatcacgggacccatatttttgctaatgatgatttagatatgatgactgaactttcagatttggtggcaatgggctatgatcattggaaattggatggaatttttacacgtggtgaagattttgttgctgtaaccaaactgtttgtcgaggctaaaaacttgattgaaaagggcgagtttacagagctcaaagctttccaacttgatgaagaaatccgaaaaatacacccagcgggtcgtactttatcacatggtttctacgatttggacaaagatgctattaaataaaaaaggctgttatttactgacagctttttttacttataaaaattttactgacaaagattttagactataaaatgacaattctgtcagtaaaagctgaagataaacaacataatgtcaaagaactttgtcacatttgacggtttaaatttggcaagaaatcctgtaaaataaagaaacaaagaagttttggctcgcaaatttactgacaatagatttgactaagaatttttctttttggagccttttcaaaatacttacaatcttgaaaattggagaattgaaacatgtcaattacaaaaacacgtccagaggttcttgcaccagcaggaacgctcgaaaaactaaaagtcgctattgattatggcgcagacgcagtatatattggtggacaagcctacggcttacgttcacgcgcaggtaactttacttttgaagaaatggctgaaggggtcgcttatgcaagtgcccacaatgctaaagtttatgtggcagccaatatggtgacacatgaaggaaatgaaaaaggggcgggcgaatggttccgcacattacgtgacttaggaatttcagcagtcattgtttctgaccctgctttgattgccatctgtgctgctgaagcaccaggtttggctattcacttgtcaacgcaagcgtctgctactaactatgaaaccttagaattctggaaaaatcttgggcttgaacgagtcgttttggcgcgtgaagtctctgtagaagaattaagagaaatccgtcaacatacagatgttgaaattgaagcttttgttcatggagctatgtgtatttcatactcaggacgctgtgtcctgtcaaattatatgagtatgcgtgatgccaaccgcgggggatgttcacaatcttgccgttggaaatatgatttatatgatatgccatttgctggcgagcgcaaatcgattactggtgaagtcactgaagaattttcaatgtcagccgttgatatgtctatgattgaacatatccctgatatgattgaaaatggagttaattcgctcaaaatcgaaggaagaatgaaatcaattcactatgtttcaacagtttctaatgtttataaagcagctattgacgcctatttggaatcaccagaacgttttgaagaaataaaaccagccttagttgatgaattatggaaagtagctcaacgtgaattagacactggcttttattatgggacacctgatgaaaataaacaactctttggggcccgtcgtaaaattcctgagtacaaattcgtcggagaagttgttgactttgatgctgaaacaatggtagctacgattcgccaaagaaatgttatcaccgaaggagaccaaattgaattttatggtccaggattccgccatgttgaaacaatggtcaaaaatcttcgtttagcagaaactgacgaacatattgaccgtgccccaaatccaatgacccttttgcatattgatgttccttttgcagttaaagctggagatatgattcgaaaaaatgggtcagggttgattaacctttatgataaaaaaacaggtcttgctaaaacagtgagagcttaataaaaattaaaagagaatttttgctaaaattctcttttatatctttttaagactgataatttcagaattgtcaaacttctattttttataaaattaaggcaaagtgctataatcaaggaaagaagataaagaaaacaaggcttgactttattttctttaagtagtctttaaaattcattttatacaaaggagtcccgatgataaaagcaattgccttagaaaatgtttggttaaatttttcagatgaaacaaaagcagctttcaagaaaaataaagcttaccagtttcaatttaaaaaagaagaagagctgacagaatcagattttctagaaacagaagtcttagttggtctgccaaagcctgatttattagcaaaatataaaaatttaaaatggctccaacttttatcagctggaaccaatggttatactcaaggagcaaattttcctcaagaggtagttttgacaaatgcaacaggaacttatggacttacgatttctgagcatttactgacaatggctttgatacttctaagaaaatttgacctttatgaaaaacaacaagaaaaagaaatctgggaaaatattggtcagattcaatctatttatggctcaacagtgttggttcatggtttaggtgatattggaagtcattttgcacagaaaattcaagctttgggaggtcatgtcattgcagtcaaacgaactgtttatggtgatgaagaatttgctgatgaagtctatgctgagtctgacctagacaaagttttaccaagagctgatattattgcttcaagtgttcctgggactcatgaaacttataaattatttaatcaagaaaaatttgatttaatgaaagaaaatgctattttcctaaacgttggtcgaggaacaaatgttgatttagaagccttatgtgatgcacttgaggcgaaaaaaattgcgggtgcgggaattgatgtgactgatccagaacctttacctaaaggtcaccgagcttggcagaccccaagactattaatcactcctcatgcttctggtggctatacactccctgaaacatggcgtcgctttatgaaaattttagaaaaaaatcttgaagcctatgcaaatgggaaagatttaacaaatattgttgatatgaaaacaggatataaacgaaatgctcacaaataatatttcaaaatcaaaattaagtggaaaaaatattggtatttattttggaacttttgctcccttacatacggggcatcagcaacaaatctataaatgtgcaagtttgaatgacggagtcttgcttgtcgtttccggttatgataatgaccgtggtgcccaaattggtttgccccttgaaaaacgttttcgttacttgcgtgaagcttttaatgatgaagaaaatattaaagtttcgatgcttaatgaaaatgatttaccagaaatgcctaatggttgggacgaatgggcaaatcgtttatttgaattgattcatcataatacattggaaaaagatttatcagtcactttttatgttggcgaattagaatacgccgcagaattgaagaaacgatttccagctgacggtaatcaatatgctgttgaaattgctgacagacaggatatttcactgtcagccacgcaaatcagagaaaatccacaagaacattggactcacattaatcgtgtctttagacgacatttttccaaagttgtgactgtcatgggttctgcttcaacgggaaaaacaactcttgttagacggttagctcgttccattaatgccccattttcagaagaatatgcaagagaatacgaagaagctttcaatattgacgatgatgaattgaaaatggatgattatgctcgaatgattactggtcaatacgatgccaattctcgcgaagtcaattctcctgccaatcaaggaattgtctttttagatactgacgccattgtgaccagagtttacgctaaattatacttacctaaagaagattttgaacaacttgaacctttgtttagaaaaacaattgcagatgaacgaatggatttaattttagttattccaccaattaccgaatatattgatgacggttttcgccatatggagtgggaagagtcgcgtcatgaattccatgaagaattgatgagtcaattagctgagtttggcctgttggacaaagtggtaattttagatgacgaaggagaccatcgagaccaagagggttacttaacacgttatcatcatgcgattgatgctgttcacgaatataccggtgtaaaaattgaacgattgagttattaattttactgacagctttatttagaaaataaaaagttactgaccaatctatcagtaacttttttagtttttataagagattttcaatattaattaattcttcgtcagtaaattccagacgttctaaagctgcaacattttcaatgatttgttgcggacgacttgccccaatcaaagctgatgtaacagcttgaactttgctagctctttcccgtaaaacccaagctaatgccatttgagctagagattgtccacgactttgagctaaatcattaagggcttgaagttgttccaatctttctgtggtaagactgtcatcatgcaaagtcgcataatgaggatcacgcattcgcgaattttcaggaattccatgcaaatattttcctgttaagagtccttgatacaaaggcttaaaggcaattgttcctatccccgcctctgtcaaagtttcttgtaaatcatcttcaatccatcgatctaacattgaataacgaggctgatgaatcaagagtttaaagcctaacttttcagccgctaagaccgcagcttcggtttctttggcagaataattagacaaacccacataaagtgcttttccactatccagagcagttttcaaagcgcccatggtttcttcaataggggtatttgggtcaggacgatgtgaataaaaaatatcaacgtagtcaagtcctaaacgttcaagcgattggtcaagacttgcaagtaaactttttcgactcccccaattttcataaggaccaggccacatcacataacctgccttagttgagataattaactcatcacgtaatccttgaaagtcctctttcaaaattcgcccgaaattacgctctgccgaaccgggttctggaccatagttatttgctaaatcaaaatgcgtaatccccaaatcaaaagcaatatgaatcatagcacgcgcgttttcaaaatcatcaactgagccaaaattatgccataaaccaagtgagagggctggtagtagtaaaccagaatttccagctggccgataaatcatttggtcataacgagaggggttaggaatataagtcattattttctccttaagaacttttaattatgaagcgatttcatagctattatagcaaatgtaagcgccaaatgttataattttataatagataacccgaataaactaaaaagcgaaacagaagtttcgctttatctatttttgaataatgtttttacttagctttttcgtattctgatattttactgataaatgccgtcccatatttttctaatttgacgggacctacaccagaaatttgtaaaaattggcttgggctatctggaagaacttgtgccatttctttaagggcactatcagaaaaaatcataaacggaggaacgccttcttcttttgcaagttcaagtcgaagcgaacgaatacttgcaaaacactcttcatcaaaatgatgaacaacagtcgccttagattcaataatcaagcttgctcttcgagagactttcacttggcccttgagtacttttagaccttgggctgaaaggagaaggaggggaaattttccagttgtaacattgagataaccctccgcagataaaaagtcgattaattctccgactgtcttttgggagtaatttttcataattccaaaagtggagaggccttcaaaattccatttggcaatatttttatttttagaaccaatcatcacttgtgctacagctgtcttaccaaatcgctcacccattcttaccacgcaagaaagaaccttttgggcatcaacggtgatatcaagaagttctctttcatcaagacaattactacatttcttacagtcttctccttcatcaccaaaatattggagaatatagcgttggaggcaagtttcagcacttgtgtaagcttgcatttgacggagcttttcatattcaagttctttatgtccctcatccccttcaccttgttcaatcaaaaaattacgaattcgcaaatcatttggagaaaagagtaaaattgcatctgattctaagccgtcacgtcctgcacgaccagcttcttgataataactttcaattgttgcgggaatggcatagtgaatcacaaatcgaacatttggtttgttaattcccatcccaaaagcattggttgcaaccattattggcacttcgtcaaatagaaaaagctcttggttcatttgacgttctcgctcgctcagcccagcatgataacgaacggctttaaaatgattatggttgagccactcacaaatttcttcaacttctttacgggtgctggcgtagataattccagcagactcactctcctgatttttaagataatttttaagaaaagttcttttatccatccctttaaccacttcaaaacggaggttttctcgaagaaatccagttttgatggtgtggctgggggatatagagagcaaggattggatatcgtcggcaacctttggagtcgcagtagcagtgagagctaagacggtgggccgtgtaggtaaatctttgagatgagctgcaaaatcgacataactaggtctgaaatcatgcccccattgcgaaatacagtgggcttcatcgatggcaactaagtcaattggaagtttttgtaagaaattattgaaataatctaatgaaaaacgttcgggcgcaacaaaaagaagcttaatttcaccattttctacttgtcgcattctttgataagattcaccttcttcaagagtagagttgataaaagttgctgggattccagcgatattaagttggtcaacctgatctttcattagactgataagtggtgagattaccagtgtgagcccagattggataacggctggtagttgataacaaattgattttccagctccagtaggcaaaatgccaagagtagcttgtcctgctaagacttgttcaataatttgtttttgaccatttcggaaataatcataaccgaatatttcttttagttttatttctaaattcattctttctatattatacgtaaaagagagggaaaaatcacagatgaatcttaaaaaatttaaagaaaaactggtataaaaattacttaaatagaaataagatattttattggtcaaaaatatttttttgctactttaatgatacaaaatgaggtgaaaagtgttagaataaattaaaaagaatgtgtttacaaaaatataatatatagaggagactttcttatgaaagcagcagtagtacggcaaaatccggatggctatgcggatgttgttgaaaaagaacttcggatgattaagcccaatgaatctttactcgacatggaatattgtggagtctgtcatacagacttgcatgtagcagcaggcgattatggcaacaaagctggaacggtccttggtcatgaaggaatcggtattgtcaaagaaattggtagtgaagtcacttccttaaaagttggagatcgcgtgtcagtcgcttggtttttcgaaggatgtgggcattgcgaatactgtgtttctggtaatgaaactttttgtcgagaggtcaaaaatgctggttattcagttgacggtggaatggccgaacaagcgattgtaacagctgattatgcggtaaaagttccagagggacttgatcctattgaagcaagttcaatcacttgtgctggagttacgacttacaaagcaatcaaggtttctggagttaagccaaggagattggcaagtcatctttggtgccggtggactaggtaatctagctattcaatacgctaaaaatgtttttggggcaaaagtaattgcagttgatattaatcaagataaattggacctagctaaaaaaattggtgcagatgtgattatcaattctggtgaagtcaatccaattgatgaaataaaaaaaatcactggtggtttaggagcacaaagtgctgttgtttgcgccgttgcaagaatagcatttgaacaagcagtcgcttctttgaaaccaatgggtaaaatgtttgcggtggcactgcctaataccgaaatgactttgtctgttctgacagttgtttttgatggtgtggaagttgctggctcacttgttggaacaagacttgatttagcagaagcatttcaatttggtgctgaaggtaaagtcaaaccaattgttgcgacacgcaagcttgaataaatcaatgagattattgatgaaatgaaagcaggaaaaattgaaggccggatggtcattgattttactaaataaaataaaaagaggcgatacagatgaattcaaaggatttagtcaactattcaagtgatgaatttaacaatctttcgcaatttcaacaagaagaaattacaaacaattttaaggaagcgattttgtacaagatgaaggaaaagaaattgcacattgatgaggtaagtgagaaggttggatactcatctcgtaagctttctgcactcctttattcggatacagtgagctatgaaactcatgcagaattgcagagaatccttgccgttgttaattcttttgcttagttaaaggataaaagagaaaaacgactcaatttcgagtcgtttttctctagttaatttactgatagaacttctgtcagtaaattagagatatttttgagcagcaggactatctccgatataaggttcacgtttcccgtccttcaattggaacatatccgcgccttttccagcgataatgacagcatcatcagaattttgagttttactgatagcttttttaattgcaaattcacggtccaattcaaagtccagctcacgactaacaaatgaagcaatctcgtcagcaattgttttgggattttctcggtttgaatcgtccgttgttaagattacatttagacggggatgattttcaatgacttgtccgaaatctttacggcgactttctcctttatttccagttgaaccaagaactaagaaaagctgaccagcatgatggtcttcaacaacttcaacgagattttctaacgataaaccattatgggcatagtcaatgtaaatgtgtgccccatttttggcggtgagtaattccattcttcctggaacgatagctgaagccaaaccttgacgaatattttcaaaagaagcaccaagtgctttggttgctaatgctgtagccaaggcgttttcttggttgaatcgtcctaacaagcgaatatcaaattctccactgacagagccgtcagtaacaaaatgaagtccttttgattctataattttattttcagaatctgcaccatagaaagcatgaggaattttccgttcattgagttcttctttaatgattgcaaagtggttcatttcggcattggcaacaaaataacgtgaatttttaagaagttgacgtttgcagtaaaaataatcttcaagagttgggtgctcaactggaccgatgtggtcaggagaaatatttaagaaaacaccaacatcaaaagttaaaccataaactcgttcagtcttgtaagcttggcttgaaacttccattactaaatgtgtcattccattttccagagcttttgccatcatttccaataaatcaagactttcaggtgttgtcagttctgatttgaaataattttgtccatcaagagtcgtttgggcagttgataaaagggcagttttacctccattcattttatcaagaatggatttagcaaagtaagcagaagttgtttttcctttggtcccagttaaggcaagggtttttaatttattttgagggaatttataaaagttagcggcaattagagccattgctcttttaacatcggttacgataattgctggaagagctacttcataatcaaattctgaaacataaaaagcagcttctaaatctgtcagatactcctttttaaaatttaaacccttggcaaaaaaaagggtgtctttagttgattttcgtgaatcataagagagctggtcaaagtttacttcttttggccaattgaaataatattcgccagcagaagaaatctcacgaaagttattatctttttttagtatttctacaacttgttcgagtttaatcatgtgaggaatgcctatttatcgcgaagcgtgcgatacctttctaaaagcaaggaactaagggaaaaatcccattaccctatattatagcataagcaaagacctgacgcatgtcccatttatttacttgatagtaatagatgacatcgtgaattaatgatctaaaattattcttttattgtcaaaatacagaacttagggtaaaatggaacaatggaagattcagaaaaaataatgaatacgggtcagcagtcaccaaaaacggctgcaaaatcaaaagatcagatgctctcgggtgctgcttggcggactggtgcagatatgattgggaaaattttaggtgtcatctatattattccttggtatgcttggatgggacgttttggtaatgaagctaactccctctttagcatgggatataacatctatgcccttttccttttgatttcaacagtgggaattccagcggcaatcgcgcgtgaagtggcgcgttacaataccttggatgaccccaatatagcctatcgtctggtacgccaaatgctcggagtcatgttagttctagggattattgcttcaggactaatgttctttctcgccggtccactatcgacactcgttggagggaaagatagcgcagacttgattccagtcatgaaaagtcttgccttagcggtcttgatttttccttcgatgtccgttattcggggatatttccaagggttaaatcaagtgaaagcttacgctatgagtcagcttttagagcaaattgttcgggtcatttggatgttggcggcgacttttgctatcatgaaattaggttcacataactggcaaaatgctgtgacgcaatccactttagctgcttttatcgggatgttaggttcctatgctgtcttattttattacttacaaaaatcgggaaatcttaataaattaatcaatccaggtcctgtaaagtctaaaataaatgctttagaaattttaagatcaaccctacataccgctattccgtttattgtcattggctcagctattcaaattttcaaaattattgataactcaactttcatgaatatgatgccttgggtaacaaattatagtcataatgagttacttgttttgatgagttatttctcggccaatacagataaattgaccatggttttattgggcgtggctttgacgctaggttctgtatcagacccattgattacagaacattatgttcagggaaatcggcgtgagcttgcaacattggtcggttataatttccaattatatgttggctttatgcttccggccgtgattggaatgtcactgttgaccaaaccaatttatacaattttttaccaaattccttctggtttgcaaagtagcttgtttgtctttgctatcttacaaactttcttattgggactttatatgattgtctatcctccgctgacggtaatggatcataaacgtttggcaatgcgaatcttcacattgactcttgttatcaaattagttttacaagttccgatgattcttattttccatacttatggacctttacttgcgacaacgatttccttcttaattggcgttttcttgttcatcagaaaattacacgaattaactcatttttcaattaagaatacaattcgtggaattcagggggcagctttactgacaggatttatggcgattgtggtaattattgttgaagttattttaggatttatcttcggtaagagcccagggcgtattgcgtcagtatttattgcggcgatagccggtggtgcaggtttttatacttatctctggtttgctgccaaactaggacttttagagaagtggtttggtccaagaggattatctctccgtcgaaaactacatatttaacaaaaaataagtctgtcagtaaaatatttgctgacagacttattagtaaatgctaaaaaaggataaaaaatggctgaaattaccgaaaatacaaaaaagattttagaagtcattctcaatctaaaagaaggagaagtgatgagctaccgagatgtggcacacttggctggcctttcaaatggggctcgacaggtttcgagagttttgcactccatgtccaaaaaatatggacttccttggtgacgtgtagtccgttcagaccgaacaattggacttccagaacctgctaaaagtgaacaaatggaacttttgaaaaaagaaggagtttcatttacagctcaaggaaaaatagttatcgaagatgaactgctttgataaataaaaaaagtacttctagatgatgtgaaccccaaaagctagactttttagacaagaataatttcttgtctttttttttgttattttgaataagttaaacgatattggattggactcatccagttcaattttttcttaattcgtttcgtgttgtaatagtgaatccatttagtaattataggaacagcgtaagttgggagacgaagttcgaatagggatgggacagtctcctaattcagaaaattatactgatgatcctaatgggcgctaaaaatgcgaagacctattttgtattagtcaaacaaaagatccaaaagaaatggtatatgattatgaccatgaaacaaagtaaaatcaaaccgagtgatctgaggaagcacccgatgatcatgaaacgttattagacacaaaagtcacccatgtgagttcttgccagaagctgaagttaatccttcaacctggaaaacccgcagaggtgactttttctatacatctcgatttttctgccaataatcattaaccgataaatatgtctgtgaatcacccagcgactccgctatgtccataatccgcggtggtagtaatcccactcgctggacaagttcgtgatcgctgaacaattcccgtggactgccggcgaagccaaacttcccgtgttccataacatacaccgactcaaactcggcggcgacccaatccatgtcatgggtgatggtcacaacttggtggcccgaatcagccaactgatggaaaattgcggtcaacttgcgccggctttcccaatcaagcgacatcatcggctcatcaaataaataaatcgccggatccactgccaaaactgtggcaacgctcaacagcttgcgttccgacaatgacaggtcatatggattttcagctgttttatcatccaagccaactctttttagagccgctaaagcccgcctcgtaatcgtgtcgtggtcatccatgacctgcgcgacattccactccacctctcgttgaacggtcgggttgaaaagctgatcgtcaggattctgaaaagtaatcccaaccttcagtaacttttcgactggtttaagatcattaaaattttctccatcgatcttaatcacaccggtttgtggtgtcagcaagcccgtcaacaatttgaagagcgttgatttgccggcaccattttggccgacaatcgccaccatcggatcggcgaagtgtttgtcttcaacatccaagctaaaggaccgttccggataagtgaacgtcaggtggttcagttcaattgtgggcataacgatcctccttcagctcagcgtcattcaccggataccgtccatcagccaagtgccaatccattttttgagcaagttgctggattgtcggggctggaatctgccagtcagctgccaaatgattaaacacctcacccggcctgccctgggctaccatttgaccctcgtgcagaacccacacaacgtcggcgacttcgcacaaatcgtcaatttcactggtgacaatgaagacagtcgtctctttgacttgggccagccattggaaaaattgccggcggccaaggggatccatctcactggtcggatcatccataatcaaaatagccggattagccgcaatcgccgtggcaattgccaaccgctggatctgaccaccggaaaggctctcgggacgcaaattcagctgttcaatcagccccatttgcgtggcaacttcttcaacccgtttttgaatcagtccttcagccattccctgattaatcaagtcaaaggcgatttcatcggcaaccgtgtctgccaacccgcttagttggccagctggattttgcagtacaactccattcatggcattataaacgggccaattgtcggacactcgctggccaaacatgtgccagtcgccctcaatctcagcagacacaattttgggaatgacccctgccagcacacggcacaaagtcgatttgccggagtggctattcccgataatcccaaccacctggccggtatgaacctccgcgttaatctgacgcagttgtggttgctcagtacccggataacgggtggtcaaattttcaattacaatccgtttatcttcgtccatatcttccacccaatcaataaaattgccaatccagtcagaccaatgtgcagcgtccgcgacaggcgatacacgcgctgggaggttctgacagtccggttgagattatcaaaacctctcagttggagagaaatcgaccgcgccatcgcttgatccaaggtcttaatcaccaatggaatcagaaccggcaggactgactttaatttctgaatcaacgttttttgcggattggttccgcgaactttttgtgcctgctggattttccgcatattgcgcatcatttccggcaaaatataacacaccgatatcagaacgtagacggttttataagacaatccggacagttccaaataggccgcgttttctgaaatactcgtggtcaccataaaaaagccactggtcaaaataatcaccaatactcgacaacccagagtggtggcgtaaatcaggccttctttgtagaacgacaccccaagcacagaaaacagcacagtttgattccgactgtaaaataacccttggatgatcagcatggtgccaatcagaaacaggctgaatcccagcgccttaaaggtggtcgaactcaatttggaaaataacaatagcagtgttgcgacaagaattaatccggcctgaagcaataaattcgtactggcaaagctcaacaacgtcatgtccaagatgaacaagagcttagtaatcggatcgatcacctggtaccacttgagcttgacccgtggcgctccagaaatcaatgtttgatcagtcatcaattatcattcctaaagaagtgcaccatccgctgcggcagctgacgatagatgaagaatgccaggtaggccacgcagactttatccaaaatatccaagacaaactcatcggtaaatgaggccagccacactggtgcatgattggcgaccattaccgcaaacaatgagtcaccccaagcgataccggtctgaccaccccaaaagatgacgttgagtggcgttgaaatgacagctgaaacgatggcaataataatagcagaaacaaatactcgtcgcgctgacgagaaccacccattggcgtgcaaaactccgacagcaatcccaattccgatgctggtaatcgcatacacggttgaaattggcgataaggtcagcccatagatcacgttgttgatgaaaccactgatggcaccggcaaccggcccagccaacatgctggcaagaaaggttcccaaagaccccagccaaacgggcagctttaacccctccgccaaggctttggcaacatagttaatccccacggcagcgggaatcaaagtcatggtggcagcacttaacttaaatttccacataccggtacgatgaatcggttctgttttcataatcttctcctttggttttattatacccgaattgctagttaatttcattggaaaataaataaataaataatttaattatttacttattttcttgaaaggaatatatgatatatggttcaacagattgttttacctatcaaagattcaaatatcttacaaatggtgcaggatacactacttgatagttttcgtgctggtcgtatacccccccatttttccaaattccaaatttttttcaaaaattttccagcgctaccgctcggcaaaattgcaagcaattttaaaaccatgagggaatttcattccctcaaactcccttgggcctcctccgaccgaaataaggggcgctacgcttattatttcattcaattatcggctttcataatctaacagacaacatcttcactgcaaagccacgctacgataacgcctgttttaacgattatgccgataactgaatgaaataaacgctaaaagctcttagaaacgattttaagcactttacagacgttttgaataatttctaagtaaaaatccccgcctggttagtcaaaatcgcttaaaacgcaaaatatgacgttctagaactattcaaaacaaaaagaggactaaacaaaaaagtttagtcctctttttgttttcctcatcagtcttctcgatgacaggagcagtcagattgaaaatctgaaatatattcaaattattttcctaagggcgcacttatataccatgaaaatcatggtatataagtgccaatattttagattaaacgtgttggaaaaactcgctttgctcctgtaaataaaaacgttataaagtatcatagcgagcttagtaagtggatatccacttacggtaaaaagggttctgttgcgaagtcaaagatttatacgaagatgtcttaaaagaatttgaaattaagctctaatttttttcaaaaagggggattgggggacaccaccaaaaataaaaagattcgtctgaaacgaacaaaaataaaattggaaattttaggttttgtgagtgaaagatgaatattttttactgtaagtgtgtacacacttacgaagttcactaaagacactaaccccctattttgagcttttagagtttacagatatttgtgaggttgacaagatgaaaaaaatcaaaaatcgtgagagaattattcaaaaaaaattcttcgtaaatgaaaaagaagacgaaagaattaaattgatgatgagaaaaactggcatagataatttttctatttttgcaagacgagcttgttgcaataaagagattttttctattgatttttcagaatataaaaatattattactgaaatttctgcgacaaaatctgaactaaaacgtatcggaaataatatcaatcaaatggctaaacatttaaacgaaaataaaaataatcagacaaaagaattgatgtctgattatcaaaagcaattagaaaatttggaagaaaaaattcaagaagtggttcattatatttcggagggctagaaaaaatgacagtgatttatatgccgaaacaatcgaacggaacggaacagttcataacttaacagttttgacctatttttagcatgcagatgaatagtgaggttagagcaggtcataaataacggtcatatttaaaagctaaaattgtacgctttagtcaattacatacaagcctatttaagggctttttcttttatccatgataattattactaactcacgtttaaaatcgcttaaaaggcaaactatgagcttgtaggactattcaaagtgtttagactaaacaaagtagccacgaccgttagggagttctttttagtgtcagaatgtatctaatataaaatcagagtgtacaagcggagcgacaagagcaacgcagggagtttaaatttagaacctcaattcaatggttttgactttttcttttgaccttgattttaatttttgaaaaaaataaaaaaaggcgaagcctatattaatttatcatatatattttaatcttttgttcttttgcgtgggaaaaaagtcagtaatagtgaggagttacaaaatttaatgtgtacaaaaatcgatgtatatgtgtacaaaaatcgatgtatatgtgtacaaaaatcgatgtatatgtgtacaaaatattatgaaagtacacttattgtgatataataaaaacatagagaaaaaactttgacgaggaatttctctatgccacaaataaaacacgcaaaggagcgtattgatatgtccattataccaaataacaacgattttaacgagaaaaaggtggtatgtaccttgaatgaccttgaaaaaagaaaagtggtggagcataacgctttaattcaaagcgtagcgaaaatgcaaaagaccgctctcaaaatgtttgagttagcggtatcttgcattgatacggataaaatacctgaaaataatacggtatatctttcaaagaaagaattattctctttctttgaagtatcctctagtagcaagcatagtcaattcaaagaagcgattgagtttatgcagaagcaagcctactttaaaatcaagtccaataaagcattaggtattgagtatgaaagtattgtgcctattccttatgtaaaatggaacgattataatgatgaagtgcttattcgtttcagtcctgaaattatgccttatctgattaacttaaaagcagaatttactcaatataaaatttcagaactacaaaagctcaatagcaagtatagtattattttgtaccgttggttagctatgaattataaccaatacgagcattacagcgtgaagggcggacggagagccgaacaagtagaagcctaccgcaatccctcaatatcggttaaagaattgcgagcgataacggatacagctaaagaatataaagattttagaaactttgaaaaacgagtattaaaaaatgccattgaagaaattaacgaacacacgtcctttaacgtaacttatgagaaaaagaaagcagggcggagcattgactctattgtctttcatattgagaagaaacgcatggcagacgataacagttacaagttggacgatagggcttatcaagaagataaaaagcaaaaatcaagaaatgaagctgacttactaaaacaggcaatggaaagcaagtacacacggttattgttggataatatgctattaagtccttatgaaatgaccgatacgtcacttatggcaggattgcaggcacacgtgtaccctctctatgacgagctgaaagccttacgagggttgaatggggtcaaagaccacctctcttatgtgagagctaaacaagaagcctattcaaaacgcaatatagctaagtatctcaaaaaagccattgaacaatacctgccaactgtaaaattacaagaccttgaacaaccagaacgtgcaaaggttcgaggtaaaggtgcaagccatgagtgagaacttaaaaacgattaaagaactggcggacgagctaggactagctaaacagaccgttcaataccatttaaagtttttgccgaccgaaaatcgacaaaaaaacaatagtggttcaatcgtcctaaaccttgaagaacaaaagtttatcaaaaaaagactaacaaaaataaaaaaaattcaaccgaccgaaaatcgacaaaaaaccgaccgaaaatcgacaaaaaaaaatgaagaattaagcgttaatagtcttttgttagaacaaattaaagacttgaaaaataatagagataagcaattagaaaacaaagataaacagctattacaaatgcaaaatttgctagaccagcaacaacgattagccttgcaagataaaaagttgctagaagcatacaaggcggaaaatgataacttaaaagccctcaaaatgccctcacaggaaacagaattcaagcatacttataggaattaaaaactgtgttaaaaagtagaatataataatttattggtataataattttaataggagatttttttatggtaaaaacatattatacagatatagtaaaacttagaaaaaaagttcagagtaagcaaatgcggctatttgatttgttaagagtaaaatattcgaaagacaacaaacgtaaagaacagattttgaatgatacaataattagtaaatactattttgatactttagataaaaatatttttaccgaaaatttttctaattattttgataatcaatatttttattatagagaaaaaagtgatttggaaactgagttaatatggaattgtttgattttaaaaaaattttcggctgagctgagtaagtataatgcttatagattgaaatatgaaaaatatctctttaaagatgattttaataatgctaaaatccaacttgaacaaatagaaacagagtttggggtttctttgtggttagtagaaaacaaaatgttactccaagaattctattctgaaaatagtaagatgaatatagaaaatattacaaaggaatattcgaaagaaggtaccaattttcaaaagtatttaatggataaaatttcagagaggataaccgatgatttttcattcgataagtatagtaaaagaacctcgatggagatagaaaatagtaaattaccatttgagataaagctattttgcgtgtactggttagattatcataattttccgatagatgatgaagcattgtccagtgttcttgtaatatcgtttaatactagtctaatagatagatataatttaactattagaatattacaacaattaatagcagaaaaaaagcatgagaaattattaaataattgtctaagactactttctgatataaaagatttaaggatagataaaattaatgcaatatacatgaaagataatgaactattacaattatctaaaactgatcaattgtttaatagtgttttagatgagtacactataggaaactatcagacagctttagaaaaactacctgaagtatttgaacaaaatgcaggggcttttaaaattcttgatatatataataagtcattattactttcagatttaataccgaataaaacaaaggagatttttaaagccaactttttaaaagaaatttctaatgcttattttgaagttctcacaaagtctgaattatattttgaatcaatcaaaaagattttagtttttagtagaaaattaggtgcaaatgattgggcaatacagatgtattattcaatatatacacaatttaataatgttaacttaaaggaaaaagaaacgtatatatttttaaacagtccaataaatacagttaacgatgcaatttttataattaatgataatgcaaggaaaaattacatacttcaatttgggagcgattcgaatacacttagattgtggaaattttataatacaaatgagattgaatttgatttaaaagatattccatattatcggatattgacttatgaagcgaaaagagaacagaagataaaaagaacaggttttcaatctcttactaaacgactagatgatgagataaagaaaatatcgagtatagataaatcaagagagttatcttctctaaattatttcaaagaaaaaatgcgacacgagctttacagtatgttgttagctgatgaaaattatactgattcagtagatttggttgtcgaaaattatctcgaaaattcaataaatttacgaatgtttaatacagaatctttactaaatgaaatcgaaaaaggaacaaaaaataaattgattacttcaaaaattgaaactttaatttttatgaagcttgaggattctagtaaattaagttacttctttgaattatttttagattgtaaaaatataaacaaaccaactgaattaattatagaagatttttcggttgataaggtaatattcttttttgaagaagtttgtaatataggagtactgtcggaccaagttttaatatttgatagacatgaagaagttgaaattgagcgcttaaatatattaagaaaattgattggtataaatccatcagatgaacgaatttatacagaagaaattagtagaatttctcaagataaacttttgagagagctaattcaaaaagtgaatcaaagtaaattatttgttgatgttaaccgtatttgggaagaaaagaaagactcaattatagaatctatccataaatttttagaagctgatactcaaaaaatgagatattataatcttaataaaaaagaagtattattggaagatatgggtaaatcagataatgaaggaatattttattttatatttgaaactccaaaagaaaaagagttacggaatgtgttaaatgaaattttagattttttcttatcaaataacgaatatggtttggatacttatttaagtactaggattagacatggaaccttacaaggtcaattgagaagtccttttcaaaagaataatttgattaccactagaaaaagtgataaatcagatgaatatatcgcaaatgatattatgctaaaaagaattaacggaaatgccaaatctatcaataaaattttctctgatttttcgtataaaattgatagtcttattgaagacgtgaaaaagaattggatgcaaataaagataaatggaaaaaacccacagggaatgtttgactttgatgatttagatttgagttttgaagaactgtatagcaatgttagttctgaaagtagccctaaaattatatttgagttgattattcaacatttgtgggatgaaactgaaaagagtctagaaagaatacgagaaagattaaaaaaagaattatgtgatcagtttattgaattactgactaaattgcaagaggatttggcgaatgagcaaacaggaaataatacttttgtaaacagaaaaatatcagagtgtaaaacagatgtacaattatctattgatgaagtatctagttggtttgaaagagtggacccaagtgatgatatgaaggttacttcatttgaattattggaactttgtaaacgaatacgagtgaatatttcaccagaatttagtaacgtgaactttgtttcaaatggggacgaacaaatattattaagtggaagagaattaccttactacgtagatatccttcttattttaatcgataattcaataaagcatagttcattagaactagaagagcttaacgttgaaatgtatattgagaatacagaaaatgggaatattaaaattacagtaagtaacaattttaataataatattttgaatgagattaatgaatctatcgaagttataaaaaataagctatcttcttcaaaaaaacaatctagtgaattagtaaaagttgaaggtggttcaggttatttaaaaatatataaggtaattaaatatgatttagaagcaaaaccaataattgatgtttctcaaaaggataacattttttttagtcagatagagattggtaggtaatttagtatgaatctattattaattgaggatgataataataaaagcaagcaaataattaattctattcaagaagcttattttaataatgtaaatatatctgaagcacattcatttcaaaaaggtatgaaaaaaatacgtactgaaaattataactgtttacttttagatatgacacttccaacatatgatatagaaactaatcatagtggtggaactacaaaaaaattcggtggaattgaaattttggaagagatgaaaatgagggagatatatttaaaaactataattattacgcaatttgatacctttggagaaggaaaaaatttaataacaattaaagaattaagggaacagttgaaaagagattttagtgaaaattttgaagagattatttattataactcatcattaactacttggagagataaattgattaagattctagatagatatagcaaaggggtaaaaaattgaaagtacttattgtagaagatgattcatctaaagtaactgagatttcaaaaatattaagagaatttgaaggaagaattgatgaagatgttgtcttagatataaaaaatgctacagaaaaattacaaaaaaataaatatgatttgttaattttagatataaatctacctaatcgtttaggagaatctccgattgaaggtaatggagcaagtttactagatagaattaagaataatgaaaaatttttagaaccttcatatgtagttggattaactgcatatgaagatgagtggcgtaattcagatgatatttttaaaagtaattttactgaattaataagatatgatattagttcagaacaatggaaagataatttaagaagaaaaatagagaggtttctttctaaagaaaatactattttctttcatagagaagaatataattatgattatgctattatcactgctcttagaaatccagaattagaagcatttcttcaaatatgtactgaacgtgaagagattaatatacctggagatccagctagttatttcaaagtctcttttggagacaaaaatcaaaaaatcttattagcaaccaatgatactatgggaatgattgcgtcaagtcatttgtcagaaaaagtaattcaaagttttagaccaagatttttattgatgggtggtattgcagcaggtatagaaggaagatcaaattttggagatgtccttgttgcaaatacttcttggaattatgaaagtggaaagtatattgaaagcaatggtaaatctttatttgaaccaagttttaaacagattaatataaatgttaacctagaaaaaatactaaaaaaagaggttcctgatgaaatatttagttcattccaacgttggggagataaggggcactctaaagttagtgttaagttaggaccaattgcttcaggctcctcagtggtttctgatacaaagataactgaaagaataaaatcttctgagagaaagttaattggagtagagatggaaatttttggaatgtattattctgctactaactcatcagatttaaaacctacttttttagcagctaagagtgtttgtgactatgcaaataataaaaaaagtgatgactttcaagaatatgcagcgaaaactagtgccgcatatataaagtatttgatatgtgataatgttatttcagatttaaataattaaaatctgaagtaggactctaaaaatcaatactaaattaaataccatttaggtgaatatcatattatcaagattaactaaaatgaagtgatgtgaactatcttcatgtagttggatatgaaaaccaagctttcacgaaaaattagtctttttcggaaacttatttcaagcgaaaaacctatggttgagccattcacagattatgagtaataaaaaagggctaaaaaccgcctaatatggcaagtttatgagaaaatgagagtgtttttaatcgaaatacctggtatatttttatagaaaatatgatttgtttatcttcaaaatttatgttatttttagagagtcttaaacaaaagcaaaaaacattctgatttcacacacgattcgtcagagtgttttttctttgttaaataaacgagatgacaaaaaaacgaagttgtgataaaataaaggtaaagaaaaaggacttgcgtcaacaagtccaatgtagccgttttaagaacggtagcaaatatcaaatcaatttatgaccgatagctctgctaagctgaacggtcattttttattacttgtatttataacaagaatcatcaaggtagcaaatgctatcatgagactcaatgcctgaaatacagtcaaaaaatttacgcctttcatgttttgtgaggaattgccactaaaaccatggcatcacctccaattgggctaccgttcataaactctacaaatatcattataacaaaaaaagccctgtaagccaaagacttacaggactttttaaataggtaaattattaaataaggaaacttcattttttccatttttgtattctcaatgatttattttgggtcttgatttttgtatttgaggtactcattaaaagtacatttcttatattttgatgaatactttttgtaggtatagaaaaaatcaaaaaacttaatgaattcaccaaatatttcatcttctctgttctcaaatttggtaaagtcttccccagtttctgggtctttacagtctctaaaataccagccataactagtaaaaagcggtttttttatttattatttcatcgttgggaaaagcaaaacgtcacggattgaagttgtgccagtaaagagcatgactaagcggtcaatcccgataccgagtccacctgttggtggcataccgtgttcgagtgcttcaacgtaatcgtaatcgacaccagtcgcttcatcatccccaagttctttagctttggcttgagcttcaaaacgttccaattggtcaattgggtcattcaattcgctgaaagcattggcgtattctttaccgttgatgaaaagttcaaaacggtcagtaaaacgtgggtctttctcgttcattttagcaagtggtgaaatttcttttggatgaccaaaaacgaaagtaggttgaatcaaagtttcttcaacatatttttcaaagaattcgttaatgatgtgaccaacagaagtgaaatgtttttcaacatgaatatcatgttcttttgcaagagctgttgcttcttcaaaagtcatctcaggccagaaatcaactccagcaacttccttgatggcatcaaccatgtgaacacgtttgaattttccaccaacattgatttctttaccatcgtattcaagaacatcttgaccaactacagttttagcaacgtgttggaagattccttctgtcaaatccatgatatcttcaaaatcagcataagcttcataagattccattgttgtgaattcaggattatgagtcatatccattccttcattacggaagacacgaccaagttcataaactttttccattccaccaacaatcaaacgtttcaagtgcaattcagttgcaatacgaagcgccatgtcaatatcaaggctattatggtgagtgtagaatgggcgagcagaagcaccaccagcttcgttgttaagaactggagtttcaacttcaagatatccacgaccatccatataacgacggatttcactgataatttttgagcgagtcacaaagcgattaaagctttctttatttgaaattaaatccaaataacgtttgcgataacgtgtttcagtatcagtcaaaccatggaatttttcaggcaaaggacgaagcgcttttgagaggaaagtcaatttttttgctttaattgacaattcacccatatcagttttcatgatttcgccttcaactccgaggaagtctccgaggtcagcttttttgaaaatttcataattttcttcaccaacttcgtctttacgaacgtaaagttgaatttggccttcgcggtcttgaagatgggcgaaaccgactttacctttaccacgtttagtcatcaaacgaccagcgacaattcctgaaagtgcaagttcatgcaactcttctttcgtcttttcgtcataagcttcgtgtagttcttgcgagttgtgcgtacgtgtaaatttatgtccaaatgggtcaattcctgcatcgcgcaggtttcccattttttcacggcggactttcatttggtcattaagttcttcgatttcagccaaaatagtactccttgtaattttttattctctctattttaacatattttcaaaaaattaacagaatttttttgtcagtaaacgctttaagcataggcttaaactgatttttttgctgtcattaaaaaatacttacaaaattactgacagaccttgagaaatttgtgattacttttaaataatttttgtcagtgatttttttagaattcacttaaatttttaatttgtttaatcacagttttgagcaatttatcttgctcggccaagaaagaaacaccataaaaaatgcggtgataacgtttgtcaagactttgaaaagcaatgttttcattaataaatcgtttggaaattaatgacgcaccaattccagcattgagttggctgacaatcatatcattattattgacgctgactaagtttttcggattaagattattttctttaagataattatgcgtatagtgagccaccccggaccccgcttcacgaataaaaaaaatatcattttcaggcttgccagcaagaacgagctcgtctttaaagagtggaaaagtttcgatggtttcatccatcatcggtttttcaataattccaaaatgaatttcatgattacgaattaaatcaaaaacctcttgagaatcaagcatcatcagttcaatattaagttgttcaagttcaggaattaaatttttgaaaatcagagggagaacagtagttgctgaactatgagaagcagcaattttaaaaggtttacgactaggcgtctgattttttaaaggaaaattgtaattcattccaatcattgagcgtttttaaagctttaggataaagaagatgggcactttctgtaggaattacttcttggtgttgccctcttgaaaagagttgaacctttagttcttcctctaattttttaattctaacagttgcggttggctgtgaaataaaacattgactagcagctctggtaaagcttttggtttcaaacacagcaataaaagtttcgagtaaagcgaacataaatcttcctttaattaataaaagtaattttaaaaatgataataatttattttacaaaataaaggagattgtgtaaactaattgatgctagacaatttaaaaaggaaaaagtagaaaaatgttaaaattaaaaaattatattaaaaatgatagacaggccatcatgagtattttgccaggatttctgatctcctttgccattgctatagtaagttatttactcaatcgttttatcttccatagtttaggttcagcaactattgcaatattattaggaattattttgggtaatgtgtactttaaacaagtcactttgtttgcaggaacggcttggtcagaaaaaaaacttctagagttttcagtgatgtttttaggggcaaccgtaacctttcaaaccattggtaaattagggttctccggagtaggatttattctgatacaaatgatttcaacaattatttttgttttatttatggggaaaaaactgggcttttctgctaatgtctctgccctaatggcttctgggaatgcagtttgtggttcatcagcaattgccgcagttgaaccagttattggagctgagaccagtgagaaaagaacatcgattgccatggtcaatcttatgggaactattttaatgctgagtcttccatttttaggaacttggatatttggtaataatgatttattaaggggcgcactgattggcggaacagaacaatctgttggacaagtcgttgcttcagcgacaatggtaaatccaaacacaacaacattagcaaccctatttaaaattatgagaattatcatgcttgtttttgtcgttttatattttggttttagaagcaaaaaacaaacaaagggtgaacaagcaactgctcaaatcaaaattaaaagaaattcttttttgccatggtacgttgttggtttcttagtgctttgtactttagatacattgattcattttgtaccagaagtttcagctaccgcaaaatttctatcaggttggtgtgaaacgattgccttagccgctattggtttgcgactaaatttagttgaattcataaaagcaggaagaaaattactgatttatggttcatctatcttagtttttcaagtagtacttgcaattattttgataagtcttttaatcaaataatcagaaatcaaagaaataaaaagtcactaaatttctgttttagtgactttttttatggtaattattaccatcagctaaatttttcactttagcaagaagcttattaatcaatctgattcactaatgttaaaccagattaatccccaaagtgaagcaatgactaaaaagagtagagcgaccattttattttcctttactgctgtaaaacctaactagattatttaatagattctatgacttctttaagttgattgacagacttttcaaattgtttcatttcataagcatccatattgagttcaataatttctctgacaccattttgatttacgacagatggaacaccagtaaagaccccttcttgaccatattctccacgcaaataggcagaaactggtagaatgacttgttcattatttaagatggctttgacaattctagctgtactcattccgattccgtaataagtggcttgttttttatcaataatttcataagcagcatttttaaccttatttgataaattagacaaatcttcaagaccaatttttttatttttaacaataaattcaagaataggttttccacctaccgtcgtgtgtgaccaaactgcaacttcagaatcgccatgttcgccaataatatatccgtgaacactccgtggatcaatttccagctttgtggctaattcctttctaaaacgtgtggtatccaaagttgtaccagttccgacaattctagattggtcaagaccagaagtttcccaagcgacataggtaaggatatccacaggattagaagcaattacaaaaataccatcaaaacctgaatccataacttgagtaacgattgagcgcataattttagcatttgtattgaccaaatctaaacgtgattgtccaggtttttggttcacaccagctgtaatcacgacaatatctgcattttcacaatccttgtaatttccagctcttacaataacattttctttagcccaagatatgccatccaataaatctaaagcctcaccctcagctttatcttgattgacatctatcaaaactaactcgttgataagccctcgattaatcattgaataagcaatacttgttccgacaaatcctgttccaatcacgactacttttctacttgtaattttcatttttatctccttttcgattttttattaatcaatattttttctatatttttataaaacctatctgttaaaaatccatagataactaatcatagtgcataaaattaaaatgatagaaatcacaaaactaatgattataaaagccaattctagtccccttttaaagtaattttctgatgtcctttataaaatctattattattttatctatatttttgcaatgtgtaaaatgaatttattttatcgttatgattaaaaaaataataaaaacaaaaaagcagaagcagcttgcttctgtttcttatttttattatttctaacgaatttcggtttctttttttattttattaattaatttttgaatcacggggtctttttcttcatcaaaagaaactcctaaaaactctctatgataattacttccaagttcttgataagggatatcatcagataaaaaggatttagaaatcaaagaagaacctaaaccagatttgatatgggaaataatcatctcattactattcatacgaacaatgtttcttctagaagaaggagcagatttgagatatcttttgatataatatccaattcctgaaccagattctctggtaaagaaagtttctgaatctgtatttccagcaaggaccaactcatctaaaaacaaaggaaaggtttcggtttgatcactaatgagtaatcgttcaatgattccaaaatgcaaatcatgatttgcaactaattcaaatactttttctgagtcatacatattaatttctacatccaattgttccaactcatcttcaaatactttaaaaattcttggcataatacttaaagcagcactatgtgaaactccgattttgaaaggatgttttgcaagagatttcttttgtacctccgcttggtcttcctcccatttttttagataggcaatcgctttgggataaaataatattgcggcttcagtcggaatgatttcttggtgttttccccttagaaataatgttgattttaattcttcttcaagttttttgattctcacggttacagtaggttgtgaaataaataaatattttccggctaaggtaaaacttttagtttcataaacaacgataaaagtctcaaataatgaaaacatctgattttatccttaaaacatggcattaacaaattattttttttaattcatatgattataataatttattttacaaattaattcaactattaaggttaatgatattggtaattggatttgtaaagtaagaaagcagggcattaaaagtaatcaattgtccgagcgtaattttttgacttattactaatgtggcaccaaaccataaaatggtgacactcaatgttagttgtataattgctttaattaagccttgaatagcttctgatttttgtaaagtgaaagccttttttagataacttgcaaattcgtagtcaattttttgatatctttcttgttcactggcaagtgcctttatagtttcaatcccattgatatcttcaataattgaggagtttaagacggcattggtctgcatgacttcatggttttgtttttcaaaaaggggcgtaaaaataataataacaacaatatagagtgggattgccaaaagaacgagaagaaagagttgcatattttgaaggcctaaaattagtcctgtcatgacgacaatcgtcaaatctaaaaagagcgaaagaatcgttgaggcaatagcatctaaaatagaactcgcatcggaaaaccgactggtaatttctcctgttcttcgggtcgaaaagaaagacatgggaagttggaaaatgtgtctaatataagaaagaatgacatcaatagctaatctttgagaaagaacgttcaataagaaggccttagcaaattctaagacctgttggataatataggttaacaatagccctactgagataatccctaaagttcccattaaggcatttggaatatagctgtcaatcatgctctggaggtagtaagagcctagaatattaatcagtgttacaatgaatgaggcaataacaatattgagaatgactttcttttgacgggtgataattgggataaaagataataatgaggaagctttttctttagtgggatgataagatggtgtagtcgaaagaaataaactaatcccagtccattccgataaaaaagcttcttttgataattttgtcattttaatggttgggtcaggatcagcaatgaataccgaatttttatttgcgccagtgatcacataataatgtgggtatttttggtctttaatgacatgagcaataaatgggtaaggagcgtttttcatttcaaaaaggcttgcatctgttcttagggcctgaactgaaaactctaatatttcagctgccttttttatccctaaagcggaggttccttcgattgttgtacctgcaagtaagcgcaatgaagcgagagatttttctgtgccataagactttaaaatcattgataaggcagcacagccacagtccatttcatctacttgtgaggtataatttttctttttaaatttcatcttttcttaactttctgagttaaaattttagtaaatcactggaaccaataatattgtttgcggttcagttacagagaatttcaataaatctattttagtttaaaatcgaagaaaaagatagtgaaaataataaggacttagtagtttaaacctagataaatgaaaataatattacttactgcctcttttttattaaaattaagtagtatagatgccaaaaaagcacttgttataattatataccaagccttataatcgagattataattagaaacacttacaccataagatattaaaatagtaaaagcgacaatgactgactcattatcgctttttttatcaaaagaaaaagttaaaactaagtttattgaaaagactaatttttccgaaacttatgaaaaaatatcttattttactatttgggctttctcttagaaaatactttgggattatatagagttggtcctttaactttacttttttttataattcttcttttatcctgacgatacaccatccgacaaaaaccacaatagtcttggtagccttcagtgtattttgctttagcccaaaattcagagtcacaattcttacaaatcttctttttgggcttttttgtatagacagttcggctttgtaatgagcttcctgttattcctctcatttttacctctctaatatataatatttctatgccatagttctagctctagttaattattcaatgatttctttcataattgctcaacatatctgaccttctacatatcacgttatataataatttgaaaagtgagatttataggatatcctgttgtcttgttcaaatcacaatataaatcagtcctacctaactcattatgagtaatttcatttctgatataattgattgtgtttactattaattcaatgaggtaatgaaatctaaagacttatttctctattgcatcgttaaatatgtatcctgatttttcaagctgtgttaatttaggagctacatgcttttcaataactttgctattgtcttgagtggaaccagtattctggtcaacctgttctttataaactgtgtattctcgttcattaggaatcgcttcaaattgtaaaaacatgtggttatccaaaacgttatttgcagataatacagataaatattgctcttctggcatggcatcaaggacttcccaaagggattcttcccaattatccaatttaaaaaacaatgagttttgtgataaatatgtcaggaaataaaaatcttttcgtttactaagactatacatattagaagttatacttaactttgtatagtaattactcaatgatttgaaccctattttcagatatctattgaaaaaaaacagtttctgagaaatatcaaagtctttttcttccaaaatagagtcccattgctttatactattttgctcattattaaatgagtttagaatttcatcagatgctcttatctcactatttctaatttgaataactttttggattaatgaattagtttgatattctttaacttttttcaatgttaagttaaatatatgctccttccttttttcttcgataaaataataattattctgtaaataggtgtaaaaatccatatttattgaatccctagtaaattcttgctcaattttttcatcatcgtttacaatagcctctgcttcctcagtagataaattaaaaacaaattcatataagaaatatgattctggattacttttaaagcaaggtggataatcattattatattccaacaaatttgtgataatttcactaatagtttgttctttactaacactttgcctaccattgttctctctactacgaagtctattaagtacatcaggatggaacagactaatatatataataaccaactgttgttctacctgaactcctccttttttctttcgttcaaaaaactcctgattcactaacatattaaattgaacttgatctctcaaatttcttttttctttaacaaacaatctttttaattcttctgaaatatcagtattgaactcctccgatatttttttaaaatagttttcccatatatttactggttctagtgctaatggtaagtcaactcgttggtcaattattttaaataaataacttccttcaaatttactaattttttgaaagtttcctacaaacaaaattggcaacctaccttttaatgtgttaaacattttataaatatcctcctgtctttcagcaggtattctatcaaagtcatctattataagaatttttttctttataaatttagtaggtaattttttaaaagccaagtaataaaagtcgtctgattggtatttgaatattttccaaacagccacaaataaagctatcattccaaaagtgcttaataaccaatcaggtaatcctctacttaaacctaaattaattgcaggagtcattaaaattgatactacaacagaaaaaatgacaaaaaactttgaagtataagaaataaatggatgaaccttaagaaaagcaatattaattggactccttttatctgtttgttcccaaaattttaaaaatataaattttcctttagctaattgtttttcagtacgatttaaatattccgtctttcctgttccccattctccattcagaaatatagttctatattctgtttttccatctatttttttttctccatctttgagtttttttttcattattatttttgccagattttcctcggctattgttgtttcaattgtggttatttctatcaatatttaatctacctttttttacttttttgcatttaagcctgcaacgttgtagctacttgctattttttaataataatgcaactataaacaatcaaattgcactactacttttctaaatctcgtattatatcattcaaaataactgcaatctcttgatttgaggcattatttggaataatgatttgaactgatttacctttattttctcctgtaattagcgagtaattggtacgattaattgtagtctgtcctacacctgaatcactactaatcaaggtagtaatttcttctttggctttatcgaggtttataactgacaattggttacccaaaagcctttgtaacgatttggacaagctgtgaactttaagagtagttagtagttgaacttttcttagatgtggaacatgaactgacatcttctcatcataataatagtcgcttttaatttcataaactgccactgtaccgttattatctggtacaaagacaatatctcctatttgcatttcattaacaaatcgaatgaaatatcctgctcttctacctaatgcagcgttatccgcagctggataatcgttctcaatgaataactgcttaagttcatctggcttaatccctttttccagtttacctatccgtggccaacctaagccaacaaccgaggcatttaaaaatacattgtagtgtggaacattatcagggaatgctctcaagagccaaaaatgtttttcgttcatatcaatttctccttaagaagtgttatagtgtagtagtatttcttcctttactactcacgtaatcttataatactactacttttactacttgtcaagaaaaacattaaaatattttatctgataagaaatactaaagttttaaccattttactattttttctgatattttatgttgatttttagttgttttcggtatataatattgtataaactgataaaaggtactacatatactactggaggggcaaatggataaacaagaattaaatcatttttttgactactcacttgaacctcgcagagctatcctttttgaagatgtgaaatcaaattacgcctctattgaatgcgttcaacgcaacctcaatcccttaactacttctctctgcgtcatgagtagagctgacaactctaaggggttaacacttgcctctagcccaacctttaagaaagtctttggaatgaaaaatgtcagtcgtgccagcgatttaccttttcttataggaacaaggaagttcaattatccgcaatggtatcgaacacatacagatattcatggacagcgaactgaaccaactttacaatatgtagctttcattgaatcttgggcgaaacgaacatggattgtaccaccacaaatgcaattatatgtagattataaaattgaagttacagatatactgacaaattatacgtcaattgatgagattcactcttactcgattgatgaatctttcttagacattactgaatcacttaactttttttatcctggtattaaaaatcgctatgtgcaaatgaatctgattgcattagatttgcaacgagaaatactagataaactagggctttatgtgaccgtaggaatgggtgacaatccattgcttgccaaacttgcaatggataactatgccaaacataacccaaatatgagggcattaattcgttatgaggacgtgccaaacaaactttggactcttccaaaaatgactgacttttgggggattggtaagcggactgagaaacgattaaacaagctaggaatcacttctatcaaagagcttgcgaatgctgaccctcttttgttgaagcaaaaattaggaacaattggacttcagcattttttccatgcgaacggaatcgatgaaagcaacgtaagagaaaaatatactcctaaatcaacaagcttcagtaattctcaaattctactttttgtttattaagatgtgaaatcacaatatgagtttcttgaaaattgtaatttttccgaaaaacataaactagccccaaaatttaaatataatttaaagattatatcacctttatgtggcttcatctaaatcgcattacttcttcacaaaaaaagacacctgtagctatgtctttttcataaatctatttttaaatatttaatatacccttcagggaatcccattttatacggtaaaacaatttcactattatcaagtttctctttaattgaatcaataaaggcattccattctaactgaatactattatcatggcaaatcaaaacattcttgatagctaacataaacgcaaataaatcacggttatcactcttctttttgtttgtatcttttaattctcttaaagtaactgtataaaatcttggattaccaatgttaaaatttaatccatatactctactataatgagcacatcgatttcttaatgcccaactagcagtaatccatgaatgagcaacgtttttaatatgctggtctaatccttttactccattataatatgaatttttcaggaataagtcggatatccacatttctcgatactcatcttttaaactttcaatgaaatgtgttgtttccccaaatgtaagttcaggaagaataacccacaaagggatatgtccgtttctattatctatatgatgtttaatagttaaggcttggttacttatgaatgctctcctaccgaaatgtcttattgtatcttcagcaatttcttcatttttataaataaatgggtctaaataacattgagctttttgaagttcaccactataatttgaacaaagtgagttaataatacttgctttaactaaattttcaatatagccagtaaatttttgtaaactatttcttaaaaacgaatcaaactcatagacttcaacgcaatctcgaaagtcaaaaatttggttatccctcactggcaaagtttttttataaatagaaaatgcgtaataattatgatttaacaaaaaagcttctgcttcctttttattttcttcgtttacaactacacttgctttattaaattcactaggattttttagttcagatactatactatcaaaattcatgaatgatttcatagtattttctctatcaatttccagacaatagtattctttctgggtgtcttctgtgctcgtatttatcataaattttagccctatatacaaaaaaagactctacatctttagaattttgcaattccagggaagtgtgagagttcgtgtacgattattatatcagggttcaattcaaatgtaaatagataagcttactagataataacactaaattctgctaattttcctaataatactatatatggatgacaataaatattatttatcaatatattgtgttttattttataaaaccacgcattgttactttttgtttacaattgcatatctaccgttgtcatatacacctgaaaaccctcaaacaatttttttaatattataccggttctgttgcgaagtctgaaactcaaaaacactatctctgaccaaccgtcaatctaagcaggtattcccattaatattttgatttcagtagaaactgaaaagccgaagagtgtcccatttcttcggttctttttatatattcctcgaatggtctccatccccttaatcgtggttgaggcagtccggagacttcgataaaatttattccgtcgcttaattggcctatgatcttgttctattaaattgttcagatacttcacagttcgatgctctgttttggtgtataatccgtttctctgtaactttctaaatgcagatcctatagagggtgctttatctgttacgatgactctaggttgtccaaattgtttatggagtcgctttaagaaagcatacgccgcctgagtatctcgtttctttcgtaaccagatatccaatgttaaaccatctgcatcgatggctcgatacaaataatgccattttcctttaattttgatgtacgtttcatccattttccatgaataaaaggattttttctttttctttttccaaatttgatagagtagtttgccatattcttgcacccaacgataaatcttcgtatgagaaacgttaatgccacgatcatataagatttcttgaacttcacgatagctaaggttataacgaagatagtagcccacggctacaataatcacatcctgctgaaattgctttcctttaaaatgattcatcgtcattcctcctgctatctttttctattattctaccttatttgatagtagatttaaaactttgcaacagaacccccttaaccccctccatttcgcagcataaaaataaaagtggatagcaatttgctatccacttttatttttatgctgcttttatttctctgaattagaaaaaaatgagcatacccataattttgtaaaaactaatctataataaattccagttactactcaaatttgatgtctatttactttcaaagtttgaccacccatacggagaacctccagtacctggattaactagcattctcttccgagactcttcaagaaaataaagaacaggagaagagtgcaccagatactgcaaactagaaattagttcactaatttgagcatcaaaatctcgccctctttcaatatctctttttgctattacaaaaagttttttttcttcttttgagatagtattattgattattatgttatcaataatatttaataactctttttggttatcttttaaatttgggtaaaagtatttcgtcattctttattaaccttatttgttatgttgagtttttttgtgtcattctacattgacacaaaacctatatttcgactatcactgtcttttctcaaaaattactaaatcaacaatcatagtggcttaaattagaataaatagtaaaattaatcatttggagttccaccgttgccgtaaggattgtgattattagcatgaaagtttcccaaaccgctgtgtccatttagccatctaagaacatcattcgcactgtagttataacctccacttgtttgcattagttcttcttcggtgagttctttgaagttgtcaaaaattggttgttcaaaatctgagttatttttcattacttaatctcctttaatttatataatttcattatattccttaaattttcataatgcaaacgattacctttgatggatctgtgtacgtaaagaggtataatttttctttttaaatttcatatatttttattttttaaaccaaccttttaataagtcgctaaaaccagcgctatgcttatccgtttcttctttttgtttgcgtaattcagggttttgatattccgtttgagtgacggcgcttggcattggttcaggctcgtcagatttccaaaattgagcaatctgttcttcttttttgcggtcaatttcgtattgattatttttttcggttctgttgcaaagttttaaataaagaataaaatcccttacggtatctatgatttaagctgggattcccaataataccttgatttcagtacagaccgaaaacccgaagagagtgccttcttttcgggttttcttatataatcctcggatggcttccatgcctttaatcgtgggtgaggcagtgcgtaaacttcgatagaatttattgcgtctctttactggacgatggtcttgttcaatcaaattattcaggtatttaatggtacgatgttctgtcccttgataaaagccgttttgatagagtagtttgccatattcttgcacccaacgataaatcgtagtatgacaaacatttattccacgatcatataacaaatcctgaacttcacgatagcttagattgtaacgcaaataataacccacagctacaattatcacatctttttggaattatgttattagaatgattgcagcgctttttggacaaggatattaagtaaaaaaatgtatttataaaattctgaaaaaagttgtattttcaaattattttgagtatactgttgttattaaatataaaggagattttataaatggaaaatcaattgaattttgaagttgtttaaaataaagatcttatgactattaatggtggtcaaaacatgagtatgaatgatggtattagcacttggtttcgtgttgtatagaatggttggaaaaaaatgattaaaaatcattggatgaaaaaactaaaatatcttagtttattctttttattatttgctatttattggtttcctgatgtaatcttagcttatccagaggtgtacttaaagtctctcgtaggatatgagagacaagtagtggctacttggatttttttagggaatatgtcaatttctctttttctaggaattttaatttgttataaattgggatattacaaaaatacaatatctatttttaaaataaaaaatcttctatttttactgattacaacaattattttatttgttatatatttttttagctatacctattacaattctcattttataacacctggaattgctaaaacacaggcagctttttcaatacaaattgtatttccttttgttcaatttattactattgctatttgtgcaccaatttttgaagaagcatcttttcggacaactatatacagttttttcaaaaatgataaaatcgcatatattgtgtcatgtgtaggatttgcatggatgcatacaggccctaatcctatcctcattgtttatttaccgatgtcaatagtcttaacatctatttatcatcgaagaagagtattaggggaaagtatattagttcatggggtgtttaatgctttattaccaatagttattcctcttcttcaagtaataactgggttatattatttataatataaaaaagcctaataggtttttttgaacgctcgaagagcgtttcttcttattttaagtttccatttttaaaaaattcctatctcttaagtatttgcaccgtccataaatgaacataaaataaatgggttggcaaaagatgactaaattttgaagtagctttacaaacccatatttttcattttaaaaagtcttaagtagtttatcgtaagtaaacattcaaaacggataaaaacatcacactgagcctaatataatcccttccggggtatttcaacgaatacttacgttttttcaagactgtcgtatgattttttgtaataaggaatacccacggagcaacaaacacttacaggaggaatgacgattgaaatattttgtgaccactttatctccatcaaaaaatatgggaacaatgaattggcaaacgatgatattgagtgattattgtgtcaatgattcttattgggagaaggcaaaacgagaattatcagaagaagttcaatgggtgacacaaagtgacctttataaaaagataaagcggaatcatgattcgaacgatgagattatattatcaaaaccagtaagtatcattttagaaacggtaaaatcagattttcctcatgccaatgtctgggtttatcaataaaaaattattggactaatgtcaaatatttagacacaaaatgagatacatcttcttagcccaatgttctttgatattttagtgttcagattcgggtctgtaaaaagaaattttgtatggtaaaagtttccataagtcactatggaatcattattatttccttttttagtgtaaccatttgataaaacttgaagaaaactatcaaaaatcggaattttatccccaactttactaacatgaatcggaatttttgctttttttaatttttccacaaaactaatgttggttaattctcccggactgatccagatttctcttatttttattttatcagctaaggacaagaaatcgccaacatggtcagcatctgtatgagtcagaataagttggtcaatatgagccacccccatggattctaaataagggataagcgttttgtcagcatttgattgcatctgcgctttttgccaatttttttgaggaagagcaagtcgtcccccagtatcaatcagaatgttttctttattaaacttatcttgtagaaaaatactatctccttgtccgatatcaactgctgtaatgcttgctctcattggatttttagtgatgaaaaaaataaaaatataaatccaattaaaaaaaatctcctttttttatgagaaaatgaatctacgaataaaccaattaacacaaatagaataattaattcgagtgaactaggtttccccaaaacaaaggggtaatgtaagggtaaatcaactttataaactagccattctagaatttgaaaaatataatttaaattgagcgaaaatcccaaaaatgatataagaaaacagcataaaagcagcgggagcaacataaaatcaaaaagaaaaccaaatataattgttaataatattgaaagaggctgaaaaatatggaaatcaaagatgagtaacggaagaacacaaagtgaaaggactgatgattctgtcagcacttttttcaatccatttaaattagaaaaaggatgattaagcatcgaaatgacaaaagcataaaacaaggtaagctgaccaccagtcgtcagtaaaaattttggacttatgagcatcaaaactaatgtcgtaactgcgatattatccaaagaagtcagacgaatatttttttgaaaaagggctcttaaaactgaaaccgataatcccgtcataaaagcataaaaaatagaaaatggaatttgaacaagattcactctttctctcgtcagtcccatgcgaagaagtattttacgaaaccaatcaataaaaaaatttacttgcattcctgatagagcaaaaagatgaataattcctaaagagctgtaaatatcgctcatctgattaaaatccttacttaaaaagccaaaaagcaaacccgtcatatagtcactcatcggttttggaaaatgattttgtgtccaaacaattgcctttcgccttaaagtatgaaggtcaaaattcttttttatttccacatttgtaatttgttggatggtaatctgtcgatagatattttgactagttaaatatttttggtcatcaaaaccattaaaatttcgctgagtttctggtatttcaaggtttcctgtgaaacttaactgacaattttgacttaagttctgataaaaccctttctcttttagacttttcaatgtgtcatagacttgatatttttgtccattcattctcccctgaaaactcaataaatcaccattgacttggattgtatctggaattaattcaatttttgagagattttttggttgattttcattatccctaatactaagactattgattaacagaaaaaatacagcaaaaacaattaatatcggaatcattagataatattttctgaataaagctagtaaaattgagcaaataaataaaataagcaagggtaaattgtaagtaaagatacaaaaataaagtagcacaacaagataagttagaaaaatcaggggaaatttaatcaatagaaatctcatctttcaatttttctaatgttttatccccaaagccagatactttacccaaatcctctattgatttaaagtcaccatttttcatgcgaaaatcaataatatcttgcgctttttttgaccaattccagtcagtttttgtaattctgtcaggtctgctttattgatatttatttttggaccacttgtcgttgaaacttgattactgacagagctgctaataggactgtcagtactttctgaacttgaactttccccaagttttggtacataaatcacttcttcatctttaagtttcgctgacagattgattgatttttggtctgcttggtcagtaaatcctcccgcttgcctaattaaatcaacaaggcgctcatctgacgaaatttggtatacattaggttttgcaaccgctcctttcaaatcaaccataatttcgtttttatttttttcactgctgctattaaatttactgacagagcttttggtagaactagagctcaaattttctactgacagattttcagcttgctttggtgaattggtgaaaatatataaaaattccaccagcaataagtgcacaaacaactaaaagcattattttccagtattcttttaatttatctaaaattttttccatacttttatatacgaaaaaactcttgaaaagtttccaagagttaaattattaatgtttttatttaaaaatgaaccggtaagccaagataattagaataattaagataacaagagccagtcttaatggtgaattgcgtcgccaaggatttttcttttctccattttcactgaccactttgtcagcattttttcgctttgcctgtcttcctgtcagtcctttaaagagttgactcataatcttctcatcgctataagaaagcacattacgcgcataaattttctctccagccttagctattgccagattggctagtaactgtaagccaagagcaatccaggcttctgtagtggttgagtattggatggctaaacgactagtcatcaaagttggactaataaaaggtataaaactaagcacttttaaaacaatatttccaggtacagttgagcctgcaataccaccaatgtatccaatcatcgctaaaaaggcaattggctgagtagcttgttgaacttgggcttgttcattcactaaagaagccacaattgaagcaagaataagataacccaaaattccaaccaatgacatcgcgactaaataaattccaaaaccaaaggtaatgcctgaaagcatttcaccaattgctttgatttggtctaaatttctgatgaatggataagcaactccaaatccgagaacgtaaattccaagctgagtggtcagaagtaaaataacaccgataattttcccataatactgcacatttgagcttgttgccgcaagtaaagtctccataatccggcttgatttctcattaccaatttcttgccctataattcccacatacatcatcatcaatgtgaaaattaaaatcgaagcaattgaaccaatggcaatatttgccccagtctgagaatttcctgttgatttttgcccagaacttgtctgagttttcatcgtaaatttagctggactgagcaattcttgaacatcagccgcagatagatttaaacgctgagctgtctttgatatattaacttgagttagtgctgcttgaaaacttgtttggtcaaatttgacacttgatttattgtccgtaacaatggtgtaagccccatcttcaacagtcaaaaacccatcaatcctcccttcagaaagctcatttttagcctcctttaaagaagattcatttttaatatcagcttttaaactctcatttttagaaagaatttgagttaaagcaggattatccacgaccgccaattgtggggtttgattggccccgctactgatgaccaaaccaataactaagtagactgctcctaataaaaaaggagaaagaacgagagcccaaaaaccaactcctttgatgcgactacgataaatattttttgcaacaagccaagtttgatttttcatttcgccaccccacttttcgcgcttaggtcttcttgatcatgctcagccacttccattcggaaaatttcatcaagggagggaggggattgaacaaaggcttgaacatagccatctttggctactttttgaaaaatttcacgaccaacatttgcttcagaaattttaatcgaacggccactccctcttttttcaattgactcaactcctgaaatcaaggagagttcatcatttgataggtccgactccaaataaacacgggtccgaccataagaagctctgatatcttcaactgtaccattcaatatcgtttgcccaccttttagcatcagcaagtggtcagataagagctcaacatcactcatattatgattagagaaaataactgctgctcccttatcacgacttcgcttaatttcatttcgcaaaagttctgtatttacaggatcaagtcctgtgaatggttcgtctaaaatcaaaaattcaggttcatgaatcaaggttgcgataaattgaattttttgggcattcccttttgagagcgtctgaactttatccattggttttccaacaacttctaagcgtttcatccaatcttgaagttttagacgtgcatctgcccgtttcatcccatgtagttcggcaaaataaaggatttgatcctctaccgtcattttttgatagagacctcgctcttcgggtaaaaaaccaattttttgtttaatttcttgatttatcgggccatctttccaagtaattcttccttggtcagctgatataaaattaagaatcatccgaaaagttgttgttttacctgcaccattttgaccaattaagcccataacttcgcctggtttaaccaccatattgagattgtcaacagcaattttgtctccaaagcttttgcgaactttgtcaatctttaatgtcataattttccttacacttccctttttttctaattatatcattttattttcacttttcacctacttttctttgaataggtaagacaaaaatttattaattttgtctttttattttaccgttttcatttgatttctcaccccattaaaacacaagactaaaagtagcagactagccaagaaagccggaagagccgaattataattactcattccccaaagtaagccacgcccctgtgctatatagactccagtattaattaagtcaagtaaaaatacaaaacttagaaaaagccataatacttttaatattttcattctccgaatttttatgccaagtctccagatacgaaaactagtaaaagaaatgagcagacttccaaaaagataaatgagctcaatagtttgaagccagtaaaagtgctgagtttctaagagaaagcccagaagggtcagtagtcctgcaaaaatcaggattgggataaaaatggaccagataaatttgttcattttttcttcctttctaatgaaccctcgtttgataaagcgtctcaatggttgtcagtaaataaacaaaaacttttggaagtgtcctgaactgtgctattataagtcatataagtcgtgcgctttctaatgcttagtgctttaagattaggatagcacgacttatttattttccaatgaaattaactagcaattcgggtataattttaaaaacagttaaccaaaatttgattatagggttactatttgatatgataccagtataataaaaaaatcttttattgtaaaatataaaattaggagtaacaacatgactaacaatcagaaagtcaaaacattaacttattcagcctttatgactgcttttattattatcttgggatttttaccaggaattccaattggttttattccagtttcaatcattcttcagaatatggggataatgatggcaggggggcttcttggccctaaatatggtacaatttcggtaggtgcttttcttgctttagctttaattggtttacctgttctgacaggagggaatggtggtgcggctagtttcttagggccttcaggtggttatcgaatagcctggctctttaccccatttttaattggctttttcctaaagaaattaaaaattacgacttcccaaaattggtttggagagttaataattgttttattatttggggttatttttgtggattttgttggtgcaatctggctatcttttcaatctaatattccactattaacttctttaatttctaacttagtttttattccaggagactgtatcaaagccattttaacggtcgtcatcgttcgacgtcttagaaagcaaggaggttttgaactttattttagaaagtgatagttatgcaaacaacaaaacaatttgtcttgttagaacttcttcggcaaaaaggaaattgggtttcaggagatgaattagcagaagagctaaatattagtcgtgaaagtatttggaaagcaatcaatactttaaaacgtaaaggaaatcagattgtcagccgaaaaaatttaggatataagtatattggcaatgaatcattagacgaagatacgataaatttttatagtggaatgaaatttgaaaatgatattttcgtttttgatgaagtgacttctacacaggaagtggcaaaacaatatttgacgactcatgaggtcaaacagccgcttgtttttgttgcgaataatcaatctcaaggacatgggaggcgcggtcgaaaattttattcgccaagtgatactggactatattttagtcttattttacctaatcccagccatgatattttgaaaataggtttattgactacaagtactgctgttgccgtggtcaaagtacttgaaaaattttatgaggataaaaactttaagttaaagtgggttaatgatatttatctagatacttataaagtgggaggtattatcacagaagcggctttagatttagaatcgagttctgctagcaattttattatgggaattggcttaaatttggcaactaaggaatttccagatgagttattaggaaaagtgaaaggaattaatcccaatataaatatagaccggaatcaattgattgcagaaatggctcaggaagtaattgctaatttttcaaattatactcacccgaacttgattgaagaatatcgcaagcgctctttattagtcggaaaagaggttactttgaaattaggaacgagttctgtcaaaggagaagtacaaggaattgctgatgacggaagtttagtactcaaaggggattcaggaaagctacaatctttcacgagtggtgaggttataaaagttgattggtaagagaagtaggagatatactattggaaaaaatttggggaaaagtggtagatgatgagggaagatgcagtcattaccatcaagaaaatgatattgttgcattaaaatgttctggctgtgaaaaatatttttcatgttatgaatgtcatgacgaactagaaaatcatcaatttgtggctactgaaaaagaagattttccagtactttgtggtcattgtaaaacaaggctgaattttaatgattattcacaaggttattgtatcaattgtaaagctgtctttaatccaaattgtcatcgccattggaaaatttattttaaatcataaattcttttttttataaaatttatcaaaggtcaagttattcttgaagttttaataaattttaaattaataacaaaggatataggccgataaaatgaagtctaaacaaagtgtataatctagatttttgcacattgttccatttaaaaaatggtataatctgcaaaactgttatatataaaatactttttaacttatggaaaactttaaggaaaatgaaaatgttatttactgaattagcaagagaaaagtcagcaaaatattgggaaatgagttttgaacacccttttatcgaaggtttagtgacggggaacttatcttctgatgttttccgatattacttacttcaagatcgctattatttagagcactttagtaagctctatctttatattgcggaaaaaactgaggataaaatgattcgagaacatttaaaattaaatgcagaagaattaaaagaaggtgaaatattcattcgagaaggtttttttagggacttagacattaccgagcaagaaatttcagaaaccgctattgctccaactgcttatcattatgtttctcatatgtatcgtcagctcgttgatggtacggttaatacggctattgctggaatgttgccttgcgcttggctttatcatgagattggacttcgtttgattgataggggttcttctaacgccttataccaacgatggattgaaacatacgcgagtgaagaggctgcggcacaaatcgaaaaagagtgtgccattatcaatcaactttatcaagaaagtaatgagtcagaacgtgaaaaaatgcttgaagcttttgtgattagcagtaagatggaatacgaattttgggaaatgtcgatgaacttagaaaaatggtaatttttcgggaataagtgagaaatatcgatatgacttataatgtaaaaaaaacattaattttatttcagttatttcttgcaaacggatacacaaaatgttagaatatgtttatccttataggaaaacgtttacctttaagtcatggttacgttactaagctatagcgagtagcttaatttctttcagatccctcctagtcagggggattttttattttgtgaaatataaaattttaagatgattatctcgtcaaaataatgaatctattgagtcaagatgttcacttgaaaataattcgcttttaagtgagaaaaagcttgtcactgttatctttagatgttataatttattgtggtgcaaaattttatatgctagttaggagaagtagtggaacattcagctactcagcgcgaatcccaaaaaatctggacggccattaaaaactggtttctagtggacaaagtttttctgatttcgtttattattgcaattattgccattagtttgggtggagtgacaactcgttttttcaattatcatgtcattgttacggtttcaggattgatgcttgtcattggtggttttaaggaaacaggattgttacagtatttgggacagaccttagtcaaaagaagtacaacaacgcgtcagcttgttcgatttacgacgctacttaccttctttttagccgttttttttacaaacgatttaacaattttgacggttttaccgctctatttagcgattactaaagaaattaaaaatcgaaaatcagtttatattggggcagctttaattgttccagcttgtcatatcggttctgccttgcttccgcaaggaaatccgcataatctctatctttattcgttttataaggtagcggcacatcatggtggtgttcctctgacaaatttagactttttcaaaggaactggggctttatggattttaggtttattgattttgatgattgcttgtcaattcatcgataatgagcctttggttattgaaactaaagtgaatcaatttaataaagttgaaacttctatcttcgttgttttgatgttgttaatggcagcttctgtttttggttatgtgaatttttatcttgctggagcagtcgttgctctagttgtgctaatttatcgtccgcgactttttaaaggaattgattatcatcttttatttacttttatctttttctttttgattgtgggtaatatcgctaatattcatgtgttgactgattttatcagtaataccttagttggaccacaggcttcttttttaggaaccgtgattatgagccagtttatttctaatattgcggcccccatcttgatttcgccatttactccccatgctgtttctttggtccttggagctgatattggtgggattggaacaattgtttcctctatggcaacactgattgcttataaggtgattcggatgaatgcgcggggcgaaacacgtggtttcgtaaaatattttacaattgtcaatgccggatttgtcctaattttaacactgattggtttgattattgtgacacttgttggttaaaatgtaaaagttggactttccaactttttttatttttcaaaaaattaaaagttactgacaggtctcgtagtcacttttatttatttttaagatttattatctagcgatgtgagaagttctgtcattagttaataattggtgtataatagataaaaactataaaggggataagatggagtttagactagcaaaaaaagctgatgctcagcgacttttagagatttatagaccatatgttgaaaaaatagccattacttttgagtacgaagtgcccacactagaagaatttgaaaatcgaattgaaaaaattgggagtcaatttccatatcttttagcgattgaaaatggtaaaatcattggttatgcctatgcaggggcctaccgtgaacgggcggcttatgattgggtggtcgaattatcaatttatttagatgaaaaagagcgacaacatggagctggaagtgtcctttatcaaaagttactgacagccttagcggcactcaattatcagcgggcctatgcttgtatcacttatccaaatcctgctagtgtcgctttccatgagaaatttggatttcaacaaattggacttttccccaaggctggttataagtttgaacaatggtatggaattgtttggttagaattagcactacaaaaatctgacgagataaaggctacaaaattactgacagatttatcagaagaggaaataaaaaaaatcttggaataatgaccgatatttggctatctttattttctagttgcttatctttaacaaataactgttgttctagtattttaactacagataaatcaccagttgtggggttactagtatcggttaccttgtcgttaccagttgcgttactagtggtaaagtgttgttttaacaacatatatccagtataggttactactaaagttttcaccccgttactagtaatggtttccacatggtttgctctaaattcttcggttaatcttttcctgaccgcttgtttcgatacgttaaattcgtctgcaagctccttaatagtttttaaattctcactcatgataattcctgccttttaaccgtaggtagatattgctcgattgcttttttcagatacttcgctacattgcgtttagaataggcttcttgtttgctagatacataagacaagtggtctttgaccccatttaatcctcgtaagtcttttaactcgtcataaagcggataaacattcttctgtaagcctgccattgttttaatatccataaaatcatttgggaaaagtaacatattttcagatagtagcttagtataagggctttgtaatgattctcctgctaataaacgattatctgtttctttttgtgttttatcgtcttgataggctttatcgtccaacttatagctgttatcatctgcggttcgtttcttctcaatatgaaagacaatgctatcaatgctccgcccttttttgactttctcataagacacgttaaaggacgtatgggcgttgatttcttctatggcattttttaatacacggttttcaaaactttgaaaacgtgtatattcattaatcgtatcagtgatttctcgcaactctttcactatgattgaggggttgcggtaggcttccacttgctcggctctccgtccacctttaacactataatgctcgtactggctataattcatagctaaccaacgatataagataagactgtacttgctattaagttctttcaattcagagattttatactgtgtaaattctgcctttaaatcaatcagataaggcataataaattgattaaattgtatcattacatcatcattgtagctgttccatttaacagttggtattgggacgatacttgtcatttcataccctttatttttttcttctttaatttgaaaaaaagcttgtttctgcatatactcaatagcttctttaaaacgagtatgtttacttgctgaagatacatcaaaaaaagaaaataattctttttttgaaagatagattatattatctttgggcggattttctgtatcaatgcaagacacggctaattcaaacatttttaaagcggtcttttgcattttagcgattgaagtaatcaagctattatgctcgaccactttacgtttttcgatttcattcaaggtatacacctgcttttgattttctgatataatagacatagaaatactcctttgtgagtgttttgtgattaagcatagagaagtgatttagacgtcaattttctctatgctttcattatacaaatttatagcaacataatcaagtttttgttgctatatacatcgttttttgttgctatatacatcgttttttgttgctatatacatcgttttttgttgctataaaaatctgtcctcccttgctaccactgacttttttttcacgcaaaagaacaaaagattaaaatatataggataaatatataataggcttcgcctttttttatttttttcaaaaattaaaatcaaggtcaaaagaaaaagtcaaaaccattgaattgaggttctaaatttaaactctctgcgttgctcttgtcgctccgcttgtacactctgattttatattagatacattctgccactaaaaagaactccctaacggtcgtggatacttttttagtctaaacgctttgaatagtcctacaagctcatagtttgcattctaagcgattttaaatgtgagttagtaattgattatcatggataaaagaaaaagcccttaaataggcttgtatgtaattgactaaaacgtacaattttagattttaaatatgaccgttatttatgacctgctctaacctcactattcatctgaaaaacaaaaaagcggtcaaaactgttaagttttgaccgcttttttgtttttcagagaattataattgactaaaatagacattgtttcagaagtaatatctttcctactctttcaagaataagggcatggagaccattcgaggaatatataaaaagaaccgaagaaatggaacgctcttcggcttttcggtgtctactgaaatcaagggattaatgggaataccagcctaagatatttggagttcagagagggcgcgtttgattttcaaacttcgcaacagaaccaaaataagcataacttttaaagtgctccataactgttagatttcttgtctaacaattatggagcactttaggttccctgtgcttttttatttgttcaaaaacagcaaccgtaatttgttttttcccagtactatagctaacttaaatgtacttttcattagccaacgttaaaattcgtcttatactaaaatttaattgtttaaatgtgataatcaatgtgatattattattatatgccaacaatggttgttaacaacgtttaaattattcgtatacttattcgtatactatcaaaaatggaggaatttgtcttgaaaacaaatcgctatgttgttgcgtttgcaggtgtcatgtttcatttaatgattggttcagtttatgcttggagtgtttttactaatccaattgcaaaacaaaatggttgggcagaatcctcagtcgctcttgcatttagtatcgctattttcttcttgggaatgtcagccgcctttatgggcaaagtcgttgaaaaaataggccctagactaacgggaactattgctagctttctttacggaactggaaccattatgactggttgggctatccatcaaaattcaatttggctattatatctctcatatggtgtcataggcggattaggactgggagcaggatacgttacccctgtatcaacaattattaaatggtttccagacaaacgcggtttagcaacggggttagctattatgggatttggttttgcagcaatgctgactggtcctgttgctcaacagctaatggctagtgttggtcttgaacaaacattctatttcttaggaacattttattttgttattatgctgttcgctgcacagtttattgttcgtccaaatctggcactatcaagcactactgaaaatagcatttctcaaaaaaagggaacacgtctaacccgaggaccggagctaacagctaaccaagccctcaaaactaaatccttcacttttctttggataatgttctttatcaatattacatgcgggatcggccttgtctcagctgcatcccccatggctcaaagtatgactggcatgtctgtccaaacagccgcaattatggttggaatcataggccttttcaatggctttggacgtttgatatgggcaactttgtctgattatatcgggcgccctgctactttcagtgccatttttattctcgatattgtaatgctttcagctatactcatcttcaaattaccgctcctatttgtcattgcattatgcttgttgatgtcttgttatggagcaggcttttctgtcatcccagcctacttaggtgatgtctttggtactaaagaattaggagctgttcatggatatgtactgacagcatgggctgctgccggagttgttggaccattactattatcattaacacatcaactgttccacaattatactttgacattagctgcctttattttgattgatctattggcactgctaatctcattctggatacaacgagatttcattaaagccagcaaattaataaaaagaaaatcataaaaaactactttaaagcgcattaaattattaaaaactaagacaaaattgcataaaaaagagtctaaaacagcatgagccgtaaagtgcaacacaaaagttagacaaaattgaatatttttaaactgctaaggcatgttccctgtattcgcagggagtcatgccttttgttttctgtgatattcgtcgattgttaaaccggttctgttgcaaagttttccaaaaaatctcttttagtgtaaaattgagaaaaaagaagatgtcttaaaagaatttgaaattaagctctaatttttttcaaaaagggggattgggggacaccaccaaaaataaaaatattcgtctgaaacaaacaaaaataaaattggaaattttaggttttgtgagtgaaagatgaattatttttactgtaagtgtagccacacttgcgaagttcaccacaatactttataacgtttttatttacatgagcaaagcgagtttttccaacacgtttaatctaaaatattggcattttataccatgatttttcatggtatgtaagtgcgcccttatatcttatagggatatcttacctctttttataagtgttttctaattatacgtttacattcctaacagtaaatttttgtcttaaaaaaataaaaaagccaccaacttattgtcagcaacttttttattttaaacctaaaatcaaatcatcaatcggcacagattggtatttcgtggttaagccgtagtccccactctgcttgcaccgcttcgtttttttatgtggcatagatgcgtcaaccactcatcaagaaattagacttctctatggaacaatttaaccgcatgctctgcgtgtcagttttctttaaactcattatagcataaagtctccctgttcgcttttgtcgctccgcttgtacacctcaattgaaaaaatcggacgttctgcctttaggaaaaatcccttgcggtcgtggttactttgatttttttaatagagttaagtatttatctcttccgtcaaatggaaagatagcacgtatggcatacattaattcctcggtcataaaaagcatctcttgtacttcacgatagctcaaattgtaacgcaaataataagctacagctacaatcatcacgtcttttggaaattgtttgccttaatctttgtaaaaaagcagttttgaaattaacggttagctcattttgatagaatataatagttgtcgcgagagacgagcgttgaagcgcgacaagctagaccattgaaaactgaataaagaagaatgactcatgtgatgtagcaatacatcaaaaatctgtcaatcaataatgaaagacaagccagtcacttcggtgacttaaatactttatttgagagtttgatcctggctcaggacgaacgctggcggcgtgcctaatacatgcaagttgagcgatgaagattggtgcttgcaccaatttgaagagcagcgaacgggtgagtaacgcgtggggaatctgcctttgagcgggggacaacatttggaaacgaatgctaataccgcataacaactttaaacataagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctaacgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggagtacccgaagtaggttgcctaaccgcaaggagggcgcttcctaaggtaagaccgatgactggggtgaagtcgtaacaaggtagccgtatcggaaggtgcggctggatcacctcctttctaaggaatatatacaaagacgtgagcattcaactttattcagttttgaggggtttagtcataaacctaagcaagaatcaaattcttgattgtggggccttagctcagctgggagagcgcctgctttgcacgcaggaggtcagcggttcgatcccgctaggctccattgtcagacaagacgttaaaatcacttgaacattgaaaactaaataacaatatctaataacgataaataaaccaaaagctgtgaattttaaagaatttacaaacttatacttgaaaaacgatgattataaatcatcatggcaaagttaataagggcgcacggtggatgccttggcactaagagccgatgaaggacgtgactaacgacgatattctagggggagcagtaagtacgcattgatccctaggtctccgaatggggaaacccagctgctactagcagttattcatgagtgaatacatagctcatgtaaaggtaacgcagagaactgaaacatctaagtacctgcaggaagagaaagtaaaaacgatttcgtaagtagcggcgagcgaacgcgaagaagggcaaaccaagaagcttgcttcttggggttgtaggactgcaacgtggacttaagcattatagtcgaataacctgggaaggttaatcaaagagggtaataatcccgtagacgaaatagcgcttatacctagcagtatcctgagtagggctggacacgcgaaatccagtttgaatccgggaggaccatctcccaaccctaaatactccttagtgaccgatagtgaaccagtaccgtgagggaaaggtgaaaagaaccccgagaggggagtgaaatagcacctgaaaccgtgtgcctacaagaagttcgagcccgttaatgggtgagagcgtgccttttgtagaatgaaccggcgagttacgttatgatgcgaggttaagttgaagagacggagccgtagggaaaccgagtctgaatagggcgacttagtatcatgatgtagacccgaaacctagtgacctatccatgagcagggtgaaggtgtggtaagacgcactggaggcccgaaccaggacacgttgaaaagtgtttggatgacttgtggatagcggagaaattccaaacgaactgggagatagctggttctctccgaaatagctttagggctagcgtcgaaatgtaagtgtattggaggtagagcactgtttgggtgaggggtccgtctaggattaccaatctcagataaactccgaatgctaatacacatgttcggcagtcagactgcgagtgctaagatccgtagtcgaaagggaaacagcccagaccaacagctaaggtcccaaaatatatgttaagtggaaaaggatgtggggttgcacagacaactaggatgttagctcagaagcagctatcattcaaagagtgcgtaatagctcactagtcgagtgaccctgcgccgaaaatgtaccggggctaaacatattaccgaagctttggattgatattttatcaatggtaggagagcgttcttaaccgcgatgaaggtataccgtgaggagtgctggagcgttaagaagtgagaatgccggtatgagtagcgcaagataagtgagaatcttatccaccgtaagactaaggtttccaggggaaggctcgtccgccctgggttagtcgggacctaaggcgaggccgaaaggcgtagtcgatggacaactggttgatattccagtactagatatgatcgtgatggagggacgcagtaggctaagagatgccagttaatggattctggtctaagcagtgaggtgtgagatgtgtcaaatgcatttctctctaacattgagctgtgatggggaagcaactacggttgcgaactctctgatgtcacactgccaagaaaagcttctagcgtaaagtcatatctacccgtaccgcaaaccgacacaggtagtcgaggcgagtagcctcaggtgatcgagagaactctcgttaaggaactcggcaaaatagccccgtaacttcgggagaaggggtgctggtgtaaaagccagccgcagtgaataggcccaagcaactgtttatcaaaaacacagctctctgctaaaccgcaaggtgatgtatagggggtgacgcctgcccggtgctggaaggttaagaggagtgcttagacgtaagtcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgtagtttgatattgagtacctgtaagtcatgtacaggataggtaggagccattgaaatagggacgctagtttctattgaggcgttgttgggatactacccttgacttatggttactctaacccgctggcataatcggccagggagacagtgtctgacggacagtttgactggggcggtcgcctcctaaagagtaacggaggcgctcaaaggttggctcagattggttggaaatcaatcgtagagtgtaaaggtaaaagccagcttgactgcgagagctacaactcgagcaggtaggaaactaggacttagtgatccggtggtaccgcatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggtaatttgagaggatctgtccttagtacgagaggaccgggatggacttaccgctggtgtaccagttgttccgccaggagcacggctggatagctatgtagggaagggataagcgctgaaagcatctaagtgcgaagcccacctcaagatgagattacccattcgtaagaattaagagcccagagagatgatctggtagataggctggaagtggaagagttgcgagacttggagcggaccagtactaatcgctcgaggactttaccaaaagagtcaaatataaaatgcttatggtttagaagttagaagaattgttatttagttttgaatgttcaaagtaacatttaatgatttggtcatcattgcgatggagatacacctgttcccatgtcgaacacagaagttaagtccatctacggcggaagtacttgggggttgccccctgggagatatgcgagtggccaagtatcttcaaacaacaccccattcgcttcaagttctgatttgaattgagcaagtaaatcgcctgtttttattgcttcataaggactggaaaaaccacaaactgttggatccgcacgcatatccgttatatttgattgcggaatgttcgttgcatttgctggaaccaagattttacaaagttgtagctcatagacatcattactttgtacaacttgagtagagttctgcttataaacgatatctccattattgctagagttgctccattgaacgacaattgaatctgtacgagactggctagttaatggtgctggaattttaaaagaaagtggtgaggtattcattacttgaccaccaattatccaagctacgccagatccgacaatcacattcattgatggactatctgtttgagtgacttgaaaagctgttgagccagcaagtggaacatttgccaaaattccagtactaatgaaattcgcaaaatattgacgaaaatcatcattgttatacatgttgcttccatggatgctttttaatggaaatacaaaaagtgccatatttaaacctactttctattaatcagttttgttagtgtaactttatctttatcaaaggttggatctaagtgataacctgactcatcccaagtttcctgcatttctgtcagagtcgaaacttttgaaactccaaaccttggattagtttgccttacaatatcacccaccatataatctttaccatactgaaaattaagattattgtagtttgcttctcctccaatctgaatgacttcagcatgttcagttaaagcttgattccctctctggagtaattgcgctttatactgattatccgttaaagttacttcttttcctgcatcgttggtataggtttgttgcaagtcacgtgcatcgacatagatttcattaacttcagctcctttaggcttcccactaggaagttttgttgctacaatcgatttccgtttgtttccctcaccttctccgaaaacataggctacattataaaaattggagatgtcacgggttaaactttcagattttagcccctcatcatccaagctaaactcaattcctccatccccactcaagtcccttcctttatagaattggatttgagaagcgggagtttctaagtttgtctgaacttcttttatacaaatactatttccatcagcaagagaggctacttcttcagcaacatttccataagaattttgataagaaatagcagttaatccaaaatctggcggattttgtatacttaccagagatatcattctgtccgttactgttttaaccatatttttattaatgagatcaaacattattttttctggcttggcggagttagtagcatatactggaataacaattcttttagttgccttacctaaaaggcttttacctttgaccgtcatcaagttcgattgtttactatcatagctgatagaatcaatataaaaataggaatcatttatagaaaaaatattatcagacttcaaataaggaatagcatttgaattcaatggtaaactcaactgaaagatatcaaagttaaacgctcgccaatttacaatacagcttttatactggtctaatatgccgactgatgagtgagtatagtctgaattcatattaaagatttcaactgtcaaatctctttggataaccattagcagacccccgttagtagtggataatatttcatagtagcaaccatattttcaatgccactatctgcttgtaagatgaaataatttgtttcaagattactaatttgcataaaagtagaacctaactttcgtttaaagaagccattttctccatttattagcacctgtttctttccttcgtttgtattgagataaattgtgtctccccctttaaatttattattaaatgcaaaatactcttcagtataagggttatacaatctaggattaacgacttctgccgtacaattaatgtttaactctaaaccaaccgcaacatgtcctggatttgtcacagctacttcttttcctacatctaccgttgcgaatttgaaatcatctgtgattcctaaaggaaatctaagcaaatttgtcgtttgtcccatttgaaccacgtaagaatcacttgaaatatctctccaaaggggattagctgcaaagaatgtcagggtaccctgatttgtatgactcttttcatcaaattcactattccaaccttttgttatccgaacatcaatttcataggttttaccgaaagactcataagttaaagttcctttgagtttaggattgaacacatctaataaggtacgctgcagtttattatcctctttagagttttttccataaactaacaaagtaattgttggagtacgggagtcaagtgagttatcattttcatgctcaccatccatactgtacattttctcactattaatcgtattgtttactgccccaaagcctgttttatcaagtaaaaagaacggacgttcctttgtcataattaccattccaccattctcattggtgtaggtaattttttcttcatcaacagcaaccattaaaatctcccttctattaaattcaattgatgcttaatgaggttattattttcatcatatatcgcttcataattctctacataaaagatgttttgagcatcatcagcaacacgcgcgcctatccattcttcttttgaagtagatattgaatcaatttgcggttcaaaaatagttaaaacagcagtttgtttcacttcacgttttttacctatcgtttggaatacaggtcgtttatcgagttcgatattgttaaaaagttctatttctccatatatagcctctccccaacgattttcgccttgtttttttgaaatttcaacactttgtttataagataaattcattttccctcctaattatttgaaaaaagataacctagttctttttggagccggttcaaaacctggttcttttctcgtaacgtcgtcctgttatttcgagttccatctttcagaattaatggctctttagaaaccaactcttgcaataatgaaatgataattgaaagttgcttactgttatcaacaactggagcgttaactactaattgttgttgaactgctcgcatatctctaaatattttcgcattggctggaataccaccagtcccatcggcatatttagggataagttgtgctgttttgctagcttttaaaatttttgttcctttaggtagtggcattgtcacatctcgtccttctggaataaaacttactccattaggaaggctgattaattccttataggttggccctttttggtcattaaccatagcaagtccgcctggatggtacggtgtaccttgagcgttgtttgttttatttatgattaaatcaattgtttttgaagttggaatatcacctaagaatccactcaatgttgttcttgctccactgtcattggcatcaattcctacagttttaccttgcaatgcagcaattgttgcggcagcgctattaactccaaatcctgtattattattcgcgcctaatggaactgttctgccttgcaaagaatttattgttgaacgcgcaccgccaaccccacttcctgtattattgtttgctgcaagtgatacagtctttccctttaaagtatcaattattgcttgagctgacattgttggattttttgtaagattcttagccagtaactctttagcaggtgccgaagctttattccatgcagcaagtatttgacttgcttctgcttcattatttttaaaattagcattattaccaagtaacttcttaactggtgtaggtatagaattccatgcttttaaactctcagaagtagctgttattgcatcaattgctctgccatttttaccaactaaatcgattaggtttacaccatatttaccgagaataattgatgaagtagtataccattgcttgtattggtcggttccttgtacaagtccctctccttgtttcataatcatattttcgagagtgcctaaatatgcttgagtagttgattcatgctcattttgtagctctttttcctttgcagtatactgttcattggtaatttgtccttgccccaataaatcctttaactgtttttgcttctgataaaatgtttcatcagatttatcaagaatactttggatacttgatgaataatcctgagcctgttttttagaaatattattaatatctccagttaaagcctccataagttgctttttcttagatcctgttacaccgagtgctgatatttcttgctctgcaattttttgttgattagttgcaacctgcgcttgctcaataagtgtcaagtttctatgctcatcacttgccttcttataaatggaagtcatattatcggttgcttgttttactatatcttttgctttgtctccaccatttttaatgttattaattacatcatcgccaaatcctaggtttttagcttcggcttgcaatttttttgtagcactatcaatatcacctttggttgtatttgataaatcttttatagcttttgagacatccttaaacgctttactccctttagttccaaaaccttcagctgcaatagataaatcatctattttacctttgaaattttcaactttagcaaccgtttctttaggcacttcaattgttccgaaatatttcatcctttctttagcagcatccactactttgcttacgccgataattaaccccgctagaccagctacacctaatgcaccaaccgccactggacttaaaccagctaatattggagagattccagctaaggaagcagatagtccccctcccccagctatcgcagcggttgctcctcctgcttctgtggcaattcctctaagcgcaagctctccagctccttttgccccaattctagccaaaccaccagtaactccagacagaatacttgttaatccacttaaagctttcgctgttggagcaactgcagcagccgcaattgccattttaatgatgaattgttgagtttctggacttaattttgaaaacgatagtaaatagaactattgtaagaatttttaacttttgaaaaggaatattatgtttgtacaactttcgatttttggtttctttaatgattggatggctaattttgcccagatgcctaatggtcatatttggatatatgttgttttaggggcgattatatttattgaaacaggattagtgattttccccttcttgcctggggattcaattttattttttgttggttctttagcagcaatgtcaaatggaaaattatccattggcttattgattttggtgatggggattattgccttcattgctaatctgttaaattatgaaattggtcgaagatttggagatgttattccaaaacataaatggctttctcgcttcttgaaaccagaatatatggaagaagctcatcaattttttgaaaaatggggttcttgggccattttcttagggcgattcatgccaatcattcggacgattgttccatttacagctggtgctggtaaaatgccacataaaaagtttattttctttaacttcatcggtggttttgcttgggttattgttgccttaggtgcaggctatttatttggtggtattccttttgttaaaaaacattttgaaatcatcatgattgccattgtctttgtgtcactactaccggcaattattggcattttgaaacgcgttcttggaagtcgcaaggaagcttaactttatgataaaataggacttaaaaaactgtcagtcctttttttatcgattgatatgtcaatgacaatagaatttactgacaaagacactagcatagctgagccttttgcgtcttgcgcaattatggatatattagtagtttcatcagtaattttggagaatttttatgaacagtaacggctacactcgtatggctgctgttgtagcaaacccaattaaacacagcttgtcaccttttattcataatctggcttttgatttaatgaatgaaaatggtgtttatttagcatgggaagttgaggcggaaaaattgccagctattgtggaaaatgttcgtactttagacatgtatggacttaatatttcaatgccttataaaggcgaaatcatcaaatttatggatgaattgagtccggcagctgaattaattggtgtcgttaatacggtagttaatcaatcagggaaattaattggacataacacagatggtataggatttttcaatagtttagaaaaatatcatttcaatatccaaaataaacaaatgcttattcttggtggagggggtgcagcaattgcaattattgctcaggcagctttgtctggagctaaaaaaattgtggtcgcagcaagaaaatcggcctcatatattccgctaaaagagaaattggaaaagctgtcagtaaaaacagggattgaaattttactgacagacttatctgaagctgatagattacaaaaagagttgaaacagaccgacttattagtaaatgcaacctcagtcggaatggatggagaatctttgccgctggaaaagagcttagttcttcctgaaaaacttttggtggtagatgctatttataaagtaagagaaacaccatttttacgttgggcaaaagagcaaggagctcaaactgaaaatggacttggcatgctgattggacaggcggcggaaagcttttatttatggacaggtaaaaaaatgcctgttgcagaaattacattagaaatggagaaagaagcatgaaattaaatgtgaatttaccagaacatccctatgatgtcatcatcgaaaatggggccttggctaatattggaacttgggtttcttcattgtggaagaagcaaaaaattgttttgatttctgataatcatgttaatggactttatggtcaaaaagttgttgaccaacttgaaaaagcaggttttgaagtggcaacttttgaatttccagaaggagaagccagtaaaaatttactgacagccgaaaatgtttggaacttttgtgccgaatttggactgactcgttctgacggaattattgcactcggtggtggagtaacaggtgatttagcaggttttgtagcctctacttacatgcgtggcattcatttcttacaaattccaacaagtttgaccgcccaagtggatagttctattggtgggaaaataggaattaattccaaaatgtctaagaatatgattgggacttttacacagcctgacggcgtgttaattgacccagaagttctgcaaacgctcggtcaaagagaattccgtgaaggactgggagaggtcatcaagtgcgccctaattgctgacaaagacctctggaatttactgacagacttgtcagcgaatgatttggtagaaaagcttgataagattgaagaaattatctatcgatcttgtgaagtaaaacgaaaagtggttgttgatgatgaattagacaatggtgtgcggctctatcttaactttggtcatacaattggacactctattgaaaatactgcaggctatggcaaagtgatgcatggggaagcagttgctattgggatggttcaaatcagtaaaattgccgaactcaaaggtcttatgcccaaaggaattactgaccaaatccgaaaaatggtcaaaaaatatggtttacctgacgaatttcaaccttgggatgaagagcttttgtttaaagccttaactcatgataaaaaagcacgaggaagaatcatcaaaaccgttattgttcctgaaattggcaccgctaaaattaatgaagtgacttttgaagaaatgaaagactatctcaaaaaataacttgagttattctaagagaaaccctatctaaaaattacaaaaatgtggtagcattaaaaaaatcccagcttttataaaagctgtaaaaacacttatttaaaggagaaacaatgtatatttacctagcttttgcattagttggcggttttttacttgctaatcaaaatccaatcaatgcggatttacgaaaaattgttggctcaccatttttggcctctggaatttccaactttgttggttcgatttttttaggaattatcactttagtgaccagtcaaacactttttcctagttttcaatttgttggctcacacccagtatggatatggattggtggggttcttggtgggatttttctaacatctaatgttttactttttccaagattaggagctgtccaaacggtgattttacctattttgggtcgaatattgatggggacacttattgattcatttggctggtttcatgccatgcaacttccgatgactctgatgcgctttttgggagttatcattactttagctggggttattgtcgcggttgttcttcctaatttaaaagaaaaagaagcagaaacgcaccaaactaacttactaggctggcgaatttgggcggtcatcgttggggcaatgtcggctgctcaacaagcaattaatggcagattgggagttttacttgaaaacactgcacaagcaacctttgtttcgttcttcattggatttttagctatttttatcgtgtctctttttattgaccgccgtttgccaaaaatttcagaattaaaaaaagcaaaaccttggaatggaattggtggatttttaggagcctcaatcgtttttgcaacagtcgttgctgttccgcaaattggtgcagggctgacaattatgatgggcttgattggacaaattttaggcagtatgttggttcaacaatttggttggtggcgctcaagtaaatatggcattcaaatttggcaaattgttgggattctaattatgctgaccggaataatattcattaaatttttataatgtagctagtaatatggaacagcgtttcacgctcactaccttccgtctgcgcgttcaataagcagtaatacctataaaagaacttagaaaattgaggataatcactctaaaatgtttactcaaaaatcatttgaaatttttaaaatagaaggtttataaccaaaaatgactgagattcgttctgaaattcaacctgttttttctgaaattggtcaaaagttactgacagaagatttcgtaatctcaaaagaccatacaaaagcagaaacttatcccctgtcagcatttagagaagccgctgaacgcctaggaaaagtaaaaaaatctgaattggaaattggacggctttggcctaaagaaagatttaacggcaaagaggacttaataattctagcggaaatgatagaaacaattgaccaactcctaccgatttatcaaaaattaatggaggcctaatctaatgacaacatttatttgggatttagatggaacactaattgatagctatgaggtgtttttagaagccttgtccgaatcatttgcaaactttaatcgaccatttgatcgagaaacagtatataattttataaagggtcaatcagtcaatgctttactaaaagaacaacccgttccatttcaagaaataaaagaagatttcacggcaaattcgacagctaaaaatgacaaaattaaattaatggttggtgcaaaagaggttttagattggactcaaaaagaaaagattcaaaatttcatttatactcacaaaggcaaaaatgcttatgatttgcttaatcagctggaaatttccccctattttctagaaatagtcacttctgaaaatggatttaaaagaaaacctcatcctgaagcaatcaattatttacttaaaaagtataaattaaagcctgaagaaacttattatattggtgaccgaatccttgatattgaagcagcccataatagtggcattcaatcaatcaattttctttcagcaataaattcacagcaaatcaataaattaacagacccgaattgctagttgattatttaggcatgacttgatacccgatagaatatcttaaagtctctggttccagtgatttagctgattttaacagtaaagaatacgctaaaagtatcctctctaatttcaattgaaaacctattcgagtattctatctaatattagtatataataaatcttttttatctttgaatttttgacctattttaaccgcaaaatcttttatttaaacaaaataaaaagactcttgacaaatcaaaagctttttattcaaatttcacttattaatattctttttgttcagctgaaaattcactttcattatcatctttaccgacgatttggactaaagtttgttcggcttcattgagtgtttttttcaatgtctcagaaattttcattcctttttgaaattcagcaattgcatcttccaacgcaacatcaccagattctaacttacgtacgatattttctaattctgctaaattatcttcaaattttacttcttctttttttgttgccatttttattttacctccacttttacttgtccgtcagttaattccacatcaagtgcctgacctttttttacatcgcttacggatttaatgatttttccattttcgtcagtaattagggaaaaaccacgcgcttttatttttgaaatatctaataaaagcaaagactgatagagttgctcggtcttattttttttactttcaacaattttactataggttggaatcaatctatttgctgacagctcataacggtgcttcatatttgcaactttattttctgtcagtactgtcaatcgttcgcacaatcggtcaagtttttgtacatgtccatcgtaaaggcgttcaggttgtctaaacaccactgactgacttaatttttcaagtcgctctctacgaattttaatcaaatgagttaaacgattaaaaagacgactttcttgctcatttgcccaattgattaagtcaatttttgtatttggtgtggctaattcagcggcggtagttggtgtagcagcgcgactatcagctacaaaatcggccaaggtcacatcagtttcgtgtccaactgatgaaataattggaatacgtgattcaaaaattgctcgaacaacaatctcttcattaaatccccataaatcctcgatagagccgccgccccgaccaataatcatcacatcaaaatcgccacgttcattggcgcgtcggatatttccagaaatttcttcggccgcgccagctccttgaactttagtcggatataagacaatttgactcattggaaaacggcgttgaacggttgtaataatatctctgatcactgctcctgatggactcgtggccaccgcaatttttttggaaaattgtggtagattttgtttccaacgttggtcaaaaagtccttctgccgctaattttttcttcaattgttcaaacttaagggcaagcgctccaactccatcaggaactaaactctcaatatttatagaatatgacccagaagggggataaatgctaatacgtccaatcgcaagtactttcatcccttcttccaattcaaaatccaacttacgaaattgccctgcccacatcgtcgcttgaatcacagccccttcatctttaagagcaaaatactgatgattaggtcttcttctaaaatttgaaatttcccctgtcaaatacacgcgctcaagataagggtctcgttcaaattttgctttcaaatattttgttaaggttgatactgataaatattctgtcattccctcactcttcatatttctctaattaattttactgacaacttgtcaatttttactctactttgtaaaatcgaaaaaaagtaaaaagtttatgtcctgaccaattatttattatcaataattgaggagaactttgcttataaacttaattactctttcatctattcttatcagttactattttcattcatttttcttgttgccgcacgcaccgtttgttccatcaacattgtaatggtcattggaccaactccaccaggaacaggagtaatcaaacttgcaacttctttgacttcatcaaaatcaacatcgccatgcaattttccgtcttcatcacgattcatgccgacatcaatgacaactgctccatctttaacatcatccgctttaatcatccggtcacgaccaatggctaccactaatatatccgcttctttagttaattctcgtaagttttttgttcttgaatgagcaattgtcaccgtcgcatctgccatcatcagtaactgtgccattggttttccaacaatgtttgaacgcccaatcaccaccgcacgttttcccgaaagttcgacattatattcacggaacatctccataattccagctggtgttgaaggaatcatcaacggatttccagaccacaaacgccccatattcattgggtgaaaaccatctacatccttttcagggtcaattgctaataaaactttttcttcagaaatatgttttggtaaaggtaattgaaccaaaataccatgccactgttctgattgattatattgttcaatcagctccaaaagctctttttctgaaactgtttctggtagacgaactacgctagaattcaaaccaattgccgttgcttgacgggctttatttcggacatagatttgacttgctgggtctttacccacaaggataacagcaagtccaggaacgctgcctgcttcttttaatttatcgactttaactttcaactcagcttgcattttagctgcaagtgcttttccatctatcaagttcataaaactattataccataagccgactttcaactctcaactcctcaaattggatttgtcagctttagttttaattgttcgtaatttttcatcagctttctcaaaaagataattccttgacattttaggtttacaatcgtaaacttaatatagaaagactaatctcatactaaatcatttgggaggaaaatatgaaaaatgaaactcattcagacgctcatgaaaaaatgatgaacgagcctcatcttgatcacgaaatgatgcagatggaaactgatggccacgacatggacatgatgaatcatggtggacacatgatgcacatgggcgatatgagtaaaaagctcaaagttgctatcgttctaatgattccgcttctactcatttcaccaattgctggatttacaatccttaaattccccggtagtgaaattctccaactcattctcggaacaatcatcttcttctattctggaactccttttttcagcggggctaaaggcgaactaaaaagtcataagccagccatgatgatgctgattacaatgggaattaccgttgcctatgcttactcagtctatgccacaatcatgagtcttaatggacagatgggaatgaacttctggtttgaacttgcaaccttaattgtcattatgctgattggtcacctcattgaaatgaaagcaatcatgggtgccggtgatgcattaaaagacttagcaagtcttgttcctaaaaaagctcacttaaaaaatggtgaagatgtggaactttccgaattaaaagttggtgatttacttttagtaaaagaaaatgagaaaatacctgctgacggaataattttaggtgaagcccttattgatgaatctatgattactggcgaaagtcgggcgattagcaaaaaaatgaatgcttctgtttatggtggttcactgaaccaaaatcaaccttttgaaatgaaagtcacaacacttggaaaggattcattccttaatcaggtttccgaactagtcaaaaaagctcaatcccaaaaatctaatcttgaaaatatggcagataaggtggctggatacctcttctacgctgcacttattgtcggtatcttttcattaattttttggacaattagttctaactttagttttgccttacttcttgcggtttctgtttttgtgattgcatgtccacatgctttaggccttgcggttccacttgtcgtttcacgcttaaccagtatttcggctaaaaatggcttgcttattcaaaatagaacttctttagaaaaaatcaatacgattaaatatgcattgatggataaaacaggcacattaactgatggtaaatttgtcgtccgtaatgttattgattttactgatgatacggacattctacaaatcatggcagctcttgaaggaagttctactcatccgattgctcaatcaatcgttaatgcagctcaacctctgaaaagtctaaaagttgaagcaattgaaaatatccctggggttgggattaaaggtcaagtcaatcaacacttttatcaaatcgttaattataaatatcttcgcgaacatcaactttcttatgatgaatcaaaaattgcccaatacttagaacttgggttaactgtatccttcttaatcaatgaccaacaaaaggttttagggttcatcgctttaggagatactccaaaagctgatgccaaagattttataaacggcctgttagctcaaggaatcacacccgtcatgttaacaggagataacaaggaaactgctcaaaaaattgctaccgcactaaatattcctgaatttagagcggaattaaagcctgaagataaagcagagattgtgaaagaatatcagaagaaagcaggtgttctcttcattggtgatggtgtcaatgattcaccagcacttgcaacagctacgattggttttgcaattggcgcaggtacttccgttgccattaacactgctgatgttgttctagttaactccaatccaagtgatgtcttagatatgataaatatctcaaaaagaatgcttaataaaatgaagcaaaacctctggtttggggcaggttataatattattgctatccctgtcgcagcaggtatcctttatccatttacggggatttatattgaccctcttattgcagcagttcttatgtcaatctcaactgtgattgtttcaatcaatgcgatgggattgaggtatgataaaaaatagaagagcatatgctcttctatttttttatttttcaagccataattaaaagaaaatttgatagaagccttttattatttaaatatacttaaacattaaatatcttttcttgattcagttatttctctatttttttttaatacttttttagcaagactaaccgtcttattttttttattataatttatcccactatctccacaactcacccattttttaaaatcttcaaatatataagtttcaaactcatgattttgaatcaatttcaaattactatgtggtcctagtatcacaattaaatcatcaaagttaacttcatttttgtcatatttaaatagtatattagttccatattttccaaaatgagattttacctgtacttttttatttgttttatatattccatcatatccttcttgtcttaaagatagtgccaaatcaactccgtttgtatcctttactatgaattcagctatatttccaagatatgtttctgaacgtataatcttacattctttcaatttttcaacagcattaaaaaaacattgaattgcttctttctcattatctttcataataatcatttatccttcttttttaaaattactttctgaaacatgatttctcaaagtttaaagaaatcgtaagacatttttgattataaattatatcatataaattaaaataaaataaaaagcacctagagtaataggcgctctggagtatttttaaaaattacttttttggaatgaatattattttccactgtaatgactatctactcttttataaattttatatatatgttcatttatcttattttgaacatcttctctatcgctttgaatttcaatttttctaccaattttagatgctaaaaaatcttcaaatgaaactagtattctatctaattcatcataaaatttttctgaattatatttgaaataaagaatgtcttttctaagaaatgaaattatctctccaagttcatctaaagataaaaagcctaaattttcagcataactgattttatttctagtcaagggaattttattgattaaataatcgttgaatattttttcaatgtaaatacgtctcaatgttgaacgatatttcttactttcacgtgtaagactaaatattgtgaaacaaacgttccccacggaaattattatagttattattggcaatataaacttgataaaaaaatccattagtattttgtaccttcaaataatttgcccatcacatattctttagtaatattagaatttttagaaattatatccactttactttctacacccgcaaatccgatttttccaaccatataagagaaaaagccttgtacgaatgaagaggttataaattcaatattttcaggaaattcaaagcaaaacccgatattgtaatcggtaatttttgatttaatttgatcattaaatatatcttgaccataatcatatccagccagagccgataatgtgttgtcaaactcaagtataaatttcatttttttctcctaaatttttattataaagttcaagttatatgctgtgccactaagattgaaggctgatccaccaattatagacatatccggcggaagtttaaagtctttctgtttattaaatccaatccagcctttctcaacaaaatataaattatccttaaatcttattactctgtttccagtatatagatagcaatcatctaagtatgacttttctcttagcgcatctatgagtttgagtgtacctactccgccaacaccatttacagattttgtatattgtcctgatatttttggttgaagacttgctatagagaaaaatacgtctcttgtgtacactttatcaaaataattttcatgtttcaagtaaatttctttaagctctttatacttcaaattatcaggttttataaactcattttgaatattcttttttaataagtcaccaaaattattacttgaaaaatttatgaccactaaatttattccaatgaatttccctacatcttctttgtgagaatggacactgcttacatcaatatcgacaatacaatcagattgactatgttcatgactgttaccaactaactcagcagcaagttctccaaattgatatgcagaattttggtttaccccatttcttttaagaaatgatgcaatatctgaggttaatactgataatatttctatctttgaattaatgggaactaaccgtctataatgttgctcttctataattctagaaaaccgacttttaaaaccggatttatcttttagggctaagttcaataacggagaagacattaccccctcggttaatatagatggctctggtgacatagcaatcgatactttatgtccgtcattgatcaacgaaaaacatatacattcaaaaataatgtacgttaatttatccgcaaaagtgaacgatccagaaaatataaaacgaatcggaagtttccccatattattcttttcttttattccttgaataaattgtactagttttgaaattacgacaccgtcaaagatttccgtgcttaccttaaaaacaaacgccttataataactgttgaaatttcgtgatttaactatcatacgtttaggatttttactaaaaattaaatcgatatttttcataaatctccttacaattttttaatttaactaattatagcattatggtatggttaaataaagtgataattgctttttagcaactaggatatacaacggttctgttgcaaagtttgaaaatcaaacctaagatttctaacctctcatgttcttaagccggtatacccattaagacttttatttcagttgatactgaaaatccgaagagcattccatttcttcagttctttttgtatattccttggacgggttatattgataaaaaataagaaaacagcccctattatctaagtgttagataataggggctgtttttatttgatttcttaggggctattatctaattatagaccctaaacaaacatcttttgtaaaaagccttttttctgttctttcaataaatctaatttccgctgatgaagagcgatagtgttgtcgagttgtttgaagaatgaaccgattttcttttgctcatgctctgaaggaagattaatatcaatatttagaaattctccattacgaatatggacttgcgttgagccatttttttctgctgagatgatctttctatacttatcgctattggagaatgagataagaaaatcctcatccataccttcaaacaactccaatttatacacaccttgtggcatcaaaaattgttcgtcatctccttcaatacgaacgattctccccatatttggagctgatggaactaggtctcttaaagaagttacgagattgcttgtgtgagcgtggctagttatattcttttcaaaaaaatcttcactaatgtatttactgccagataaatctgcaattccagtcgcattaacagctcctttcggaatcgtacgaattccatcttcaagatagtctgttggtttgatagatgcaccgccagacaatttctcaataataccagatagcttacgctcttcccaatcgtcagcaaaccccgcaaatcgcaattcaggaactttggcaccatttttagggaacattttttgcaagtagccttttttctgttctttcaacaaatctagcttacgttgatgaagagcgatagtggcatctaactgtttgaagaatgaaccgatcttttgttgttcttcaagactaggtaagtttagtttttgtttaacaatatctttagtatttaaagtagtcatcatcaaagttttagtagttgccttaactaaaagatacttcattacagattcattatttatataaactttcataaaatctgtatccattttacaaatagggcgatatacattaaatacatgcgagactatcccatcctgtaaatcatttagaacaaacctaccaaatgcaaaactctttgacttgttaccttcaaatgcaatatcacctttatgaagcacattatatgttttcatataatcatcctgttcatttctattagatggatttaatttcatttgagccactgataaaacttgcttcggtgaatattctaaatttaaattgcgctcacttgattttttccaaacttctccaaacttacgttcttcccaatcatccgtaaaaccttcaaaccttaattgtggactctttttactcatcatgaccgcctctcaaaagaagacgcatcgattcaatcaaggcttgattctcttcactttctgcaaaattgtcaatcatcgataagagcacttgctcttgttgaactaattcttcattgatcttaaggagattggtatttactgcaaccaaatcaaccggttcctcttcctcaaaggtatctacataacgagggatatttaagttaaagtcattttcttggatctcatcaaaacttgcaacatgagcatatctttcaatatcttctcgttttttgtagatagaaacaattttatcaatatgttcatccaacaggacattttgattttttcgtttttcaaagtcttgagaagcatcgataaataagacatcacgacgagagcggtttttcttcaaaataataaccgttgtcggaatactcgttccaaaaaagatattggccggcaagccaatgaccgcatcaatagctcccatttctaaaagggcttgacggatggttccttccgcggctcctctaaagagaacgccatgaggcaggacaatccccattgttcccgattctttcaaatggtaaaaaccgtgaaggagaaaggcaaagtccgctttagatttaggcgctaattttccaaaacgctcaaaacgagggtcagagagaaattgatctgccgctgaccatttcgcagaataaggagggttcatgactacggaatcaaactgatacggttcttctgagggccaatcgattttattttgttcttttactatttttagatattctatacattcatctaattctaaatataccagcttccaaatgctattatatctcctgctctgcatcagcgtgaaaacgctggttttttgtggacgtggttctcgttcactcctttttgcatttttttattttgtcagtctttaaagacaaaataaaaaaatgcctgatttttctttcagacattttttatattattatttttcaaaataatttagtatatcaaagatttttgtataactatcgttgtttatataatcttgaaaaatttcttctgcgttcatgttgtttattgtttttgctccgttttcaatttcataatttattaaaaactttactgaactactataattatttttaaaacattcatttaattttttttcaatttttttagctcctttataaaactaaattattattttttatatcccattcaaaccattcagaaaaatcttgcttcatgccattaatagcatatttttcttgttctttttcttcttcttcgtcataagggtctaacgctgtcggcttgtcttggggtcttgcatatactccaacccattcattattatcgccatactcaaaactactatcaattaagaagcctttttttgtgagttcttctcttacctgtgctttgatatattgtaattcttctgcaccctcaaaccagtcatttttgaaatcttctaattttatttttttgttgtttgtcataatgttttttctcttttcttttttgtttttaaaattcatttttttgttatgtttggaagtgaagttgttagctggaatttaaaaaatattgaatttcataatattatgtgtcctttcttttttgagtgatccattttttcgccttgcttgtttttggtcgttgtgattgagggggaacagaaccccaaagcagaaacaagggcgagcttgcgagtatatttacccttgtttctgctttggggttctgttaacatgattgaataacgactattaagcaaggcaatggatatttcaaagaaagatttataagattatgaaattcatgcccttatttttttaaattccagctattttttataaaaaaaaagcaattactaaacttttttagtagttgcttttttccatgcttttatatcttttattttgcagacctactcaaagttgtcgcttttaggaggtcgtccattttttcagtcattaatctatatcctgcctttttaccgtaggtaggtattgttcaattgcctttttaagatactttgcaatgttcccttttgaataaggttcttgcttctcacgaacgtatgagagatgctttttgaccccctcaagtcctcgtaatgttttgagttcgtcatactttggataaacatttttttgcaagccagccatgattgctgggtcggtcatttcataaggggataaaaggaaattttccagcaataacttagtatatttgcttttcattgcttttgcatataacctatcttcatttgcttctttttcagctttcgcttcttgattagttttatcttctagcttatagctgttatcgtctgctcgacgttttttcgtgatatgaaagacaatagaatcaacacttcgcccttttttcactttgtcataagccacgttaaacgaggtgtgagcgtttatttcttctaatggtttttctagtacccatgtagtaaagtgtgacattttttgatactcttcaaccgtatctgtcatttctcgcaattctcgtattgaaatttgggggttgcggtattcttccacttgttcttctctgcgtccgcccttattgctgtaatgctcatactggttgtaattcatggttaaccaacgatacaaaataatagaatacttgctgtttaatttttgtagttctgaaattttatattgtgtaaattcagattttaaattaattaaataaggcatgatatgttcgctaaattgtatggttacctcatcattgtaatcattccacttaacataagggatagggacaatgctttcatactcaatacctagttttttattagacttgattttaaaataggcttgtttttgcatgatctcaatcgcttctttaaattgagtatgcttgctgttagaaccgacttcaaaaaaagaaaatagttcttcttttgagagataaacagtattgttttctggtacattctccgtatcaatgcaagatacggctaactcaaacatttttaaagctgttttttgcattttagcaacgctggtaattaaagcgttgttctctactacttttcgtttttcaagttcattcaaggttagtacctgcttttgattttttgctttttctgttataataggcatagaaagtaactcctttgtgagtaattttagaattagcatagagaaaacatttttgcgagtgaatttctctatgcttttattatatcataataaggacagttctacaacaatccctgtccttatacatcgatttttctgtccttatacatcgatttttctgtccttatacatcgatttttctgtccttattattctgtaaacccttgaaaaacctcacttatttttgacgcaaaagaacaaaagattaaaatatatatgataaattaatataggcttcgcctttttttatttttttcaaaaatttaaaccaaaggtcaaaaccaaaagattaaaaccataaaagctcatattttacgttcttagcgattttcagcacttaccctcataactttacttgaatcagtttaaaagccataagaaacgactatatggctttctaaggcataataaactgtttatagctttgaatataacttgatgttctctatcagtggttagcaaagtgattatttaaagataaaagtaagagattctctaaaagctcatattttgctttctaagcccttttaagtgttagtcctaataaagtttacctgattcgttttaaaactccttaaaagctctgtaaagcgtcaaaaaaagcctttgaaactttaaaaggcttttaaacttatttattttgtaaaacttcgttccaatctttaaattcttttggtaaatcattttgaaaagggatatttttaaattctaagtgctgtaacttattacaggcttgttttccagcaatatcattatcaaaacaaacgtgcaaagattgacaagtttcttttaaatttaagttttctataccgtatctaaaaaatgaatagactttttcaatcgcaactccattgatagatattaaccaaaaattgccagtttcgtttaattcttcttcaaaaatagaataataacttaataaatcaatctcactttcaaagaaaaagatatgttttggttcaccactaagataattaaacccccacattgtatcagcttctgttgttggtgcaacatatttaaagaaatctcttttagtatgatatttctctttttcttcgtctgtgagtgggatcgtaccttgtttagaaaaacctacaattttgtcgcctttaaaccatttaaaaatgacttcattattttcattttgagaaattaaatcataagaaaaaaataggcgaacaattttattaggtatttttcgttttgcaactaaatagcgttgcgtttctatggggacaatagcttctttaactttataattaaattttttaggatagctttttttagggatcgctggaagaactttaccgtctaaatcttcacttaattttgagagtgtttcttgtaaagataaattatgcatgatctgcatatactgaacaactccacctcgtgaatttttttcagatgaacgactattccaaacaaaatagtttttcctttgattaatttttaaactatcatgatgtttatgttgatagtagttatgaccaacactttcaaggggttctccaattgaaagtaagtagtctacgatcggtatattgtaaaagtccactttgtgtttttccataaaaatcactttcctttattaattattatgctttagttctacgctccaatgttttttcttttgattcttcatttctaaaagttgaaattcttttcacttcaaaatattcttttttaccctctgaattttctttaaagtaactgtcgtgataaccaataagactaactaatgatccttttgtcacatattctgcaatgcgactggcaatggggttgttttttgtatcaattgcggtgtatttaataaaaacagattctctttccccagcttcattttttttaaaagggtgttcttgtgctagtgtgattgaaacaatagcatttcctgttttttctgaaatattaatttgaggactgtctactaatcttcctcttgctgtaaattgattgtcagttgctataaacataaagttctcctttttattgttttagatttcttggttgaaaccaaaaacagaatggggctaacatacagtagtaagtaataaataataataatgtggtgtgattttcaagtggttcgtggaaaaaaattagcggtgctgtcgcaaacattaagctaaaaatactgaaaaaccaaatgaaaatatgaacgacacgaattgatccacgattataatttgttgttttttcaagtcttctttgaattaaatattcaaagggaaatagtaatcttcttaataagaaattgctacttttattgctagaacgcatgagagcaattaatggcaaaaagtagatacaacttatataaaagtaaagccataagtccatgatttttttcatgagaaccgtcttttttctcaattttacactaaaatagattttttggaaaactttgcaacagaaccgacaggagcaataagggatttttaattcttgaaaagggaatgaaaaaggaatataataaaaatgcttacaaagttaatgaaaaggagatttttaaaatgaaaacccaagaacttaatttaaaacaatttgtaatgttgtctgaaaaggaacttcaagaaattagtggaggaggcggatggggttctgcttttgcaggatggcttggaggaattggtgttaattcaggtcaaactgcccaacaagtagttaatcaattaaatggtgtaacgggctttcacgcttataatcataatccatatggtagtggtggtacaccaaacgattgattgagaagtatgtttacattgattttctctaatttaacaggaggtataattattaaagcgatttataaagataagactgtagatgtctgggaaataagtaaaaataatgaacaaccagattgggtaaaaaatgcatttaaagaaaattatcttagttggtatgacgaaagattaaaaattctaatgaatggcatcaaaccttcagctaaaagttctttaaaattgggaattatgggctctgttgctggaagtttagctggtggattagcgggaaacaatatttatgtgatgggtgaaattggagattatttagatataaccaaccgcaaagttgtatctaaagaaaaatttttaaaaaaatatagtgtttgaatcaaaacgctctttgagcatttttttaggttttaaactgatttgctgagcggtagtgttggaaaaaattcgtgaatataaaaggaaaactacgacaagaaagtatttactaacaattgtctgagctagttttctcgacagtggtgtcactatttttttatccaggaagataaggagaattagatattgaaatattttgtgacatttttgtctccaacacagaacatgggaatattgaattggcaaacaatgatattggatgattatcttgttgatgattcctactgggaaaataccaaattagaattatcaaaagaagtagaatggattacgcaaagtgaactctacaaaaaagtaaaacgcaatgatggttcgggtaatgatattatattatcggtaccagttagtgcggttttagaaacgataaaatcattttttatactaggacacagttaatgatatgttttgtactattcggtacaaaatgtttgtatttcaaaaaagaagatgttaatataattataccaagtggtacaaaacaatgttgttagatacaatctaatctaaccatttgaatctaaaaatatggaggtgtacaacttgagaaatacgaaagaaaagatattgacggctacagaacagcttatatataaaaaaggttatacagggacttctattaatgatattttagatgaaactgcgacaggcaaagggcaattctattattactttgattcaaaaaaagaagcttgcctagcagtcatcgataatcatgttaaaatttggcaaaaacatttgctaaatggaatcctatcgagagatgaaagtccactggcaaacttgaaagagatgctggattggatttacagtgatcatgcgcaaaaaaaaatatactacggctgtcctgtaggtaatctcgttattgagctttccgccctagatgaggattttagaaaacctcttgaacaactattttcagatttacaaaaaaaaattgcggaaaatctatcaggtttaacaggactgctggtgaaacaaaatcttcctgcagcacatgcaattattgctcaaattcaaggaagtcttctactcttgaaagtgactcaagatttaaatgttctggaatcaaattttgatttattaaaaactatttttgaaaaagtgggagaaaaataatgaaaaaattggatatgatagttatcggaccaggtcctgccccgcctactgctgtgatacgacgtaaatctttatgtcagcagttgaatctaaagaaaaagtcaaagcttttgcaggtagatgcgattcggagagaatataccattgccgatgttcaaaaaagatggcaaagttgtcaaacattcatagacgttcttcgtaaggggatacttaagcaactcattgcagaattatcataaaaattttatatttaaaggagaacaaaatgttcaataacaaaaatacagcattcgtcgttacagacccacaagtcgaattcctcaaaccaaaaggtgcaggctatggtctaacaaaagatatcctcagaaaatatcataccactgagaatcttacagaactcttcaaacatgctaaagcaaaaggctataaaatctttatttcaccacattacttttacgaccatgaccaaaactggaaatttggtggtcaaggcgaacaaatgatgttgaataataaaatgttccatcgtgaacaccagtatcaagaaacagtgaaaggttcaggagcagacttcgtggaggaactcaaaccttacttggatgaaaatactatcatcacaagcccccacaaaatcttcggtcccgaatcaaatgacttggcgcttcaactccgtaaaaacggcattgatactgttatcttggctggaatgaacgcaaatctctgtgtggattcacacttgcgtgaactcgtagaatcaggttttcacgttcacgttgcagctgacgcaacaggagcacctggtcaagaagcctatgatgcagcaataacaaattttggatttgttgcagatcgcaccatgagtacagcaaaagttcttgaagagctttgaagcaataggtaaacaggcaaattaaatgaaaataatatttgatgaactagctactgaaaaaattaaaagcttcggtgctgtggtaaatctatcgtggataataagttagttcaaaactaaaatttggagatttttaaatgaaaaaaatagacgtaaaaaatatcgttgttggttttggtaaaggtggaaagaccttggccaaattcctttctggaaaaggagaaagtgtcgtcgttattgaacaatcaactctaatgtatggtgggacttgtatcaacatcggctgtattccatcaaaatttttgattgtcaacggtgaaaaaggtttgaaattcacagaagcttcagaaaaaaaagcgatgcttacaggtaatttaaatctaaaaaattatcacatgattgcggatgaagcaacagctgaagttattgatggcaaagcaaaatttgtctctgatcacgaaatcgaagtgatggatgctgagggtgaagtcattgcacaactaattggcgaacgtatctttatcaatactggcgcgacacctgtcttgccaccaattcccggacttgtggacagtagaaatgttgtgacttcaactgaattaatggatttgaagcagcttcctgaacatttgacgattattggttctggttatattggtcttgaatttgcttcaatgtttgcaagttacggatcaaaagtaacagttcttgatattttcgataacttccttcctcgtgatgatgaagatatttcgaagttggttcgttccgaccttgaatctagggggattatctttaagcttggcgtgaagattgatgctattactgacaatagcgttgaaataataaataaagaaggcaaaaaagtttcaatcttatcagataaaattttggttgcaacaggtcgcaaacccaatactgctggacttggacttgaaaacactaatattcaacttggtcaacgtggagaaattgtggtcaacgataaacttgaaaccactgttcaaaatgtatgggcacttggggatgtgcatggcggtttacaatttacttacacttcccttgatgatttccgtattttaagtaataacctttatggagatggtaagcggagtctgtctgaccgcaaaaatgtaccaacctctgtgtttatcacacctgccttgtctaaagttggccttaatgaaaaagatgctaaagcagcgggcatcgattaccgtctcttcaaacttgctgcgacagccattccaaaatcagctgtcttgaatcagtctaaaggcttactcaaagctttggttgatccagagacagacaaaattcttggtattacaatttacgcagaagaatcttatgaaacaattaatctcgtaagtcttgcgattgaagtaggcttgccttacacattattgcgtgacaaaatttacactcatccaaccatgactgaagcattaaatgatttgtttgccgctaaaaatgaagtaaaataaaatagtcaaatttgatggaaatcgagtatgagttactgacatactaccaataactttttatatcttgataattaaaacgaaagtttttaatagttattttaagtcaatttaatgaattgcccgattagccttgaaaagttgagcaatatgagcagattatgacagttttatgagaagatgagagtgtttatctttcttaattaaacgagatgacaaaaaaacgaagttgtgataaaataagggtaaagaaaaaggacttgcgctaacaagtcctagtgtagccgattaaaagtcggtggcagtataatgttctaagaaccgttaactgtaatgacccccaaaatatagacttttcaaatctatatttcggaggtcttttcttatggtcaaatattccatagaattaaaacaacgcgttattcaagattattaattttgtatttttttaaaatcatggctgttctcttataaaaatttttagtgagtgttgcaggttcatcactataaatttttgaagttcatttaaattcttcttcatatgcatctcctttgttataaaaaactatatattcaaactattttgaatatatagcataatattagcacttgatcaataacatgtcaaagaagtttgaacatttttaatataactgctattatttaatcaaacgtagtatgtataataagtttcatctactaaaaaaatagataaactgacctattataaataggtcagttttattttatagtaagggtttattcaaaatccagacctgttatatattttgaaatctgccaaagtctatctgcgtcattgtggtctactgcatgcggacgtaagcctccagaaaaattattagcttcttctgatgtcataagtctggcaatattaaggtcttcacaataaagcccacccttaccttctaaatcagggcttgttgaggcccaaagaggtgttgcggcaccttgagctattgtttttaaatagcgatatttacttcggtcaaagccggatttaagtgcattaaaaaatacggggatatgaattaatttaaaatagtcggctaggtagcggagccaagggataataggtgaattttgacgaccaatatttgtcattggaatcatgccagggtggacggcaaaacttctaattccatatttttttcctagttcatctagttttattgaaaataaaacgttggcagttttagattgttgatagcctatttggggactgtagttttctattttttcaaaattccaatcttctagtaatggtgtcatttgttgagcacgactggataaatttataactcttgagttttttgcattttttaaagcgggtaaaagttccattgttaattgatagtggcctagatggtttgtggcaaagtgatattctattcctcgagaatctctttttaaaggaaggtacattaatccagctgaattaataagaatatctagttttgaattattttgcaaaaaactttcggcaaattgatgaatactttttggattggtgagctcaaggggaagaatgtcaatattttttattttagataaatttttcttggctacctccattcttcgggcggggataataatttttgctccagcacgtgaaagttgtttggtcatctctaaaccaataccagaatacccaccagtgatgatgattgtttttcctgaaagattaatatttttcataactttatttgctgttgttttataattaaatttgtagtttgctattggttcttgatttgacataataaaattttcctttgtgttataatatttatgtgatacaagtgtaacagcaaaaaagaacttttacaattaactttggacggtttgtctttaaaagtgacaacaaaatgaaagtgtaacagaaatgaagcgaaaagagcaatatcaagattttcatgactttattattgaaggaacgatgttgtgtttagagaaatatacaatcaatgaattgccattgacagaagtttgcaaaaaagccggggtgagtcggatgactttctatcggcacttcaaaaataaggaagaagtcgtattagagtattttgagctaatctatgataaatttcttaaagaacttttggagctagaaagtattaactcacttattttaagtgagaagttggtgggactatttgttgagcaagaagaagaaatagaaaaagctgtcaaggggaattattattcgctggtttttcaggtatttgcccaaaagatgactattttttataatgaaacaacgacttgggctgattatctagggacaaatcaaaaattttggaacgattttatggctgctggtttattttatgttttaggaaattgggtgaaaaatggctgtcaagactcttatgataaagtggtgaagatggttgtagaattccatgaataagtgaacagataaaaaggctcaaattattttgagcctttcttttagccaataaattttttcccttgtttattaagaatcacttttgtaatttcaatgacaagagttgggattaaagctaagatgatagctattagccagtgtgtcattgataatggagcaacttctaagatattcatcaaaataggaacatttgtaaagagaacggttattcctagtgacaataatgtggtaccaaaaatcattttattagttgtaattcctcttgtgaagagagattcattacttctagcgttatagacattaatcgtagaagcaagggttagtatcacaaaggccattgtttgcccgagttgatggttgggtgtcaatccagcgatttcaataaacctaccgagataaaaaccaattagagcagtaatgatgaatgcagtggaacaaatggcgatgcgccagctgactcctcttgagaagatactttctttgactccaacaggtggctgttccatgatatgactgtcggctttttcacgtgaaagtccaaatccgggaattccatcagcaaggacattgatgtaaaggagttgaattcctgtaaaaggcattccccaaccgacaattgctccaatgagcattgttagaattttagctacgtttgctgagagaaggtaataaattgtttttttgatattggtgtaaacacgacgtccttcacgaatagcggcgacaatggttgcaaaattgtcgtcagcaagaatgatatcagatgcagacttggcaacttctgtgccggctattcccattgcagttccgacatcggcagctcttaagctgggtgcgtcattgaccccgtctcctgtcatggcgacgatttgttctttttcttgccagatttttacaatacgaagtttgtcttcaggacttactcgggcatagaccgaaatttgttcaatcatttggctaagttcatcatcggtcattgatttaagcgtcagtccatcaacaactttatctccgtcacgatagatgtcaatttgttgagcgattgcttttgctgtaagcgcgtggtcccctgtaatcatgattggtttaataccagctgctctagcttcttgaacggcagcttttgattctaagcgtggagggtcaatcatgccaacgattccaagaaaggtaaggttattttctaattcagttaaatcttctgggattttatcgatgattttgtaagaaagagcaagaacacgtagggcttggtcagcaaaaatatcatgtattttttgtgcttgatttaataggtcatttgaagaactcagctgttctgaagggttttcagtagtaaagagtgaagggtgctgactttgatgttgactgcttggtgcaagtctatcaaaagcgcctttggtcagtacgagatatttttcgttatttttagggtgaggaatgacaacggtcattttcttacgtgaactatcaaaagggagttcagcgaggcgtttgggtgccttttctggctgatagagtttgtgagtgattaagaagcgaataattgctgcttcggttggatcaccgtggacttcccaatcaccatcaatgagttgagcactagcatttgaggcataagcaaagttttggataagagtgatttctgagtttgatagttggcctccaggccaactatcttgtccagacaaccagagtttttgtatggtcatctgattttgggttaaggttcccgttttatctgaagcgatgactgttgcatttccaagagtttcaacggcaggaacgtttcggataatagcttttttctgagccatattttccacaccataaatgagactgagagttacaataactggaagcgtttctggaacagcagcaactccgagaacaacggcagtcattaaattatcaactagaggaacattagcatataaaaggttgatgacgaaaatcaaaattccggcagcaaaggctataattgctaaacgttttgcaagtttatcaattcgtttttgaagtggcgtttttcctttgatttgttcgccgatgagtgttgcaatttgacccatttgcgatttagaaccaactgctacgacaattccttcggctgttccgttaaggatatttgttccagaaaaaaccatgttgagttggtctcccaaaggaacttcatcagtgatttcaaggtcagcattcttatcaattggttcggattcacctgtcagtgatgattcgtcaacttggaggctattgcttgtaagaaggcgaatgtcggcaccgacttgcacgccggcggtcagttcaataaggtcaccgcagaccagctcgcttgaagggatggtctgacgctttccagagcgaagaacggtcgaagtgggagaagagagtttttttagggcagcaagggcgttttctgccctgttttcttgaaaaatggaaatgaaaatattaatgatgacaataaggagaacaacaattgtcttggtatagtttccgttgctgatatatgctaaatatgcagagaggaggccgaccaaaatcaggatgatattcataacttctaaaagatggtggagaagtttttggagaaaattaggtcctttttgatcttcaaaattattgtggccatacttgatgcgagagtttgtgacttgagttggactcagcccagttttcgcattaatatcataaaacttttttatattttcaatggcttctgttttatatttcatatcaattttaataaggaaaaaacaatttcatgaataaatcaaaaattattgctttctctgcagtttctctttctgttgctctgttactgacagcctgtggaaactctagcagcaaatctgaacagccgactcaaaaggcaaattacagctttgcaagcaatattttaacccttgacaccagcatggcagctgatgttaattctattgatgttcttctcaatgttgatgctggacttgttcgttggaatcctgatgcgcaagttgtcaatgatttggcaaaatcaattgacctttcaaaagatggtaaaacttataatgtaactttgcgagacgggttaaaatggtcaaacggagctaagttaacggccgctgattttgtttatggctggcaaagaaccgttgaccccaaaactggttcacaatatacttatgccttgacaccagttgctaatgccagcgaaataatggccggtaaaaaaacagttgattctcttggaattaaagctgaatctgatacaaaattagtcatcactttagcaacacctactccttacttcaataaattactgtcacttccagcttattatcccgtcaatgaagctttcgttaagaaaatgggaaataaatatgggacaagttcagacaccagtctctataacggggctttcaaatttgtcaaaggaaaaaataattggactggttcaaatgaaactttctcaattgtaaaaaatgaccaattctatgacgccaaaaatgttaagctttctggtgcaacttaccaaatcgtaaataatcctaacactgctgttaatcttttcaaatctggaaaacttgatgttgctaatcttgccactcctgaattagtttctgcaaacaagaagaataaagattataaagctttgacttcaccaagaattgatgttttagaataaaatcaatctggtaaagttcctgaactttctaatttaaaaatccgtcaggctctaaatttggcaacaaatcgtaaaaacttgcttgagattgctgcgccaagcttttcaattacaaatactgtgacccctaaaaagttagaccaagcaccaaatggtcaagattttgcgacttacgccgctcagccttatacctacgatgccaaaaaagctgccgaactttttaaagaaggtctaaaagagttaggaaaaacctcaattacacttgaacttgaaggcgctaatgataattcattcgctaaagcggcagtggattatctcaaaggaaatcttgaaaaagacttaccaggtttgaccatcaacgaaaagctagtctcatctgctcaatgccaaaaagatgcccaaaataataatttccaaattttattaaccagctggggggcagattataatgaaccttctgatttcttgatgaactttgtgtcaggaagttcaatgaatcacggcttagtcgacaataaagactttgataaagcttataatgcagccactacaactccagacgttctgtcagcagataaacgatacgctcattataaagatgctgagagagcactttatgaatcagctaacgtcaacccacttgctaccgaatctgtgtctttattactgaatccaaaactcaaaggaatttctacttataactcagccatgatttttgatttacgtcacgctgaaatcactaaataataaaaaaatttactgacagatttttgtcagtaaattttttattctgtcagtaaattttaaacttcatgacgaacatggccgggctcaaataattgcccccaagtcatatttcctaagacttttttattaatgacttgattcaatcgactaatgctcacgccatcagtgcttgttgaatcatgcaaaataaagcctccaccaagataaatagccgcatgttgctcatcctcacttgcatcgtcagcagtaattaataaatcaccacgtgctttatcagaccactcttcggctgtccctgtttgggcaagtaatgaagttgaagccgcaaattgataaaccaaagactgaccacccaaacgaaacacctgagcaatgaaacttgagcaatcaaattcatttttcgctaccgattcatcagttcgtcccccaccataaacataaggactctttccaaccaatttcattcctgaagaaattgttttttcaatgaccttattatttgtagtcaattgactagctactgcttcataagctttgaccacatcatcttttccagttttctttgagaaataataataatatccatcaattttatgtagtccatagaccattttaccgtttgccggactgaaataaacggttcccccattcacagtctgcaaacctgtcttcatgacacccgttgatgaatcaaaataataattattcccattaattgtttgaagacctgtcaattttttttgcccagcataagcataggttttatttgatttattaaccagtttaatcgttgattcctgaacatcttgactatgatatattttatagccgacaagaaaacataggaggactaggcaagttaaaataattagttgtccttttttatcaatatttttggagccactttttttatcattatttgttcttttattcatatctatttataacacgtgaattttaatgataacttaataagagcattttaagatttagataagaaaaggtgatttgaagttaatttcaaatcaccttttttcatttctaaaagagccacaaacaatctagctaattttctcaccaaggtttagccacttactttttccaactcttgataaatttgacggaaaacagtcaaaaattgttcaacttctgccatattatttgtaggatccaatgagattctaactgcgcttgttgccaattttgaaggaacattcattgcaactaaggttccagcggcagcatttttctttgaagaacaagccgaagtggttgaaatatagatatcatgctgttcaaaagcatgaacaacaacttctccacgaacccctcgaataccaaaagttaaaatatttggtgcgaaatcagtcattttactaaaaacatgaacttttttatgtttttcaagttcttctaaaatcgcttgtttcattgctaacattttttttcttttgaagtcgtcttcatccacagctaatcgaagcgccttagaagtcgcagcaattccagccaagttttctgtggttgagcgccaattatgctcttgaccaccaccatgtaaaagaggagttaatcttttcccttttttggcgaccacaatccccactcctcgaggaccatgaaatttatgagccgataaagttgcaaaatcaagtcggtccgtcagccaagtttctaaaggaactttcccaatcgcttgcaccgcgtccacatgaaaagaaatggttggcttatcggctaatagttcagaaatctcctgaatcggttgaatagctcccacttcattattgactgccatcactgatattaaaatcgtttcatctctaatcaatttttcaagttcggaaacaataacaaaaccatccgcatcaacaggcgcataatcaagttcaaatccttgagtcttgagccattctgccgcattttttactgcaggatgttcaacgctggaaacaataatatgattaccataaggtcttttttcaaaagccacacctttaataatccaattatcgccctctgtacccccacttgtaaaaaatatttcttgtgaatcaagaccgagtaattcagcaatttgtcgtctggacgcctctagcaaacgtgtggccgtcgttcccaagccatgtaaacttgaagggtttcccataatttttgttgctacatctgtataagttcgtaaaaccattggattaactgcggtcgtagcagaattatcaaaatatatcattttttatccttaatatttaaaaatcaatcttattttatcacaaaaaatgtctgagcgttgaaaaataatataaggactaaatatcaagagcatctattgtaagaaaactcagctctctttattaaattttttgacaatctgccgatttctaatcatcgaataaatataaaccaaaataaaaataagaagccaggtcacagtaaaactccaaatatgattatgccaagagttatcaaacaaccaagtattcactaataagtaaataaaagctaagagataactacataaggcttgactgataaactctaccaaagcaatactaataaactcatcaatcactttagaaatgaaaccttgaataaagccataaagaagaattaaagccatagactcaagctcaatctttccgccatatagtaaggtgagaaaaagtccacagactaaagcaataaggattcctttaaaagcagaaattaaatatttcattttttagctccctcttttaattttgggctgatatttgccaaatatcttcggctgacaggcagtttatcctcagaaatccaaagtaccaccccatacacgaaatccgtttctaaacgtgtaatttgctcaaaattaaccaaagtatttcttgaaattttaataaagtctttggctaattttttttcataaaagtataaaggagaccttactcttatctttccacctaccgtataaaattcgagataattttttattgattttatataagagacagatatattatatttttttattatattaatagtaggcgcactggtaatgattggacttgttcttttacttgttacagcctgtgagtatgatttatcccttaataaatttccatctgcaaaaaactggtaggaaaaatttcaaaaaataatatttttatctttagatatcaggctgaaatgcagataaatctgctaaaaaactgacttagcatcggatataagaaatagcaaaattaagttgctcagacttatgttatataagacatacaaaaactaaagatataaatcgttgataatttctttgaaatttgcgaaaataagagatagctatttgtaaatgtaatcaatggaggctaaaatgagcgaaattataaatcatattaccgcttttcaaccagtctatcgtgttcttcatcgtgaagaaaatttagatttttatcgtggagttctaggctttaaggtattggtagaagaaggggcaatggtatggcttggtggacatgaagcgaaaaaagatcgtttccaattagaagaatcaccaggttttcatccggttgaaggattaaaaaaacacggacagactgtcattaaagcaaattcatctgagattgaacaattaattgttcgtaacttagataaaattgctaaaatttatcaaggaaaaaatggtcttgcttttacggctctttctcctgaagcaggtctttttttggtaagttcagactcactgacagacctaccagcactgacagaaattaataaatcagaaattaagctcaatcttgataaaaatttcaaaggtttatcagactttgaaattacagcaatgaacttaaatgttgctgacaagtcaattattgaattttacgaatctgtatttgatcttaaagcgattgatggtaaaattgaatttccgtttgtgactttgaccttaaatgttgaagaaagtgaagatttaactgcagggacagatgaggttcttgaccttgaatttttgatattcatgattgataaagactttgatttgaaagcttttgctaatcaattttcagaagcaaatggaacttacatcgatgcgtcagcaaaaactttttctttagaagttcctgaccatgctgaactttggtttgtaaaataagaagttagtttaaaaaatctgttaaattttgacagatttttttgctcaaaagaaaaagaagcagaggataaaatgaaaaatcaacaagaatttttagcgatgatagaagattatcttgagcgtgatgttttccctggtgttaattttgcaattcttgagggagaagaagtttctgagtatttatttggtaaagcagctcttattcctgaacctatcgctttgactcctggaaaaaaatgggatttggcctcacttacgaaagtgattgggactggaactgcggtcattgaccttgttcttgctggaaagttagaacttgatgcgccgcttcaaaaatattatgccaaatttactgacagcacggttagtttgcgacagttactgacacatacttctggaattgatccctacatcccgaatcgggacaaattaggtttttttgaactgacagaagcaattaatcagattagagtaactgatgataagagctttaaatatactgatattaattttattttattaggatttttattggaagaatattatgatgaaagtctagattatatttttaataaaaatattttcaagaactgggaaatgaagcaaacaagttttggatcagtagaaaatgctgtacctacaagtcaaaatattccgctagggacagttcatgatcctaaagctcaagtattaaaaaatcattgtggctctgctggcttgttttcaaccttatctgatatgattttatttagtcaagcttattttagagaagagaaatatttagagcttttgaaaaattatgctgatggagcgaaagaaaggagcttagcttgggacttaccagctgaaaataatgattggctccttcatacaggatacactggaacttttatattaattaatcctcgcatcaaaaaagcagttgtttttttatcaaaccgtgtacatctcaaggataatcgagaaaaatggattgaagaacgtgaccgattaataaagttcttaatcaatcatttaagtttagactgatatttttgaatgaatcaacaagtagaactgtaacttttagtttacggttcttttttagttgttgctgatagactaagaaaataaagtggagaactcaaataatttacaattagattattttgacctataatttacttagaaagtattttatttacctaaaaatgaaaggggaatgtttaataattagtattttttaaagcagtgttaacatagttagtaattgatagattgaacatcaaggagaaaatcatgacaaaaataaatgcagcagatgcaatgttaaaagttattgaagattggggtgtcaaaaatatttacggtttacccggcggatcaattgattcgacaatgaacgcattatataatcgaaaagacacattgaattatattcaagttcgccatgaagaagtgggggctttagcggctgtcggagaagcaaaagtaaccggagagattggtgtaacctttggttcggcaggaccaggagccgttcatttattaaatggcttatatgacgctcaatacgatcatgttccagtccttgccttagttggacaagttccaacaagtgcgatgaacactaattatttccaagagttaaacgaaaatccaatgtttgctgatgttagtgtttataatcgaacagtaatgacagcagaacaaatgccagcggtagttgacgaagccattcgtcaagcctatgctaaacgtggtgctgctgtcattaccattcccaaagatttaggttggcaagaaattgaagacaactatatttctagtgcgaacttatatcaaaagccactacctttagagcctgatagtgaaagaattcaacaagcttggaaaatactaaaagaagcaaaacaccccttgatatatatcggacaaggaacaagaggagcacgtgaagaagttttagctctttctaaaatgctacaagctccaattttgagctcagctctagctaaagggatagttcccgataatgcgcctgcatatatgggctctgctggacgggttgcttctaaaccgggggtagagattgcctctaatactgatgctgtgctattcttaggttcagatatgcctttccaaagtttctttatccctgaagatgccaaatatattcaagttgacattgacggaactaaatttggacgtcgtcatcaagttgatttggccattttggctgacgctaaattgaccataaaaaaattaatggaaattggagaacaacttccagaaacggcttggtatcgtgcagccttagcagacaaagaaaattgggtagaatggcttgaaaaacgttcgcttatcgatagttcaccattagaagtagagccagtctttaaagcaatcaatgaaatggcaactgatgatgctattttccaagttgatgtgggaaatgtaacaatcgatggcatgcgacttcttgatacaagtaaaaaccaaagatttacgacaagtggttggtatgctacgatgggctatgctttgccggcagcaattggggcaagtctcaatatccaaaccgacaagtttggtcaatttctggggatggagcttgggcgatggtgatgcctgatattttaactcaggtcaaataccatttaccaatcattaatgttgttttaactaataagagcctaggctttattgaagcagaacaagatgatgccaaacaaccacactctggaattgatttgattggagcaaattttggagcttcggcagcagctttgggtgcagtaggatttgatgtcaataacttgtcagaactgaaagaggcctttgcaaaagcgaaagaaactgatcgaccagttgtcattaatgtcaatatttttgaccatcgtcctttgcctgttgaacaattaaaacttgattcatccatttacggagaagaaactgttgaggctttcgagaaagaataccaaactcaaggtttaattcctttcagtaaacttattaaagaataaaaaaatcattagaaaaaaagatactggatattccagtgtttttttttattttgaaaaccttaaacaaaatgaaggtgaatacaaaacgacattttgaaatgtattttggttggggaatcaagggcaatatgagataattattttgttaaacgagtttaagattaaaaaatatctcgtaaacacatttttagaggggctttataacaaaaagatgagaaattgttggtggcttggagagttttttatattgcttgtaataaataaattatattttgtgaagaaaggagtcttagaaagacgaaaagtttttaagaacaaaagaataattctgataagaagggaagattaatgacaaaaaaatgggcagtatgtttaagtataattatattggttataaactttattccaaacctaatgcaaggacctaaggttctgtgacgttaagtcaatattcgggtgtttaataattcttcatatgccacagaaccattatcgttgaaaaatcgacgttgaaaaagtcgagcactattatctacaggtttaaagtattctgaaaaagttttgacataagtataatagtctcgttgaattagctttccattaacaagtaattctgttttataaaccttatcagtcgcaactttatctaaatatgccatcaaacgtataccattctcttcagaaatataagtaaccgaattagtagatgtttttttctctttaattgtaaatgtaatttctttttctaaatcttttacactaaaggttgttgggctaattcttacatccgtaaaagattgatatagccaaataatttcatcatcttcaaagccaatattctgagccataggttggagattttcctgaaacatatcagtaaaaatgaattttgctatttgcttattttttttgaaaatatttgaacgataagcttgcgcatattctacaccactactagcccatccaattcccttgttgaaattatatattgtcatttttattatttctcatctttctacaaatataaagcgttttgaatctcaattaataattttttagcaaagaagccctcttttataagttcaccaatatcctgagaagccttttgtttttctctatatatttcttctgtcatatcttttagcagttcaagcacttcatccatattttcacaaacaaagcctaagttatatttttcaacaaagtcttgcttagccatccctttattcacaattaacggaattccagcagctaaataagtagaaaatttataagaagcattcatttctgagtattctctctcgtgttgagtttcaatatcttcactccaaaccaagccgtatccaccttgacgaagagaacgtaaaagctcatcatcatgcttccaaccttgaataataacattaccttggggctcaaattatcctctactaaaaacttcaaggcgcgtctcactcttccagtttttaacaaatggaaagcgctccatatttcctgcaaatttaaggacaggttcaaaacagggcgtctcaggaaaatccattgtggttacatgatcccagacttcttgatataaaactggaggtgtaagccctttagctcttaagcttacttccattttgcttgatggtaagacaaccaagtccgcctgattgtaggcttctaaatatgcatcagccaaataagcatttcctataaacatcaatgggacaaaatcatgaacgaacacaactagtttttttgctcgttctcgcaatttttttaaaagtactttatcaaaagcaataccattccatgttggcatttgagcaattactaatcccccatattcaaccgaagtaagcatcccatcaatacgcttttctttttcttcttcactatcgtcactcactcgataagcagcaatattaatttccttataacctatttcttgtgctaaattcgttattgtatgctgtccatgcattgctgtgctttgtaaggaatgaccataaatattagtaatatatttattcaatttttttattactccatcttctttaagggaaaattacgactaactctcctttttttatttcaaataaactcaaagcaacatttcgaataatcatcttcgaaagctgctctttatgatatccataacttctttgagcttctttttcatactcaatcaatggcgttttttgtgcagtggctcttgaaggaactacaaactttaattgatttaaaatttcaatttgactactccaaatcgtatcaatcgcttttaatatgcctatttgtagatactggaaaaatgctttatcatcatgaagttgagcttgtttgttctgtaagttcttctcaaatacagactgaatgaaattctcttttcctgcttgattttttaaatattgaaatgcttgaatttctttgaaattatagtcaatgttatctaatacaaatctttgtaattccacttctgtttcagaacctttttgttcaaactattcttttagtgttaaagagagttgctgacttaaaaaattcaaaacttcgtcaatatcagaaaattgcagaactctttgacgactttcattgaacatatctttttgtagtttaagaatattatcaaattgcaaagattggcttctttgaccttctccttgctcctctgatttttgctgggattttttaaatgttcgtcgtaaagatcctcttcttatttttgggggaacttgatgatatggaaggttttgtgatttttctacgcgtttatcataatatttttgaactcttccttgcataaattttttaattacatcatcttctaaagattcataactataagttacccctggttctcctttgcgtcctgctctgccctttgcttgcagctctccgcgtcgattaggtaaacgttccgtaataataaccgcaagcccacctttttttatcgactcttccgttatttttatgtctgtcccacgacctgccatagttgtagaaacagtcacagcaccaacacgtcctgctttcttaatcatttgggcttctttcaaactactttttgcattcaagacgttatgagcaattccaaggtccaaaaggtaaagagacattaactccgaagcatcaacagaaccagtgatgattaataaaggttgttctttcttatgcaattcttgtatcttcttcaacgctgcttttaattttgcttcattggttacgtaagatagagaggaatagtcttttcttttatttttcttatgagtttttatttttttactggcagattatatgtcccaataaattcaggttctgctacttttgccgttcctgacatccctgaaagttgacgaaattggcgaaatagattttgataagttactgacgaaatcgtttgagactcgggagtcccttttgccccctctttcgtttgaactgcctgatgtaggccactctgtaagctagaaccttcaagtattcgaccatctttacggctcaagagttttacttctccgtcttcaactagataatctttatcttttcttattgtatgctcagcctttaaggctaaaatcacatgttggtagaggctaaagtaaggtaaacccaataaattatccacagaaaaataatgttttgctttttcgattcctttttctgttaaccaaacattttctccttcatcgtccatctcatagtcttgttttattctcaaagtttgaacaaatcgatgcgacacatcaaaataattagactgaacctttggatttcctgaaataataagaggagtttgtgcggtatcaatcaaaatttcatctacttcatccagcaaggcaaaagtgagttctggcataaaacgattttcaggactatctgctaacccatctattaaaaaatcaaaaccaaattctccatttgaggtataaataatatctcccccataacctatctttcgctgttctacaagacttttagtctcattttctaccgcactgctgtctgaaacacttagacttagccattcatagacagggccaattcgttctttatcccttttagctaaatagccatttgttgtaataagaaaagaccgccccatggttagagcttttaaatacaaaggaagagttgcaactaaactctttccttcccctgtcttcatttctgcgacatagccctcatacagtaccaaaccacctaaaacttgttcatcggtatgaaacattttcaggactcgatatgaggcttcacgtaccaccgcgaatgcttcaacaataattgcttcttcatcttcgttgttagcaatttttttccttaatatttcggtttgcgcctgtaatttttcatcagacattgcgcgataataagttttctgttcattaattttttttaataatttttttgcttttgaatttcgcatttttttctcttatccctactttagacatcattctaaatagctgttctagtatttcttaattcccttttgtcttcacttatggttttttgcttgtgtttaaatctttattttcaaatgacatttttttcatgaatcagccaattattcgttattttacacatattaagtttttgtttttcatctaatcttcgaaaaataatttcagcagaatttttatcatcatggcctttcaactcgtaaagttcacttttcccaaacaaatattctggagaaacgttaaagtattctgatagttctaacaatcgaagcgccgacggcatgtgattcattttataattatttaaaccatttctagaatagccgagttctttttcgacttggtttaatgactttcctaaatttttactcaatagttttagtcgtttataaaatatgctttcgtccatttttttgattccttatcaattatgatttatatgtttccgaaaaatctaaatttttcggagtctctaaaaacgtacgatatatcgatagaatggacaatctaaacttgatcaaatatgacaacagtagtcttttatatttatcttctgtaataactattatacatgctttctggagtatttctactataaaatttaaaagactattaaattttttatttcccatcaaattatttattaattttttcaagaaaacaataagtgctttcttgaggcctccgattagttcactttccaaacacaaaatgttcaaagtttttgaaactcatactttctagttacccagtttaattcgtaactataatgagtatttctacttttaattttttcatttttcagtaacagagcactaactttaagccttagataaaaatatgttcccttgccacctctattctctttaaatagcactataagtgagtgatttttaaaatttatattggcatttgtgaatgtctttgaacgtttgaacaaaggcactaacatctgcaaataatttaaaatcacgttacactttattctatcacaatgtaagcgcgaataaaaacgattgaattgtaaaaattattcaacaagagtaacctcaggagcaacaatgtcattttaaagatacaaaaaagcctatctctcaagataggttttttcattcctttactaattaacgaacatctcccattaatttcaaaataggttttttgataataaggaggatgattccaacgataataccgataatacctgtaattgcaaagaagtgaacttctgttgctgctttaaagataggtgtaatttgggcattaatcgcttgtgaagttgagtctgccaagaaccacattgccatcatttgagattggaatgctactggcgctaattttgttgaaactgataaaccaacaggtgaaacaagtaattcacctgccatttgaacagcaaacatcaatactagccaaagagcactcgcacgtccagaagtcccattcaagagtccaggaagtgtcataatcaaataagaagctccggtcaacatcagtccaagaccaaatttaacgatggttgatggttgacgatctcctaatttgttccaaattcgtacaaagataggtgacaagagaacgatgaagagtgggttcaacaattggtaccaagatggggcaatatggaaagtaaatccaaaccaagtaggatttaagttagaacgtgattctccccaaaccgcaataatcgtagaactttgttcttcaattgcccaaaagacaatagcagaaaggaacaaaggaatataagctgttaatttacgacgttcgtctgattctacctttttagaggtaaacatcattacgaaataaataattggaacaaaaataccgataattgataaaacgttaatgaaattattgatgaaattcgcaggacttgcttgataaattaagaaaaatccgattagagcaacaataagaacaatcgttaatgtaataatgaaattacgttttgcttttgcatccgttggattagatggttcacgtccaatttctggaaaatgacgaagacgtccataccaataagcaaataatgcaaaaatcattccgattgcggcaagtgagaaacctaagtggtagttcacaccttgtccaactgtcccaacaatcaatggagcaatcagagaacccatattaattccgactacaaagatattaaatccagtatcacgacgtgagtcatcttttgaatatagatgtccaaccatgttagaaatattgggtttaagcatccctgttcctaagataatcaagaataatgccacgaagagtgaagataaaccaaatggtgttgctaaagcgacgtgtcctaaagtgattaaaataccacccaagaagattgtgcgcgaagcacccaacaaacggtcagcaacccatcccccaacaatcgttgaaagatagacaagtgcaccataaatacttacaatcgccattgcctgagctttaggaagtcctaaacctgcgttatcagcagttgtcaatgcatagaggtaataaaccagaatggcacgcatcccatagtaagaaaaacgctcccagaactcagtctgaaaaagcgtcaataggccgcgaggttgaccgaaaaatgttttttctgttttgtttaagttttgcatagattatattataaagttttctatacaacttgtcaagttgtcaaacaattttgactatacagattctttgaaaaacgcgggaaaaagagggacaataacaaacttttcaaggtatttcttttaaaaacattcctaagataagtctttaattttctcataaataataaattcccgtgagaaactgtagaaatgaaaacataatcggtaaaaatgtattgaacaagatgtgaagcaaaatactttcagaaagcacttttcgtctatgataaatcgtagttagtataacggacatggggagatacactaacaaaactggactaaatcccgtatgtatccaagcaaaagtaatacttgctaggataaatgctaacttatcattcttgaaaaaacggtaaattgttccccgaaaggccatttcttcaaataggggagaacttataccaaaacttattgcattaattcaaggaaatacaatttgattactatactccatctgtgtttgggcaattccggccagaggaaaatgggaagaatagtaagtcaatgtaacaaaatataggatgctagcaaagaaaaaagtcatcaaaataatcaataagtttttgattttaaacatggataaagtatttttgaaatagccaaatttaacgccaagaaaaatgcctagtccaatacttattaatagattagcaaaaagtaaccaagttgaagctaattgccgttcatatcctatcagtgatttgaagaagatttcaggataagcgaaaatcacatctggaaaccaataaattgtccaaattaaaatgaataaaccaaaatattttagtttattcatccagtatttttttatcaaatttgactcctgactttatttaagcgacgcgagcatacggttgtccaaacatgtaaatccattcgaatccaccatctgtcatggacatattttgaccaccatggatattttcaagttcttcatcagtcaattctgtgaaaagttctaaagagtttttaacattttccatctgaatctccattctttaaaagataatattttggtttgttataatcgattactaatatagtttacaattatctgatttttctgtcaataacttttttgtttacctgataagtttatccactgagatattgaaaagtgttgctaaagcttttaaggtttcaatgtttggttcacattttcctttttcccaattgtaaacggcttgttttgaaaattgaagttgctcagctaattgattttgagttaagccaatcgctaagcgctcatttctaatattggtagaaaggtctcctcctttaatttccatcagttcattatcacctaaagtttgaaaatccttaagactatcttcagccattcatttgtattcctttttaaattatttttcactgacagacttttcagtaaatcaaaaatctgctaaagcagatttttatctttctattttcaaatctatgtttgattttccactaatcacttgctctgtcagtaaatcttttagttttggcataaaatcaaacttctgtaaaaaagtaatttctgaataatctatcttgatttcatcttcactgggattaatcacctcgacaaaaacttctgaatctgtatagcgcaaaattcctagtagtctgtcactataaaagctagaaaattctccttctttcaaactattttctaatagacgctttttcgtccaactcttataataatcatatatttctggtgaaatatcatcccaaggaaaatatttacgattttctggatcctttcctccagaaagtcccgcttcgtcaccataataaatacaagggattcctggtaaaacaaataagagtgaaacagctaatggcagattttcttttccgaccattgttaaaatacgttccgtatcatgggtccccaaattatttaagttgttataaaaaatatctttgggatagttttcctgcaaagtcatcaattgatgagctacatcctgacatgagcgatttacgtttaataaattgatgattaaatcacgaaacggatagttcatacaagcctgtaagctcccgccaagaatatatttgcgtcttgttccataagaaatcttattagaagcatcctcccaaatttctcctattagaattttttctgaataacggtcaagattctcacgaatccctttaataaatgaatcaggcaattcatcagcaacatctaatcgccaaccatctattcccaagtcattccactttgataaaacagagtttttcctaccataaataaaatcacgaaaggattcattatctttatcaatttcagataaatctttaattccccaccaagatttataatcaaaaggataattttcaaacttgaaccagtcaaaataaggagagtcaggatttttcgccgctccttcatcatctccataatctccaaaacatctaaaatcataagataaaagaatgaataaagaacaaattaaaacactaatcaattctggagaaacctatgatgacaatgacctagaactcagtgagtatcgtaatcatgccttttttgaaacccgacgttacaatcaaaaaatcaacaataatgagggttatcaaccagagattttaagacagctctttgaacatttgggagaaaatccctatattgaatacaattttcgctgtgaatttggctttaatataaaaattggggataatgtccttattaatcatgatctgattattttagattgcaatcaggtcacgataggtgataatgtttactttgggcctcgctgtggtttatttgctgccaatcattcagaagacccagcagtcagaactgctggtggggtctattcaaagccaattacggttggaaatcaagtctggctgggagcaaatgtcagccttcttccaggagtaacgattggtgacaactgcattattggtgcaggaagtgtcgttaccaaagatattccagcaaatgttgttgccgccggaaatccttgccaagtgattcggacaatccgaatcgaagaccaagaatggattaaaaaggataaaatattcattccaaaataaaaaagctaaagaatattctttagctttttaaattaatcaactttaacaatccagccttccggtgcttcaacatcaccaaattgaatgccgaccaactcgtcatataaacgtttaactgttggtcccacttctgtttcagaatggaaaatataagaatcttctccatcgtcaatacgtccaattggggagataattgctgccgttccacaagcccctgcttcgacaaatttccctaaatctttagcaaaaacttcaccttcaattgcttttaatcccaaacgatgttcagctaaatacaacaaagaatatttagtaattgaaggtaagatagaaggacttaatggggtgataaattcattatctgcagtgataccaaagaaattcgctgccccaacttcttcaattttagtatgtgtgcttgggtcgagataaatcgcatccgcataacctgaggctttagctccaacttctgcttgcaaagaagccgcatagttcccaccaactttagcaccaccagtaccaagaggagccgctctatcatactctcttgaaataacaaattttgaaggtgctaacccacctttaaaataagagccaacaggcatggcaaaaactgtaaaaatatattcatccgcaggtttaaccccaataacatcaccaaccccaatcaaaagtggacgaagatagagcgtggcacccgttccataaggaggaacaaaatcttcattggctttaactacttgtttaactgcgtcaataaacatttcagttgaaacttctgccatacaaagacggcgagccgttttttgcaaacgagcagcattttggtctggacgaaaaagttggattgacccatcttttgtccgataagccttcaatccttcaaaaccttgttgaccataatgcaaagcaggtgaagattcactaatatgaagctgattatctcctgtcagctctccagcgctccattttccatctttaaaacgagcgatataacgaaaaggtaagtttcgataactaaaacctaaattttcccagtctaaattaattgccataacatcctccaaatttttttgttataatagattatattattttctgtaacataaaacaagaaaatattcatgaaattcagtaaaatttcaaacaattttttcaaatatagtcaatttttctataaatgaattagaaaattactgaacaaaggagcaaaaatgaacttattaaaaataaactgggaagacttaggcgcatttttactaaacaaggcaattacaattttattagtcagtgttcttttttttattctctaccaagcaagttctcggattgttaaccgattatttaaaaattatagtgagcaaaaatggacagatacttcaagaatcctgaccctttcaagactgaccacaagcgctattcattatttgaccgttttcctttatatctatagtgtcttgggtgtaatgggaattcctgttgcaaatgtcctagctggtgcgggtatccttggagtcgctcttggtttcgctggacgagatttagtcgctgatatcattaatggtttctttattatcgttgaacatcaaatcaatgttggggatacggttgcctttgccggtcttgatattgagggagtggtgaaaactgtagggattcgttccattactgttatcggagccgacggtgcgactacttttattccaaaccgaaatattgcggctctcaaaaattactcttataaagaaagaacggtcaacctagatgtgcccgtgacagacgaaaatattagtgagaaaaaagcccaaattatagaagtcaatgctatctaccctcaagttaaatatctgggtatcatcaacattgaagacaaactttttctaagaacaagtctaactgcccctctatctaaaattactcctttaaaaatggaaattttggataaatactatgaaaagaataggcgataagctaattagtaaatagcttaaaacaaaataaaagcgatatatctaagatatatcgcttttatttttagtgagtaaagccatatgttttattttcaggttcctgatgaaatagaatatgagccttatttagtgcatcaattgcttcttgtatatcttgaacatagttaaatgccatattcatcccgaaatctgctcgaattactaaacgttgaatgatttcattttccaaatttttaggaagtggataagcaggcacttgccatcccttcattaaataaacgatctgccaaatcataaagattccaaccaagatttgaattttcttttaatttgtagcatacaattggcaattgtgacccatcgttcataatctcaaacattcctgttttttcaatttcttctgctaaatacatggctactttatgcgttctctcatgaatagctttatatccatcaaatccataacgtacaaaattatagtattgaccgattaattgagaagcactgtgagaaaaattaatcgccattgttggtaattctcctccaagataacttactttaaaaattaactcttcaggtaaatattttttgtcacgccacaagacccaacctacaccaggatatactaaaccatatttatgtcctgaagtattgattgaaatgacatttttcaaacggaaatcccactcaagttctggctcaacaaaaggagcataaagtcctcctgaagcagcatctacgtgaatataaactttatagtctgtctgtttattatattcttcaatcaaattatccaaagctttgatatcatcataacgaccagtataagtaatccccataattccaactaccccaatcgtatattcatcaacataatccatcactttatccaaattgattgacatatgttctctatccattggtacttctcgcatttcaatatcccaataaacacagaatttttcccagcaaacttgataaccagaggaaatgactaagtttggctttttcgcattaatatctaggcctaatttttctgctcgcttgcgccaagaaaacttcatggccattccaccaagcatacaagcttctgaagaaccaattgttgaagtccccataaatttttctttttcactcgcattccaaaggtcagcgatcatgttgacgcaacggttttcaatttcagttgttcttggatattccgatttatcaatcgcattttttccaaggtctgactcattagtttgactgcttcaggttccatataagtttgacagaatgtggctaaatttaaacgagcatttccttcatctaacatttcatcttgaactaactgataggccactcgaggttcaattgattgttgagctaatttatatttaggcaaatccacttgttcactttcttaaccaaaaattggttccaagaactctgcttcatcgcgattttcttttccgtataacataggtacatcctccaattttttaatgttttaagatatgttcttcttttttaataatatgatgctcaccacgagctgctggataaatcgcggggttcacatctcttgctttaaagtgccttggttcttcaatagtatcatgtccccttttatcatgcaattcataaacaataaatggcaagatagcggtcacaacaaaacttataagaagtatcatttggtaagtatgagtctcatttttcgcaattgatgctggagaaacaaaggaaataaatagagcaaaaattgataataagaatccaattcccgcaatgattgtttttcccattattttacctggaacattataagtacgctttaaattttgttttttatagaagctttacgtgctttatcttcttgataagccctatcgtccaacttgtaactgttatcgtctgccatgcgtttcttctcaatatgaaagacaatagagtcaatgctccgcccttttttgattttctcataggtcacgttaaaatgcgtatgtgcattgatttcttccaacggtttttttaatatccatatttcaaaatggtctgaccttttatattcattgacggtatctgtcagtgttcgtaactctgacattttgatagacggattacgataagtttcgacttgttcggctctccgcccccctttgacactgtaatgctcgtactggttgtaattcattgataaccatttataaagaataatgctgtatttagagtttagctccataatatctgacaaggcatattgcgtgaatttttctttcagttcaatcaaataaggcattatcgacttggtaaaagttatcgaaataatatcgctataatcgttccatgtagttttctccaatggactaatcacttgatactcaaacttatttctatggtcattcatttctcggacttcaaaaaccgactgttgatgtaaggtggttatggcttctttaaaacgactgtgtttattgctgtcgtccactttaaaaaaagcaaagagttcagttttagaaagataaaccgtattgtcttccaatggcttctccgtatcaatacaggataccgccaactcaaaaatcttcaaagggactttatccattttagctacggacgtgatgaggtcgttatgttcaactatttttcgtttctcaatttctttcaaagaacacactgtcctttcattgtctttgtaattgttataagggtatttttttgttataatttccatgagggctactcctttgtgggtggtttggttaagcatagagaaaaacttttagtagggaatttctctatgcttttattatactactttattcccagtaaaacaagttttttctgggataatacatagttttttctgggataatacatagttttttctgggataatacatagttttttctgggaattaaaatctgtaaacgcaatgaaaacccgattacaaaaccacgcaaaagagtaaaagacaaaatatatatgataaattaatataggcttcgcttttttcacttcgttctaaaaacttaaaatcaaggtcaaaagaaaaagtcaaaaccattgaattgaggttctaaatttaaaatccctgcgttgctcttgtcgctccgcttgtacactctgattttatattagatacattctgccactaaaaagaactccctaacggtcgtggctactttgtttagtctaaacactttgaatagtcttacaagctcatagtttgccttttaagcgattttaaacgtgagttagtaataattatcatggataaaagaaaaagcccttaaataggcttgtatgtaattgactaaaacgtaaaattttagcttttaaatatgaccgttatttatgacctgctctaacctcactattcatctgcatgctaaaatatgagaaaatttgatgccacaatcatataaaatttcttacacttcttgataacagagattatagcgaaagagtaaccagcagaggtaataatcacatttttttattctttgtatttaaaatgattcatccacatactctcactatctttttattcaaatttacaataaaatagatttatcgaaaaacattgcaatagaaccattatttgcaaaaaaaaggagaaaaatgtggtatataaccttgaaaatctagtgaatagcgaatttgagaaattaaaaggtacaggtctacagactgttgatactgaaaaagttactttagatttttttaaaatgctcaagaaaataagcgacaaagaatttattaatattctaattacatcaggttatattcctgatttgtatgtagcagattctaaggaagaaacactatttacaaagctatgtgaagcacttgaggtagattgggctagccgtatgggctttgaagcaaatgcagtaactcaaaaatcatcttatgaagatgttgtaataaaaattaataataaaattatcgtttcggatacaaaatcatttaggctaggacgttctcaacaggctccgaatgtaaaagattttgttaaaccagaagattattcaaagtgggctaatagacattctggacaaaaactaggcggcttagtcgtatatcctcagttacatgaatggacaagaaaaagtgatgctcatgtatactgttcagataagaagaaccctattttaatgcttccatatcattatttagcttatttcttagaaaggaaagacaaatttaatcctaaaagtttggaaaaactatgggactatgagaagatatttcctgaaaaagcagatagtcgtaatgactattggcaaaaaataaataatgtaattttagaaattacaggtgacgaaaaaaaagaatttaaaaaattcttaaatttagctgaaacaaaattatatgaatttgtagagggaaggcttaaaaatctggaatatcaaaaaaatatcaaaattaaaaaaattgaattcgaaatatcatcaattccagattctgaacttagggataagtttttgaaatatagacaagagattgaaacacagtatattgtaacttttcaagaacgtattcaaaagttcagacttacaaacaataaagaatctacgacctattcaaaatttattgattccagttttgataaatcttagaaaaaagtctcaatgtaaaaacacttaaaataaaggcttataaacgagttatcaatgatattcgtttataataatttatttcacatttatatgattacagcaatgtattcaaacggtttagagaggtattataataatccttatctatttcaaaacctaaataatgtcgatttaactccttcgcagcaactaaagtagtaccacttcctgaaaatgggtcaagaactatttgattttcttgtgttgttaattcaataagtgctttcataagaaccaagggtttttgagtaggatgtaaaccacgatcacttgataaattaggaatctcgatataattatctcctttttcagaaaaagtttgccatttttctaaattatatgctcctacaccatgtttaagcatattatcagcaattgtaccaccttgcttatatggtttagtaaaccataatataggttcaaaaacaggtcttaagtttcccactcgccattctgataatttttcagcattctcaaaatcatttctacgttcataaacttttgaaattctttgagctttcagagtagctttgcttctattccatcctatcatatctcggaatgtaaatcctgaattttctaaacctacaattgctctatgtgcatatcgtctgcccgcaaatataaagcaacttgatcctggttttaaaactctaaaccattcttttgcccaactttcgacccaattctgatattcaagaggtatttttctgtctgcttcgctccaaccattaataggttttcctctcattttaaatccactgcctgttttatgttgtgctggactagaacctccaagagccgaatttgtattctcatgtaaaatatcccaatctgcaaaactaataccatatggaatatcagacagaataagatgtatactttctgtttcaattttttttatggaatctatactattttcattatatattgtgtcaattttcaactttttttcctcaatctacatttttcattattttttctttgatacttagcacattatttagtttattagcaaattttctattaatctgtggtgttttgtacacgacactattatagaataaatgtcgtgtattgtcaacacttaaactgctaaatttttccgtggcgaactaaaagagatcctctaactatcattttaataacaaacgaagtagttatatagccagtttctgtatattgggataaaactttctttaactcagtaattccatctatggtagtttgatttacctgtaaatcagtccgagtttttggtgcatttcgttcttcaacttgtgaaccaaattttaatactttatcccactttttttcagaagtaatctttttagaatccaagtaggcttgattcacaacaaacccattagtaagatgcagattatcaaattctccagttgatttaatttcctccttaagggtattaatactctcccttgtttctattgcaagtcgaaccgctaatctcattatatcaccacctattttgtaactcatactattatacaaaaatgttttatttttgccacacattattttctatgcctaccaatagtttaaaaattaatttttaggttctgttgcaaagttttccaaaaaatctatttgagtgtccataatggttgtcagtaaataaacaaaaacttttggaagtgtgctattataagtcatataagtcgtacgctttctaatgcttagtggtttaagattaggatagcacgacttatttattttccaatgaacttaactagcaattcgggtatacaaaagaaatatttgctaaacttggtgatatgaagtcgggaatgaaagaagcttctgacggatcaaataaattagctgatgggacttcgtcagcgctgtcaggttccaaagaattgactaataatttgaacactttgtcctcttctagtgtaacttttaatgatggcgctgatagtttgaattttggcctaaataagtttgttttaggagtggatcaagctgcaaatggaggacaacaagtctcttcaggtgctgcccaatttgtcagtggaactcaacaattagctgagggaacccaaactttggctgataaatctaaagatctgtcagcaggaatttcacagatttctcaaagtacagaagcggtgagtcaactgcaatcgggtgtgcaacaactatccgaaggcttaagtcaaatggctcaaaaaacaactttatccgaaactcaacagcaaaatattagtgctgtgcaaaatggtcttactgaattaaatcaagagttacaaaataatacgattgacccaaatttggctgctaatgtccaaaaaaacttggaaggtcttggagctacggttacaaatttagctaatgatcaagtggcagccactaaggcagcagttgaaagtactgagacttttaaaactttaaccgaaagtcagaaaacagatataagaaatgcattagataattctgttggtgccggagcggttcaagctgatttactatcattaaatgagaatattacaggggtcaaaaatagtcttacaagtctactaccaatgtttggaaaaattgctgatcttaaaacattagttccaggggcaagtcaaacaatcactgacctttctacaggtttaaatagtgtgaatagtagcttgaatagtcaaattttaccaggaatgaataaactagacactggtttgacaacattcaatagtcaactcacctctggtggacaaaaattgagttctggctttacccaatatgctgacggagtagctaaggcaaacgctggtgctcaacaattggcaagtaaatcaaaagacttgcaaagtggaaccatgcaattagtttcaggattgactcaactacaagcgaatggtccatcattaacttctggctcaaaccaattggcaagtggtgcaaagcaaatttcaacgggttcacaacagttggcaaatggtggctcaagcttaactaatggtttgggaactttaaatacaggtgctactgatttatcaacagctttaactaaggctgatgatagtctgtcagcaacaaattctactgacgaaaatgctaaaaaagtagcagctccactgaaacttaaacatactgaccatgataatgtgccagtaaatggtgctgggatgactccttatatgattaatgttgcactctttattggggcgcttgccactaatgtcgtaattggagttggtttctcaggagaaaaatggaaatcaggacgcgaatttatgtttgctaagattggcacaaatggtttggttgcacttttgcaaggaatcattgtctggggagcagtggcacttcttggtttgagtccaaatcattggtgggaaatgctattagtcgttcttttgataagttttgcttacatggctataaatactttcttcttaacggctttaggaaaagtaggtgagtttgtcatgattgtcgttcttgtgttgcaattagcgacaagcgctggaacttatccattattacaattagctcctaagatctatcaagtcatcagtccatggttgccaatgacctatggattaaagatgctacgtgaaacaattggcttgaatggcgcgattttacctgaagcaattctctttgtggttattatcgccgtctttacattcatgttgagtttcttcaaaaaattctcacgctttgcttaatataaaaattactgacagaaattttctagactgaatttttacctgtcagtaattttttgtctagaaattttaaaataaatttggtaaaataaagctgtaaaaagaatttgacaatttggaatcgtcctagaaagcaagctcgttcaccttacaaaggtttgctttttatgatagcctaaggagataaaatggcagataaatacacagaagagcaagtgaatgaaatcaaggacaaaattctctctgcccttgaaaacgtcattgacccagagcttgggattgatattatcaacctcggattagtttatgaaattagctttgaagataacggatttactgaaattaaaatgacactgaccacaatgggttgtccattggcagatttgttgacggagcaaatccatgatgctttgaaagaagtaccagaagttggtgaaatcaaagtaaatttggtttggtatccagcttggacagtagataaaatgagccgctacgcccgtattgctttgggaattagataaacttctatcactaggtttatggctgttttgataggattagtaaagactaaaaaaggacatttagtacggtatctaagccgtttttgaaaaattatttattgttgttaaatctagtaaaaacagaggaaaacaacatggaaatttcaatccaatcagcaattcaagaaatgctttttgataataaagcaagaggattgtcgaaaaatacaattatattcagagaaaaaacattgagggttttctctgtttttttgtgccaaaatgatattttaaatattaacgaaatcaaaccaattcacataaaaaaatatttagttgatagattagaatgtggttactctgagacaactgttaatggtcatttaagggttattagggcgctattttcatattgtattaatgaagaatacattaggtatgaggaagcacctatacaccgtgttaaatggattaaagagaagaagacgattgtaaatacatttacagattcagagataaaaacaatgctccaatataccagaaaaagaacctttaataccatcaagaaaactggtaagggacgaactggattttgtacaaaatttgtgaatgagagaaattacttgctgttacttatacttacagacactggtatgagaataaatgaagcattgagtctaaaattagaaaatattaatgattctcaaattatcataaaaagtggtaaagggaaaaaagatagaattgttcattgttcaccacttgtttataaacagtatctgaaatacaatagggcaaaagaaaattatttttcaagtaatgggatagtacccattgaaaatatatttgtaactaaatttggaaaaaaatatgattataggctagcagaaaaagaaatatataaaataggaaaagcggtgaacattcgtgacagtatccgtatctcacctcatacatttagacattattttgctcaaaaattagtacgtgagaatgttgatatttatatgattcaaaagttactgggacacgctagcatcaagactactgagatatatcttaggagtttaaatatcgagaatgaaattaccaaagtcattaaatacagtcctttacagaatttagattaaaataaatttttagatagtgtggatgggataacctactagaaaacaataatttttgaattattatatctataaaatgaatgtgaattggttttatatcctttatgtttcaagtaccatattttttgggaaaaatgtttaattagattgatagaaaatttgtgaaattattagttaaatcttgtattgattttggtctgtggacatttaataataaatatgtttatacaaaagatgaccctcattgctaggagataaagttacctgatatggtatatatgcctcgaagtaatttttacaaaaaaacactatataatttattactagtgagatggagttattgaaatcaagagaggtaagaagaggagatgtatggtataatattaatgaattctaatgaaagtcagtgtaagggaagttattatgaagaataaaattgttggggtatcactaaaattttctcatatgaattttaaaaatatagatttaataccatttagttcttataattctttgttggactatgatatagtaattattgatttggcaggaatctcatcagaatatgattgtgataaagattataatgggagagaacgattatattctggtaagagacgctttatcaaacgagtgttccccttgaggttcaaaaccgaaaaaacgtccatctcgcaacatcagattgcttagttatcgctttataatatagaaaggaagacttctatggctgcacttgatttaactcatcttactgataacataaaaaaacaaagaattggtctattcatcgtaaaaggatgtatgcaatgggattaatgcatgaactttatatcactgatggttctcttgatgctgagcattccattattcctgcaagtgatcgattattaactgctcaactggtcagtgaagttcttgaccaacttatcgaatatgatgaaatcacaattttttaagaaatggttgaaaaaagtgaatcgatcaatgctaagcttcaattttcccatatcctaacttttaatgatgaagccgggatacaatatattttaaattccaatagctggttaaagattttaaatgactcaaaggacttagcgcttgtcattactggaaatcttgtaggagattttacattttttattgagaaatcaaatggagtttttgaaaataaatgtatcactttcagtaagaatggaatctatagattaacccatgcaccagtcaagcaaatctatttgactactaatgctttaaaaattgataaaaattaaaaaaacgattattaatcgtttttttatcttataatgaattaaataattcttgaattgtttcaaactcatagtcagcaatggttcctttttctgacccaatataggctgtttgaagtcctaaatctttagctggctttatatcatgttctagtaaatctccaaccattaaggtttcactggctttgaaattctccttgttcagtaaatttgtaaaagcacgcgcgtctggttttaaatagcctgtttctcctgaaatataaactggaaataattcttcaacatttgaacgccgtaatttctctctttgttcaacacgtccaccattacttaatagtgcaagttgatatttttttgaaagatttttcaaattttgaatgagttgctcatcaggttctatcaactcaaataatctgttcaaaaaatttttgaagaaagccctaagataaatttcatcaatttccaagtcaaaatattcgagagtcaagcgtaatctttcttctcttaactcttcaatggtcatctgtctttgatgaacttggggccagagcaattcatcaaattcgtgatatttctccataaaatgattgagttcctgatcagtaaatgggcctaattgttctgaaaaaagttgtcggtgggctaattcccaatatttttctttaaaagggaaaagtgtattgtcccaatcaaaaataatgttttttatttctgtcatctatttccctcattccatatttaagcctattttttcagcttttgatttattctacaagaaaaaaagttactgatgaaaagttgaatctagtcctaagtgattaaaacacaagggcattcctctaacttttctatcagtaactttttgtcagtaactttttaattctaaattattttccttcaagataaaccatgagaatactaatatcagcaggatttacacctgaaattcggctggcttgtccgagtgtttctggatttatttttttgaatttttgacgagcctcggtagcgatggaatctaacttatcccaatccatatttttaggaattcgttttgcttccaagcgatgcattttgtccacttggtccattgcttttttaatataaccttcgtaagtaatttcagtttcaatcaattcaatgactgtgcggtcaattacttctggtgcttgtccaatgaaatcaatcacttcatcataatgaacttctggtcgtttcaaaaattcggcacctgtcagtgcatctttgattggaccaaagcccaattttcctaatttttcttgagtatcaggcaaaggtttgagtttttccgaattgagtcgtttcatttctcgttcaaattgagccattttagcttggtaatgctcccattgtgcatctgaaacgagaccaacttgacgtccgatttctgtcaagcggcggtcagcattatcatgacggagtatcaaacggtactcagcccgtgaagtcaagaggcgataaggttctaaagtccctttggttaccaaatcatcaatcattacaccgatataagcttcgctgcgtttaagaataaattctggttttccttgaatcttaagagcggcatttattccggcaaccaaaccttggccagccgcttcttcataacctgaagttccatttgtttgtccggctgtaaatagacctgaaatcaatttcgtttcaagagtaggacggagttgatgaggcatcaccacatcatattctatggcataacctggacgcatcatcttagcattctcgagtcctggaattgattttactaaatcaaattgaacatcttcaggcattgaagttgaaagtccaccgatataaacttcttctgtattgcgtccttctggttcaagaaagagttgatgacgaggtttgtcagcaaaacgagtaattttgtcttctatggatgggcaatagcgcggacctactcctttaacaataccagaaaaaagtggtgcacggtgcaaattatcacgcaaaatcgtatgactattttctgtagtataggtcaaccagcaaggaatttggtcttttagataatcctcgtcagagctcataaagctaaaatgatttggtgcttcatctcctggttggatttctgttttatcataatcaattgaacttgccaaaactcgtggcggtgttccagttttaaaacgaccaatttcaaaaccaatttcacgtaaattatctgctaaaccaattgatgaaagagaattatttggtccagaagaatacttcaattcaccgatgataatttccccacgtaaagctgttccagtcgtgatgatgacagccttagccccgtattgtgttcctgttgatgtccgaacaccaataactttttgcttttcatcatcaaggatgagttcttcaaccattccctgacgaagcgtcaagttttcttggtcagaaactgtatttttcattgaagcagcatattcatctttatctgcttgggcacggagggcacgaactgctggacctttccctgtattaagcatcttcatttgaatataggtcttgtcaatattgcgtcccatttccccacctagggcatcaatttctctgacaacaatccctttagctgagccaccaattgatggattacatggcataaaggcaaccatgttaagattaatcgtcatcaataacgttttagaacccatgcgtgcagccgcaagcgaagcttcaacacccgcatgtcctcctccgatgacgatgacatcataattttcttgaaaattcattttttactacgaattttttaaaattcgcctttctttttattttgataaaagttcttgcaaaactgctgacagaactgccaaacttactgacaattcttttatctaacgatttaatgctcactctttgtacacattaaacataaatattttgcaaataaaaaagccaaagctgtgaaaaacatgtcaaaaaatcctctcatcagttactgaaagaaaatcaataaattgaccctcctgtcagtaattttaaaagttttttgtcatattttcccgagctttgaccatcgagttcttatctaagataatgatattttaactcattttatcatttttttcaagactattttcttatcattttcaaaatcaagtaaatctattactatttacaaaatttcttccaattctcgatataaaacttgtccaagaatatcttgtgccgagagataatcgtcaaaaagaataattcggtcttttttcttatctgtagggtcatactgcccagcatagtcaattctaccattagccaacctgacaggaatagcacttccttgcggatagacccctaagaatttcccagaatcttttccttcaccaattagttttagataagggagttcgttttctggagttaccccttctaagacaagttcatactgaatatcaccgaaagttgctgacggacctgaaacaacgatacttttgctttgacgatttttccacagtcctgacaaagtcaaaaaattaccttttttaacctctttagtatttatttttagtccaactttttttatttcttttttattttcaatcgaattttgctgactacctgcagtattcgaaattgaagactctttagattgttcttgaatattgtggagcaaggtcaatccaagaatcataataagtaatattaaaaatccatctaatataattaatggctatttggctatcttttatatctaattgttcctttccatttctacgctgttcttttaaatctcgaatttgctcctcctgtattttgattttttcaattaagaaattattttctttgtcggttgaaattttgtcggttgaaattttgtcggttgtaactttgtcggttgtaactttgtcggttgaaactttgtcggttgtaactttgtcggttgaaattttgtcggttgtaactttgtcggttgaaactttgtcggttgaaattttgtcggttgtaactttgtcggctagaactttgtcggttgaaatttttaaaatcttcgctctaataaaattttgttcgtctatcgttaaaagtattattcctttttcatttttaagtctttccttatttggcaaagacttaatatgatattgtacgttttgtttattaactcctaactcgtccgcaagctctttaatcgtttttaattcttcactcatgataagtcctgccttttaaccgttggtagatattgttcaatggcttttttgaggtagcgtgcgatattatgcttagaatattcttcacgtttgctggcaacataagacaagtggtctttgacaccatttagccctcttaattctttcagttcgtcataaagcggataaacgtttttctgtaagcctaccattgtggctgtatccataatatcattcatgccaattaagaaattttcagataaaagtcttgtatatttactttccattgcctgttttagtaagtcagcttcatttcttgatttttgttttttatcgtcttgatagtctttatctcccaacttgtaactgttatcgtctgccatgcgtttcttctcaatatgaaagacaatgctatcaattgaacgtccttttttaatcttgtcataggttacgttaaaagaggtgtgagtgtcgatttcttctatagcattttttaaaactctagtttcaaaatggtcgaagcgtttataatctgtaactgtatccgtcatttctcgtaattctcgcattgaaatagacggattgcggtaagattccacttgttctgttctccgcccccctttgacactgtaatgctcgtattggttataattcatggataaccatttataaagaataatgctgtacttgctgtttaagtctacaaggtcagacaaagcatattgtgtgaatttagtttttaactcaatcagatagggcataatcgacttagtaaaggtcatagaaataatgtcattataatcattccatgttgtttcttctaaaggactgataactcgatactcaaatttatttttatgaacgttcatttctcgtatttcaaaaacagactgttgatgtaaagtcattatggcttctttaaaacgactgtgtttattgctgtcgtccactttaaaaaaagaaaagagttcggttttagaaagataaatggtattgttttttggtggattatctgtatcaatcaacgataccgctaactcaaaaatctttaaagggactttatccattttagccacgcttgtgatgaggtcgttatgttcaacaatttttcgtttctcaatttctttcaaagaacacactgtcctttcattatctttgtaattgttataagggtatttttttgctataatttccatgagaagttgctccttatgagtaattttggctaagcataaagaagtcatttcgtcgtgaattttctctatgcttttattatatcacattatccccacatacaatagttttttgtgggggaatacatagttttttgtgggggaatacatagttttttgtgggggaatacatagttttttgtgggaatgaaattctgcaacttcttgcaaccactgacttttttttcacgcaaaagaacaaaagattaaaatatatatgataaattaatataggcttcgcctttttttatttttttcaaaaattaaaatcaaggtcaaggtcaaaagaaaaagtcaaaaccattgaattgaggttctaaatttaaactccctgcgttgctcttgtcgctccgcttgtacactctgattttaaagttgctacattctgccactaaaaagaactccctaacggtcgtggttactttgtttagtctaaacgctttgaatagtcctataagctcatagtttgccttttaagcgattttaaacgtgagttagtaataattatcatggataaaagaaaaagcccttaaataggcttgtatgtaattgactaaaacgtaaaattttagcttttaaatatgactgttatttatgacctgctctaacctcactattcatctgcatgctaaaaagggttctgttgcaaagttttaaataaagaataaaatcccttacagtatctatgatttaagctgggattcccaataataccttgatttcagtacagaccgaaaacccgaagagagtgccttcttttcgggttttcttatataatcctcgaatggcttccatgcctttaatcgtgggtgaggcagtgcgtaaacttcgatagaatttattgcgtctctttactggacgatggtcttgttcaatcaaattattcaggtatttaatggtacgatgttctgtcccttgataaaagccgtattcttttagtttcttaaaggcacttgtaatagagggggctttatctgtgactacaaccttcggttcatcaaactgcttcactaaccgcttaagaaaagcataggctgcttgtgtgtcctgttttttacgtaaccaaatatccaaggttaaaccatctgcatcgatggctcgatacaaataataccattttcctttaattttgatgtacgtttcatccattttccatgaataaaaggattggttctgttgcgaagttttctaatgttctagatttagtgtaaaatgtaagaaaaaagatagcgaggacagaggtatgaatcatttcaaaggcaaacacttccaaaaagacgtaattattgtcgctgtgggctactatcttcgttacaatttgagctatcgtgaagtccaagaactgctttatgaccgtggaataaatgtttgccatactacgatttatcgatgggttcaagaatacagtaaagttttctatcatctctggaaaaagaaaaatagacagtccttctattcgtggaaaatggatgaaacctatatcaaaattaaggggcgttggcattatctctatcgagcgattgatgcggacggtttaaccttagatatctggttacgaaagaaacgagatacacaagccgcttatgcttttttaaaacgactccataaacaatttggacatcctagagtcatcgtaacagataaagctccctctattggatctgcctttaaaaagttacaaagaaacgggttatacaccaaaacagagcatcgaaccgtgaaatatcttaacaatttaatagaacaagaccatcgacctattaaacgacggaataaattttatcgaagtctacgtactgcctcaaccacgattaagggcatggagaccattcgaggaatatacaaaaagaaccgaagaaatggaacactcttcggcttttcagtttctactgaaatcaaaatattaatgggaatacctgcttaaattgacggttggtcagagatagtgtttttgagtttcagactttgcaacagaaccctttaagatattctatcgggtatcaagtcatggctaaataatcaactagcaattcgggtactatttagataaaactaaaagattgacaagcaaaaaaaaaatgttataatgaaattaacgaatagtaggtaagcattgctcactactgagaccgaggtactgccaaaagacctcggtttttttatttttataaaaaaacatccctctgccaaagggatgtttgtgataatatggcgcttatcgtcggtttttcaaccaatccttgaccagctcaagaattactccaaccacaactggagcgacaactgatacgaatagtaggctaagcatagactcacttcctttctaaggctagattgcatcagaaaggtgcgccattaagaattgtatcataaaaaatagcataattcttttaacaatagtagctgaatatctttctgtaatattttggtttttcggaaagttaatataagttatgcatgacctcatactgatatgtgtacagttgtatgtcaattgttattaccacttttagtgaacataaaatttaaaagatatttctctaatttctaaaaaataaaaagtgttaatttatatataataaatataaggactataaaatactgaaatgtgaggttaaaatgacaaataaaaagaaaaccaataattgttacatttatgactaaatataaaggaataatttacgcttctttgggtgcctctttttttggtattagtagtattattgccggaattttatttaatcgttgctccatagaaccaggttggttagtaaccacacgtatgcttttttctggcttattattattagcttggttggctttaagaaaaaataatatttttagcgtctggacttctcttaaatcgagtctaaggattattgcttttggaatttttggtgtactgtttgctcaaacttccttcttattatctgttttttatggaaatgcagccatcgccaccattttacaatctttgggtccctcaataataattattattttggccatcaaaagtaaagctattccacgacggctagatattatcgccattttcctttcattaattggcgtttttctcttagtcactaacggcaatctaggagagctcagtttttctgcttctgctcttgtttggaggctcttatcagcgctcggcgtttgtgcttacacactcattccttgcccacttattaaagaacattctccactaaatgtcgtcgcttgggctttattaatttggtggccttatttccaatttccttcaccccgtaacaaatttacctgcaaactttgaccaagttgatttacttcttgtcagtctaattgttatcgttggaacactcttagcctattctctctatatcaacagtctcaaatacatagagccacatatcgttgggatgttgggaatgcttgaaccggtgacagcgatactcatctctactttatttcttggtatttcttttttaagtttccaaaaaattggaatagtagtcgtctttttatccttattccttattaattttccaacgaagaaaaaataaaagacaaagagtatattaattactctttgtcttttatttatcttatttgaaaatgcctcttatttctggtttaacttgcgttgttccagggatgaaatgaatactttcagttcctgcttctgctgccgtttgataataccagattttccatcttaaaaaggctaaattcatttctaaaacttttattttttcttcaagttgctcttcatgggtttccatgaagtctaaacgttcatcaagtgtggagtccccctccatacaccaatcaataaattgggcgatatccttaatcggaattcctgatttttttagacaatcaatcacttcaatataaccaaggtcatcgtcggtgaattcccttcgtccagctttatttcgcttggcaaatggcagcaaaccttcttaatcataataacgtacagcatcattagaaacattcaatttacgtgaaatatcaccaattgtatattttgtcattctttctccttgacatggagttaactccatgttgtataatcagtatatcaaaaaaatactcttaaggagaaataaaatgtctaaaccacttattgttataacaggagcaagttcaggcttcggtgccgaaatcgcaaaactctttaatgctgacggattcccaatgttgcttttagggcgtcgcactgataaaattaaagctttgcctcttgattttacaaatgttcttgtgtaatctgtagatgtcacagataaaaaatattttgaaattgctatttctaaagctgaggaaaaatatggcaaaactgaccttttggtcaacaatgcaggtgtcatgttactaggaaacgtcctaaatcaagatccagccgagtggaaacaaatgatggatactaatgttttaggtgttctcaatggaatgcaaattgttcttccacaaatggttgaacgtcaaggaggaccagtgattaatatgtcctcacttgctggtaaaaaaacttttaccaatcacgccgcttatgtcgcttcaaaatttggtgtccatggtttaagtgaaactgtcagagaagaagtttctgctaaaaatgttcgaatttcacttgttgcacctggtgctgccgaaacagaattattgacacatgttactgacaaaagtgccctaaatgattataatctttggaaagaatcaatgggtggtacaactctagcccctgaacgagttgctcaaaccgtgaaattcatttatgatatgcctcaatctgttaatatcagagaaatcaatattgcggcaaccaatcaaaatgcttaatatttaatatcttagctaaaaaaagatactagttgaccgctagtatcttttttagctatttatttcatattttatctacccgaaaactagcctcactcttcaaaaattcttatttagaaaatattttcttaaataaattaggcgctttagattcttttgttgcttcaataatatcagttgccataagttctggtgctatgtgatatcgattgtaaagttcatttttgggaacagcatcaataaactcagtatctgcaccatatacaagtgtttttatccctttgcttgccaaataagtagccactttttgaccaaatcccccatctttagtgccatcttcaatcgtaacaaaaagtccatgagtttcagataatttatctaaagcatttacatccaaaaggtttacaaagaatggatttacaaccgttggattaaatcctgatttttcaagttcttttgcgacattttcagctttttcaagcattgcaccaagacccaagagtacaactttttcgccagacttaacgacttcataatgaggtttgctaaaatcagtaatttttgttggacgattttccaaagtatgctctggcaagtgtataaacactggatattcatgttgattatatgcccaattaagcattgcaaaaaggtcttcctcacttgttgcagcaaggtcaattacattgggaatatttgatgtttgactataaacaaaactaccttggtaagtatcatttgtcccgccaatttggctgttactgataataacaattgctggttctttattcagtgccaagtcatgattaagttggtcataagcacgttgtaagaaagttgcgttttggaaaattatagctcgagttcctgctgccgcgattgctccaccaagtgtcactgtatattgttcggcaattcctccgtcaacataattttttggatgattcttggcaaattgagacaggccaaagaacattggaattgcggcattaatggcgataagattgtcacctttggctaacttttcttccataaagtcaagaaatacattattatagctgcgaacggtatttgttgagctattgactggttgacctgtagcaatatcaaaaggtgcaaagacttggtgcattccttctttattttcaactgctggtttataaccatgtcctttttctgtgtgaatatgaagaacaattggacgattaatgtcttttactgattcaaaaagggcaatcaaactttggatatcatttccctcctcaaggtatcggtaatcaagcccaaatgatttaaaaaggttatttgctgaagttcctttacttgctcgaagatctgcaagatgttgatagattcctccctgattttcggtgatggccatttcattatcatttacaataataataagattcccattaagtgtacctgtaccatcaagtccctcaaatgcaagtcctcctgatagcgctccatcaccaatgatggctacaatatttccattttttccttgcatatctcgagctaaggcatatcccatagctgttgcaatagatgttgatgtatgacctactcgtataaagtcatgttcattttcttcagggtctgtatagcctgttgttccagaaaacttgtcattgtcagtaaaaaattctttgcgccccgttaaaactttatgcggatagctttgatgactaacgtcccaaattaatttatcaacaggtgaattaaagactttatgtaaagcaacagtcatttctaccacaccaagatttggtccgagatgacctcctggatattgactcacacgattaagaattgcatcgcgcacatttatagcgagctcttctagttctagaggtgtaagatttttgatgtctttgggttcatttactttgtctaatactgtcataattttttcttcctagttctatttagattataaagctgcgagtaaatttttaaaattactaaggagaaaaaatatgacattaacagacacttacacattaaacaatggcattaaaatcccaaaagttggttttgggacttggcaatcagcaagtggagaagaagcttataatgcagtaaaagctgcccttgaagcaggctatcgtcatatcgatacagcggctgcttaaaaaatgaagaatccgttggtaaagcaattgctgactcaggaattccacgtgaagaacttttcattactactaaactttggggcgtaggaacgacagaagatgcagcaaaagcattggacgagtcattggaaaaattggggcttgattatgtcgatttatatctcattcattggccaaatccaaaggcttttcgtcctgacttttaaaaacgcaatctcgctgtttggaaagcaatggaagcaggattaaaagctgggaaaactcgtgcgattggtgtttcaaacttccatccacgtcatttgaaacctttgttgaaatttgctgaaatcaaatcagcagttaaccaaatcatggtcaatccaagtgaccaacaagaagaaattgtaagttttaatgtggacaataatatcttgactgaggcttatagcccgcttggaactggtaaaatctttgaagttgcagaacttgctgatttggcaaataaatataataaaacaattgcccaagtggtacttcgttggtcacttcataaaggatacctcccacttcctaaatcagtaacccctgctagaattaaagaaaatgcagaaatctttgattttgatttaagtattgaagatattgcttttattgacagtcttcatggtaaagccggattggctaaaaatcctgatgaagttgatttctaaagaataataatgaaatattttactgacagattgtttacctttcttacaagacagcagagaatttggtcagtaaattaaaaaaggtctgtcagtagaattttgctgacagattttttagatttttgctataattatctctaactataaaacgctagactgcctagtcgatccacgctcaccttgcgaagaataatgctcggtcataataagaaaaaattatcaaataccaaggagaaaagatgaaaaaagcacttgttttagttgattttcaaaatgattttattgatggaagtttgggaacaaaagaggcgcaagctattcttcctaatgtcattgaaaaactttctcactatcctaaagaaaatcggtttgccacgcaagacacgcattttgaagattatttatcaacacaagaaggaaagaatttgccggttcttcactgtcaaaatgggacttatggttgggaaattcgcaaagaagcacaagttggctttgctaaaatttttgaaaaaacaacttttggttcaagaagtttagcggaatttatccgtgatgaaaactttgatgaggttgaactcatcggaatttgtacggatatttgtgtggtttctaatgccttgttaatcaaagcctatgctcccgaagtgaagttgacagtcgatgcttcttgttgtgcgggcgtttcaccagaaaaacacttggctgctcttgaaacaatgtcttcttgtcaaatagaaattataaatgcataagttgcaacaaaattactgattctgtcagcaatttcaacttgacaaattcttatctatcattgataatggaaagagaaatgacaaaaatttggaagtgtgagagaggttaaaaatttgaattatcatcaattattttcccgcttgaatgaaaaactttcagaagagaatttgcaacttcatttacactgtgttggcggttttgtgcttgaatactatggaatgaaggcgacagaggatattgatgctttttatgagactactgaaaaaatagataaaatcattgaagaaattggtgaagaatatcatgtgggaactgctaatgaaccttggctgagtcaagcagttggggaagttatgtctcattcaaaaacagatgaaacaattatttttgaaggaagtcatttgactgttgggctctcaccactggaagcgattttgattgataaaattcaagtcggacgtaccaaagatgtgccagacattgcaaaattgatgaagaaattgaaaattgaaagtccggatatccttttagaacgttttaagtatactgatggatcggcagacccagcggttattttagaagcttatagtttggcttatggtgaagaagctttaaaaaattatttacgaaaaaatccaaaaatactgaggttattacaatgacgtggattgaatatctcttgcaggctgcccaaaagtccaaatggaatttagaactttgggttcgctacctaaacaaagtgattcaacgtgacaaaattttgctctctaaaaaagagattgactatttaacgaactgtgaagaattaacttcatttcaacgtgtttttcttgaattggctcttgaaaaagaaacaactccttgggaaatgactgttggaatgtcagaaccgacccgttctatccatcttcaagcggttttacaagaattaaaaaaagaatgaattgaatttcattcttttttttattagctaaaagttcattaataataatttattttattcgcagatactgaccaattaaaatagtatcgctagataaatgattccaagccttgattgaagcaattgggctgccagatttttgcgaaagtccccagagagtatctcctttaacgaccttatgaattgaggcatttgagttagaagaagtcgagtttgagttattggtagcagttgagcctgaacctgtcgaaggatttgaagtagcagcagattgtgaaacaataagattttgaccaatataaatggtatcagaacttaaatgattccaacttttcaattgagcaatactagttttatattttactgatagcgcccaaagggtatctccggacttaaccttaacagatgtttgtgaagctggctttgcaggtgtcacagaagtggttggagtagtgcttgcggaattgtttgaaccacctgaatttgtagaagaagctgaacctgtcagtaaaagtttttgaccaatgtagataatggtacttttaagattattcgcactttgaatttgagcgacactaattccatatctttgtgaaatttcccaaagagtatcaccagatttgacggtataagtagttgaactgctattggttccagaattattattcgtatttgtggttgtcgagccaccagaattagtatttccagctgaagaagctccgtcaaaacgagtcaaattatattgagaaataatgcgatttagtgaagcgccataacttgggtcggtagcatatttgcccgtcaaagcagcagtagcgtcttgataggtggcagcattagcccgccaagccttagcgtaatagggaccattcccaaagtttgttgtttttaggacataagcattgtcttgaaaactttgattaaaggaaggatagaccctaaagggcatatctttagtcacccatttaccattgagatactcttgagttttaaatacgacactctttccttgataagtgccttgaataccaaataaattataataaggtgctcgtgaaagctgacttgagccccagttgctttccaaaatagcttgggcaatcatgaccgaaggatataagccattagcatctgccacaggttttgctgatgcggcaatactttcaataaaagcctctgatgagttagttgctgcttgaaccattggacttgtctgttgcagaagaagttcatgtgtggttgtcaatgttccggcaataagaacagcgccaacaaattttgtggttggtttataaaaagcgagtggttttttagttttcttttttaaatgtctatttttaactttaacacgtgatactggcataaataattacctttctaaagattacaaaatataataagtactatctttattctaccacgcctcaagctaaaaaaagatgtcaatttggtggcggtttgtaaacgtttttccgttaaggatttatatttgtaaaaactttttgcctttaatctaaaaaatctgatttaaaacaaaaacattacaattgtgatacaaaaaacttatattttgtcaaataataagaaaaagctgaatgaaagcaagcaacacaagatattgtgtgtcattacataatttattatcaacattctattaatctaactatattttaacagattttggaacgtaacataaaacgtaacacttagaaaatgttacgttcgctataacttgcaccgccgtgcgcaaaattgagaaccatgagtgagcactatccagtgctttttattatggttcttgctgaactcgaaccagcgaccgaaaatatctactgtaatttttctaatctatttaagctctccaattttacttgtttcattaaatcttggagtctttttacttctgaatatatttcatttttgaattttgtcagcacgacatctaattcttctctatttaaaaatttactatctgataaattatctgacttacgaaccatgaattctatggaatatacaatagaagaaaatattttttctacctctttaatactaccttctcgactcatatgaaattgtaatgaatttgacttagaagtaaattcattagtcaaatcttttctgtaattattaaatttttttatagattctttagatttttcgatttcttttttaatatatttaatttcttgaacgtaagaatcattataataatcattatttctaaacacttggttcattgacaatttattatttaattctcttaaaacgtttacctcttgatacagcattctcaccgtttgctcttgggtttgtatgttccctattatatcaccggctaaattaaaagttatattatcactatttatacgattttgaagttcaaaggtgtttctttgatactttgattgtttccgaatatctgttctttgccaaatcaaaactattactgaaattattactgctatagaagcagaaattgctgatactgctgaccaatccatattttcattattctcctttttattattctatcaaattaaacaaaaaaagccctgaccgaagtcaggagtaattaaaaatataatccatggttcttgctggactcgattaaaatgctttttacatatctccttataagtcttcgtaagtttcatagcggtattatttgtaaaagttcatccaaatatatcactttgcctctatgcaaacttttttgtccgaaagaatctatcttctttttatttcgactatattcttgtttatagtcattaaatacgtatacttcatacactgctcttgaacattgttttagaagactttctggtccaagaactatatataaatcatcatattttctttcatttccttctccaacttcaccgatttgaatattagtcccgattggtgcgttatgagatttaatttgtacttttttatttttagtgtctaacccatcgtatcctttttccctttgattctcgcataacttaacactgaacttctcttgtacgataaattctgctatatctcctaaatatttttctgagcgaataacaccacattttctcaattctttaacagcacctagaaattcattaagtgcttcgatttgcttttttttcaatatatacccctttaattatgctatatataagtttatcacaaaaaacaaataggtaagcgcaaagctgcactctacaaattatgcaaagtaattttttccttcacctcaactatcaaaaatttaatcctagctaaaaagcattcattaagaatgctttttctttttttgaaatttcgacactttgctcataagatagattcattattacctcctaattatttgaaaaaagataacctagttctttttggagctggttcaaaacctggttcttttctcgtaacgtcgtcctgttatttcgagttccatctttcagaattaatggctctttagaaaccaactcttgcaataatgaaatgataattgaaagttgattactgttatcaacaactggagcgttaactactaattgttgttgaactgctcgcatatctctaaatattttcgcattggctggaataccaccagtcccatcggcatatttagggataagttgtgctgttttgctagcttttaaaatttttgttcctttaggtagtggcattgtcacatctcgtccttctggaataaaacttactccattaggaaggctgattaattccttataggttggccctttttggtcattaaccatagcaagtccgcctggatggtatggtgtaccttgagcgttgtttgttttatttatgattaaatcaattgtttttgaagtcggaatatcacctaagaatccactcaatgttgttcttgctccactgtcattggcatcaattcctacagttttaccttgcaatgcagcaattgttgcggcagcgctatttactccttgccctgttccgtcaatagctcctaggggtaccgtttttccttgtagtgaatcaataatagcttgagcgtccatttttggctttaaagtcaggttttgcgctaaaaggtttttttcttctggagtagctttattccatgcatctaaaatagccgatgcatttgcttcgttgttaatgaaatttgaattgtctcccagtaatttttttacttcgtcaggaatactattccattcgtttaatttttgttgagatgcagcaatggcaagcaatccttgctgattatgtataaaaagctctttatctttaggggataggctatcccattgaccactagcgataactgcttctaaaattgaagctttagcattagtagataaattagcatgcttcatcacaaattgaatttgttcccaaccacctttttgttttaatgtatcggcaaccacttgagctgcatttgttgtaactttccctgtcttagggtcaagaaccaggccattccatgtatcatctgctttttttacatcgctactcatatttttagcatattgggcaagcaatttagaactatcgccaagctcttgggtgctgcttttagctccacttcctgctttttttaacatttcttcgaaatctaatccgtaatcagcaaattgcttcgactgccttctcatataagcaccatatgcttgagtacctttttgcatattatctataatcacttgttgggtagccgctaaatctacaccatacttttccataatttgtttatgctgattattatatgcttccgtagtctcattatattcctgagcactcattttcccgttttcgaaaagttctttagcagctgccattttctttttatagctatcattctcactatccattaatttcgttaaactgtcagaaacattattggcagtttctactgacatattagtcatatcaccatttaaagccttcataacagccgtttttttgcttccagttattttcaaagcatctaactcttgaccggctattacgttctggtcagctattatcttagaattttcatcagctgtaatttgtctatgattttttgcagcattttgatagatattagtcatatcatctgtcgccgctttaataacatcctttgctttagaaccgccttgcttaagattttttatttgatcatcagaccaacctaaaattttagcatcatcaattaatttttgtgtggctgcatcaatatcactattagcggcagttcccatatcagcaatagcttgcttcacatcattgaaagctttagggccaatagctccaaatttttcagtagctgtttttaagccttctactttttcttcaaaatttttaacttttttgtaagtttcgtcaggaacattaattgttccgaatacattatgcttatcttctaatttacttacttgatcaagtaccccaataatcaatccagctaaacctgctgtacctaatgcaccaaccgctataggagagattccagctagaataggagagataccacctagctctgcagctaaccctcctgagcctcctactgcttttgccgctaatcctgcttctgtagttatcccttcgagtgctaatttaccagcacctctagccccaaatcttgccagaccaccagtaactccagacagaatacttgttaatccacttaaagctttcgctgttggagcaactgcggccgctccaagtgccatatggatgataaattgttgagtttccggacttagtttttcaaatgagaaatataataagtattaataaaaaataaaaggagagccaatatagagctttccttttattttttattaattgattttctttgtagagctctttaattttttctggtttcaaattttaaacaacttaagatattttagccatcaaatcaaccatctcaatcgcaccaactgctacctcaaatcctttatttcctgcttttgttcctgaacgttcaatcgcttgttcaatattctctgtcgtcagtactccaaacataacagggatatttgaattcagtgaaacatgggcaatccctttagaaacctcgctacaaacaaaatcataatgtgaagtagaacctcgaatcaccgtacctaagcagataatggcatcatatttatctgaacttgccatttttgcgcaataagcggaatttcaaatgctcctggcacccaagcaatatcaatttgttcttcttgaacaccatgtcttttgagagcatctaaggcccctgctaagagttttgcgttgatgaattcgttaaaacgtgcaactacaattccatatttggcatttcctgttgttaaatttccctcaaagactgtcatttttctatccatgctttctttttattttaatcgaacaaatgtcccattttattttgctttacttttaaataatcctgatcaaattcattttctttaatttgaattggaactctttctttaactggtagcccatattttgaaaaatcattgattttttgtgggttattagtcattaatcttaaagacttcacaccaagtgttttcagaatttgagcacctatggagtattcacgcgcatcttcttcaaaacctagggctaaatttgcttcaattgtatcaagcccctcatcttgaagtgaataagcacgaagtttgttgattaaaccgattcctcgcccttcttgccgaagatataataaaacccctcgtccctcggcatttatctgtgttagagcttgttctaattgttcaccacaatcacatttcattgagccaaaagcatctccagtcaaacattccgaatgaactcggcaaagcactgcttctccctctccaatgtcccccttaactagggcgacatgatgctcaccatttattttattgacaaatccaaagatttcaaaataaccatattttgttggaagtttcgctctggtaacttgctcaaccagttgttcattttgttttcgatattcttgtatggccttgattgtgataaaattcaagtcccattcttttgctttttcttgaagttcttctgtgcgcatcatgctaccatcttcggccattatttcaacacaaactcccacttcctttagaccagcaagtcgtaacaaatcaactgttgcttctgtgtgtccattgcgttctaagactccatttttctttgcaatcagaggaaagacatgaccaggtcttcgaaaatcttcgactgaactttcttcatcagcaagttttctaatagtcagcgaacggtcaaaggctgatacccctgtacttgtctctacatgatcgacagaaacagtaaaagctgtcccgtggttgtctgtatttctctccgtcattgctgacaaatgcagactcttagcatatttttcactcatcggactacaaattaatccctttgcctgactggccatgaagtttatcttttctggactaatcatttcggctgcacaaatcaaatctccttcattttctctattctcgtcatcagtgacaatgatcatttcgcctgctttaagggctgttaaggcttcttctactgtattatattgaaacattttatctcctcttaaaatccataatcaattattttatcctttgtcagcaaggaagaccctgtaaaagaatctttcccagtaagtaatttttcgatatatttacccaatatatcgttctccaaattaactttatctccaaccttctttgcagacaatatggtctctttgatagtatgaggaattattgacacactaaaagattttgaagtcacatgagccaccgtaagactgatgccatcaatcgtaatagagcctttttcaacaacatatttcattaagtctacagttgtttgaacttcaaaccaaaccgcattttcttccttcttgattgataaaatctttcctgtaccatcaatatgccctgaaacaatatgtccgccaaatcgaccatttagagccactgctcgctctaaattaactttacttcctactgttaattcccctaaatttgaacgcttgaaactctctggcataacatctcctgtaaattctttatgattaaatgcggaaacagtcaaacagagaccatttgttgagatagaatccccaagttttaaatcttctaagatactggaagctcgaatgcttaatttagacgacttatctctcttttgaatttgagttacttctcctacttcctcaataattcctgtaaacattaaatgagctcactttctaataatatatcttctcctaaatagaccactttcggtcggtctagtaaataggcttgattgggatgctctactccttgtccatcaacaggacttggagcttctttcccaccaaatattttaggcgcaatataggcctgaactttttgaacaattcctgcttttaatgctgaggcgttgagtcttgctcccccttctaaaataagactatcaatttctctttctcctaacttagtgattaaatctttcaaatccaaatgttcagatatggaagaaactagtaaaatctcgcaaccggcttcaataaaagcttgatgtttttgaatgttttcatttgaggtagcaatgattgttggaatttcaaatgcagtagaaacaatcttagacgtaagaggggttcgaagttgagtatcacaaataattctaattggatttatcccattttttattctggcagttaattgtgggtcatctttcagaagtgtttcaacaccaatcatgattgccatgaaacgtgaacggtcttcatgtaccttttgtcttgctttttcacctgtaatccatttggattgacctttataagtcgcaatttttccatcaagagtcatcgcatacttcatcatgacgtagggggttctttgagtgacgtaatgaaaaaaatcttatttaagtctttgcactctttttctagaacttttaatgaaacatcaattccagcttttttcattgcttcaattcccttaccggctactaaaggatttgggtctagactcccaatgactacacgcttcactttatttttgatgattgcttcaaaacaaggcggttgcttgccttggtgggcacaaggttctaaggtcacataaatggttgacccctccggtgattctatacaagatttaaatgcattgatttccgcatgtgcttctccatatttctcatgataaccttgaccaataatttgaccatcattgacaataatcgctcctacttgaggatttggattaacgtttccccctccttttcgagccagtaggattgctaaattcataaaatgctcatcattttccatccatttatcctttctaaaaaaaataagccccaaaataatatttcaagggcttaggataattttctattttattcaagcaaaaaaacagctcaaaaaaaccaaaaatggagtgaattagatagattcactccagagtttaaggctaaatagaaataatactatcatgagtattatgggtttttatcttctttcatccagactatactgtcggcctcggagtttcaccgaatcatgctgctagcagctcgcgggctataccgctggtagggaatttcaccctgccctgaagatttattaaattgtagctaaagtatagcatttaattttaaagattgtcaagatataaaaacgtattctttaaaataaatagtttttttattacttttaaggtagaataaaattaggagaaaataaatgaaaagtatatatatggttacgattctattagtaacggcatttggaatgtcagcttgcagttcaaaacaaactaaagaagtttcaaaaacgacttctgaaagtagcttcatctctcagcaaagttctacctctcaaaataattcaagtataaaaagtcaaactagtagttcaaaaacaacaacaactgacgaatcaagttcaacgattcaaacagaaataaaatggaattcagaaaagaagttccgacttgcagagtttatgagtgcatgggggaaagaaatgaatcaaaactatagtcaatatgatcctacgcataacgttgacttttatggactctctcttccattttcagtattaaatgataatacagcttggaaagcggccattaataatcaaccgattgatttaagatggtcagagacaggagaaggagaaagagattatttattagttgatgtttactcggattttgggacaaagaatacatttgaaaatcatgtctatttctttgtgcttaaagctggccgtcctcttgtgctctacactggccaaaatcaaggaaataccaatcattatttacacttaaaagaaacagagaataatgaattaaagaatgcctttgctcgaattgttggataaatttataaaattaaaagtaagtctgcaagctattgcaggcttttttagaactcaaaaaatttttttccttaaagaatttttattcttgacaaaagatagcgaacggattataatagttaacgtcgttaataaatattaccgttagggaggagtgaaaatggactacaacaaggcagcggaggttttcctcacaactgttatgaaaagaggaaaagcagagatgatgcaccgctttaatacctactcccagggggagcatttggtgttaggctatctttataaggaagctggtaagcaaattgttcctagtaagattgcaaaattcacgcatacaagtacggcgagaatagcaataatcttaaataatcttgaaagtaaaaacttgattactcgtgagatttcaagaacagatcgtcgaaaaattttggttgcaattactgacaaaggtcgacgtgtcgcagaagaaattagagtagaagcttgctcaaatttggcgcgagtttttgaagaaatgggtgaagaacgaacagaaagtttcattgaaaatttcaaaatgtttttagaaattggcatgaaactcgcacaagaagataaaggtaaagaggaggaaaaaaatgcctgatacttacgaaaaagattaccatttagatatacatggtaaacactatagccgaatcggaatgcttattttgattctggttggtacatttggtgccatgttgatgcaaacatcacttggaacagcgattccaacattgatgaatgacttcaacatcaaaatgtcaacagcataacaagcaacaacttggttcttattagcaaatgggattatggttcctatttcagcttatttagcaacaaaattccctactcgctggctttacgtgacagcatacgcaattttatttttaggaatgtttgttgcttactctgcaccaacatcaagttggtggattttccttgctggtcgtattcttcaagccattgcggttgggattacgatgccattgatgcaagtggccttggttaatatgttcccagcgaaacaaatgggagctatcatgggggttgccggggttgtactcgttcttgctccagctttaggaccaacatttgcaggttggttaatcactcatgattttaatcttatcttctggacttttgatgcaggttggagaactattttccttattccaatgattgtcgtcggaattgtcttcctcgtttcaatttttgccatgcgagatgttattccaaaccgtccaatgaaattagacttcctttcagttattctttcagttgccggttttggtgcattcctctggggattcacaaacgttgcaactgatggatggggtaaatttaatactgtaattgccccaattgttggtggtttaattatcatccttctctttggattgcgtcaacttaagatggacgatcccttccttgatatccgtgtctttaagattcgacaatttactttagtcactctcgcccttgctttaagtacaatggcaatgatgggtgttgaaatgatgcttcctctctatcttcaagatgttcacggactttctgccttcaactcaggacttgtcctcttacctggttcattgatgatggctgttgtagccccacttgctggtggtgtttatgaccgtattggttcaaaacgtctcgccgttattggtttccttgttttagcattgggtactgtaccatttatgttcttcacagctacaactcctgatcattttgttactcttctttacggcttacgtatggttggtgtaggtatggttatgatgccattgacaacaagcgcaatgaatgcagtgccagtaaatgaagttgctcaagctacagcttcaaataatacagcacgtcaagttgcatcatcagttgtcgttgccctcctttcttcagtagcccaaaacgtaattacgattaatatgcctgcttcatcattgaaagcagccaatccattgcaatttgcaaataaagctattgaaggaatgttgcaaggttaccatgcctcattggcaattggacttgtctttgcaatcatcggtatttttgtagctctttctttgaagagtggccgaatgattgctggcctaccagttgaagaacaagaagtgaaaggagaaaataaataatgctgattatattattattggtagtgtttatgattggaaccttctttggtttcatgttcataaagaatacaattgctcattggttagttggtggaatttcctttctattattagcgggttctgttgctatgttgaccatgcacatcaaagataactggggaatgaaagaagtaacaacttcaagtactcaccaaatctatactgctggagataattcagctccttatggcatgatgattaaagcagaaatcggaaaaaatactgacaactatgttttggtatatcgaaatagtgaaaaagctgaaaaagctgaaaaagctgatactaatttcaaaccaaatcaaaaaaatattgttgaagctgttaaaaaatctgcaacttataaattagtagatgatactaaagcaacagttacgactaaaacaactagacgtgtttggtcatctgatttttataaattactgtttagcgttggtggagaacaaaatgaattggttaaacaacaatctgttgtatcagttccgaaagatacttggctcgttttaactcaagaccaagttaaaaaactaagtcaagaagctccagctatgcaaaaacaaatggaagcacagcttaaagctgacccacaaaaagcagcacaacttgctgccctccaaaaatcaaatccaacagaatatgctaaaatgcaagtcaaacaaattaagcaacttcttggaattacagaataataataaaaagacttcaaaattatttggagtttttttattacatataaattaagtgaatataaataacgtaaagtgaatgactttactttatttatattgacaataattgaagtaaataatacaattgacaaataaaagaaatttaattttcatacatcacaaaatatcttttaaaagataacaaataataaatttaagcgttgtaaggtaagccgtttttactaaatatttaaaattttcttagatatatcaaatttagagtatataggcaaataatattagaacactagaacccactaaggtaaaattacccaaccagaagccgaccaaagaagaaacaaaggcaccgataacaaaagatagagcaagggataaaaacatgaacgagtttcttaaatattttgattctttagaaacaagatattcgcctagattggttccgaaagctttaatattcacggttgacatgatattggcatagggaagtcctctcacttttgtaaaagtatccccttgtattaccatgaaaaaagaaaggattccaacaaaaattgaggccgacaagtgtaaaaaagtagcaaatgaaagggaaaagataaggattccagtcatttgaatgaataggagtggaccaatttcactgtggttattcttgttcttatatttggtaaataatgttttaaaaagggctcctagggcaaagaaaaggatgggaatgataaattgagaagctttttcaaagtttccatgtgctaaattaattccggtttgtattagatttcctgtttgcaagctagcaaaacggccatcaaaatggaaaaaagtaaaggcatcaacaaagccagtgttcattgcgagcaataaagcaacgagcagactttctttagagttagtagtggatttaatcataattatttccttcataatctatagaagataaagtcattatagcacaatgctttttcaatgttatttatttaaaatgataaaatttattatcaaaaataaaaattaaattgtcgctattaaagtaattaagttataaaataataaatatagcatgagaaatcaactagatttcttgtgtttggataagcaatattaaaggagcgtgtggtataattgacacagggctttattgtaagcctatccattttctaaaaggaggaaaagatatgcgtcgttggattattcatctcgttatgactgtcatcggagcatcgctaggtgttgctgttgtaccgtccattttaaaggtatttggttgggacaaaggaattttacaaaacgaagctgttgacggtgtgattggtgcaattatttttattattctttcatttatatttgccggttcaatgcttaatgggttgaaaaaaatagattctagaatttcaaaaatgaatatgtcaaaaatggtctttaatattattgggattgttcttgggcttctagttggagttattggaagtattccattaagatttttaaatgttcctattttgagtaatattatttcatttatacttgtattggtcatgatttacttaggttatgttttatttgaccgtcgtggagatgaaattgctaaagtgctctttcgtaaacgtcgggaggtcatggcaacagaagctgtagaagttgctgatgaaacggttaatgaagcaaaagttgaccacagtattttgttggatacaagttcaattattgatggtcgaattttggatgtgataaaaacgggatttatttcagataagattattgttcctaattttgtgattttagaattacagttaatttcagatagttcagatcctttgaagagagctaaaggacgtcggggattagatttggtaaatgaattgactaaatttgatcaagttgaaatttctcaagttgactttacagatgttcgtgaagttgatactaaattacttaaatatgcaagttccactggttcaaaattagtgacgaatgattttaatcttaacaaagttgctgagattcaaggggttcaagttcttaatattaatgaccttgcaaatgctgtgaaaacacaacttgttgtgggagaacgtattaatgttcaaattattcgtgcaggttctgaacgtcaacaaggagtagcctatctgccagacggtacgatgattgttattgaagatactgcaaaattgattgataaaacagtgactgtagaagttgctaaggttttacaaacaagtgctggtcgaatgatttttgctgatttggttaaaaaataaaaaggaaagccgataatttatcggcttttatcttaattgtgtgtttaggagttaatgatgtatttaaaaaggtttgttcagttattcgtgattttttttgtttctcttgtgatttttgctttgatattagaaaggaattttggtaatttttggttaaggtttgctttggggcttttggttgcttatatctttctaaccttacctcttgttctgttgactatttttaaaagtaatcgaaaagctaaagttgttggtacaaatgcatcgacaaatgaactggcttatcttctgaaaggttttccaggttatcttgcattgagtgttactgacgagagcttaaaaagttcaactacaattatgagttttattcaagcccaaaaaaatgagaatgttttatatatggtttcagataaaaaagcatcaaagatttatgacttaaaaaagaatccattagtaagttttacaacttggtttgactccttagaaaatggaggacgtttatcttcgaatcgagtgaagtctgaagtttttgagggagaggcagcccagaagcttattaaggaagaacctctaattctgtctcttcatgagaacgctgagaatatgtccattattcgtttgaccattgaatcggtgctctatgaaaattttaaggggcagatgaaagtaattgagtttgaaaaataagaatagaaaagctgcttttatgcagtttttttcattgccaaaatattgaagcgcttgacaattttgctatatagtagtactatatagctgtaataagtaatacaatatagctggagataaaatgaaagaaataacagaattgctgaaaggagttcttgaagggtgtgttttagaaatcattggtcaaggagaaacttatggttatgaaattactcaaaaattacggaagcttggctttgaggatgttgtagaaggaactgtttatacaattaccatgcgtttagaaaaaagagaatggcttgaggtcactaaaaaaccctcaacaataggaccaccccgtaaatggtatcggttgaatgaggctggtcaaaccgaacgccaaaatttttgggaaaaatggatgtttatctcagaaaaattagagattttaagagataaaacaaaatttacgacagagcaaggagaaaatgatgactagacaaagaaatattgttgatagaatgattggccttgaggaaaaacgagaatttcgggaatttgaagagcgagctaaaaatcttggcccagattactataaagattattgtgaattaaagagatatgtttggatttctggagcaagcaaatggagcgattttaaatttatttttaatcaacttttggatttgcttgaagaggcgaagggacaaaaaagaaagctgacagatttaattgggacagatgttgcggcctttattgatgagatgattgatgataagggttgggaaaagaagcaaaaagtgaaacttaatagggcggtgaaaaaatgattttagagaaaattagtgacgtcttaaaggaaaaacgagaatggcaagctatggaaaatcgggcaaaaaatttacctaaggatttttatctagcttataaggctattcaaaagtatatgtttaatatgggggaaacagattggcatatttttaccgatattatcgaattgtttgagttggctgtcattgacggacggaccctagcagaagttttaggtgaagatagttcggcttttgctgacgaattattaagtgaaaataaacaagattggcgagaaacatatcggcaagaattgaatgattattttgctcaaaagtaataaaaaaacttacaataaccttaattttcaaatgataaattctcatttttaactttgaatctaaaaagtacaataaaaacaaattttaaattttatttttatgattgtgtctttctttttaattcattattagtgcaacaattatccccaaaatagttccaccaacgacttgaattggtgtgtgtcctaataattcctttagattcttgtccactttaattccagcattttcaacattttgcaacatacgattgataattcttgcttgattccctgcctgccgtctaattccttgggcatcatataaaacaacaaaagctaacacagttgcaatcgcaaaaagaggagactcaaaaccttgtcttaatcccgttgcggttgccaaagctaccactaatgaactgtgagaactaggcattcctccggttgcaaaaactaattgccaattgattcgatgagttcggatgagctcaatccctattttaatgagttgtgctaaggcccaactcacaattgctgtcagtagaatttgattatgcaatatctgactaaaaaaattcataacccctccttaatttcccctaaattaaaacccctcacttactactcttattatactatataagccttttaaatcttgacttatttgctgacaaaacaaagaaattttatcataaaactagcatgaattttaaatgaaaaatacaaaaagaacaagtttaaccttgttctctgagtttttctaattgttccttgaagaggtcaggagcatcaacttgaaactccataagctctccacttgttggatgttcaaatcctagcgtttctgcgtgaagaaactgccccttattgggtgttagagttttattcgggccatagagcgggtcacctgcaacaggatgaccaatataatgcatatgaactcgaatttgatgtgttcgtccagtttccaagcgtaaagcaattaaagtataaccaacaaaacgttctaaaacctcgaaatgagtcacagcaggtttcccaccagacacaaccgcttgtttttttctgtctttaagattacgaccgattggggcctcaattgtccctttatcattggcaagctctccatggacaattgctaaatagcgacgtttgctggtcttgtcttttaattgagcagctaagctttcatgtgctttatcatttttagcaatcatcaaaagaccactagtatctttatcaatccgatgtacaattcccgggcgaatgactccattgatacttgaaaggtcttttatatgatacataattgcattcactaaggttccagaagcatgtcctgccgcaggatgaacgaccattccttgtggcttattgacgactgcaacatctgaatcttcataaataatttccaagggtaaatcttcagccgcaacatcaaggacctcggcttgcggaatctcaaattcgattctatctcccgttttcactttatattttgctttttttgcttcattattgacaaaaactttgtcattttttataagctctgtcagtaaacttcgagagtactctgtttgatttgcaagtgctttatcaagacgcaaatctttattttcttcagtaatttttattataggcaatcgatttttcctttttcatagaggttttaatgctacttactgtcactcgttttttaaaaagcttattttgtttctttgtccgtcaaaattgcaataaatagaacaacaaaaccgacagatagtaagatatctgcgatattaaagattggaaaattcataaattctgtttgaaacatatcgacaacaaaaccttgacgaacgcggtccataaaattccctaaagctcccgcaataatcaaagttaagccagcaaaataccaattttgtcccatttttttccacaaaaaccatagtgcaacaatgagtacaataggtgtcaaaacaaggaaaaaccattgttgaccagaaaatgatgaccaagcagccccatcatttttaatataagtcaggctcaatacatctggccaaattttttttgtatctccaagttgaatattagcaacaacccaatttttgaaaacttggtcagcaataattccaacaacgataattacaagtgacagtaattttttcatattttaattataccacaccgcgtcaacgagggtcaataaatatcataaaatagacttttagcccttttcagaaatagaaagcccccaaaaatcagaaaattcctttaaaaatactttctgtcagtcaatgaattctttagcactaaaaaaaacttataatgctttgccttctagcactataagttcaagtcgttaattaaattagtctctctagctgtttattgtcatcatttttaaaacttttttgaaagactttcccttaactcctcaataacataatctgatagtttactcccttatattcatataatcatgccattcaactatttttttattttcaataaatatgattgagcaaaaactttcagtctgtgtgtcattattgactaaaactttatactctaatgttatgacctctctttctttgcttttatccttgtacacccctagaagttccccagaggttaagggaacactataatcttcaaaccaagacagataatcttttttattcattgactttgggaaatctgcgaaagaaaaattaaaatgaaaaattgccttatcatctactgcctcccaaaagctacttccattaacttcacccttcaatccttccatcactaaatcaaaaaatacttttgagtgttcattatagccatattccatgctgcactcctcctttaaatctatttttattttacaaaactagtataatatattatagatgacaaatgtatgtcatcaataaatatttttaggaaaaaaatgaaaatagaacgattaatcaatattattatgttgttattagaaaatgatacgatttctgcgaattcacttgctcaacgatttagcgtaagtaaaagaacaatattgcgggatatggatagtctgattttagctcacatcccaatctatactacccgaggtcccaaagggggatttggaattatggatagttacaaattcaacaaacgacttcttaccgaatttgatattcaaaatatcttgattgcactttctggactttctgagtttacggctgataaagaaacagctttaaccatcgacaaactgaaaagtttactaccaaataaaatgaataatcttaagactctgattgattttgaagagattcatgaagctctctccgctgcaaaaaagttaatattttttgccattcagcattctaagacaatagaaatcagctatattgaccagaatggtcaacaaactgagcgaaaagtagagccctatcaactttattataaaaatactagttggtatctttattcctatagtttagataagggggattttcgaacctttaaactttctcgaataacttcaatatcattgttagaaaaagagtttgaccaaaaatcttttaagtccactgataatacaaatccaaatcttaatttttctttaagcaaaatagaggtcatcgtgcataaaaaatctcgtgataaattaattgaaggagttgaaacaggtgaattgctagaggttgataaaaaccattatcaaaccactcttgttctaccagatcatgagtttggttatcaatatttagctaattttggcacaactttaaaaataattggtccagatttttatctcaaaaactatgttgaatggttagaaaatttataaactatatcattataaatcgaactaaaaaatacgttttttcaaatcctaagtacaaggttttacatcagtaaagctattactaaaaaaatgataattatgcttgctaccagccctaaaagtaacagaccaataattgttctcttctctcgattattattcattattaactcccaattcaagctccaagtatctactattcttaaattttaagaaatatgtattttttaatcttcactcaatactgtgcccagtataacactttaatctttaattgcaacaaaaatacaaaaaagccactcccgattgagtggctaaagatgaaagagcgataatttcactgaatcacctttagattaagtataacattttgatttctaaatacaacagtaaaaataataatgaacagtttttgatataaatgactattccttctccttttcatgcgacatatttataaatcttttactatttttagtaaaaaaatagacaaactcgtaaaaatgtctttttgttttttaacataatatgttaaaatgtattgtataacttacaggagtttttaaaatgaaaaaatcaatcgttgccctatctacttgtatactattcactactttaccttctccgacaaaggcagatcaacttgataatctatcgcctgatacttctgtccaagccgaacaagaatggtatggtatttcgacaattgaatttttcaatatggggcttgactctggaattattgaagtgacacagggcgatattattattgggacagcaacttttggttattatggtggtacttcacttacagctgacgatatagttgtcagttctaaccttaattatgtcgttatttctaatattactattgataataattcacataccggtacctttgatattatggtagatacatctaacattagttctggaagcgaaacttttcaattgaatattacagatgctctccctgaaaatgatagacatgttacgccctactcaataacaaacatgattcagattaatgaggctcctgagcctgatccagatcctacacctgatcctgatcctacacctgatcctgatcctacaccagacccagatcctacaccagacccagatcctacaccagacccagatcctacacctgatcctgatcctacacttgatcctgatcctacacttgatcctgatcctacacccgatccagatcctacacctgatccagatcctacacccgatccagatcctacacctgatcctgaacctacacctgatcctgaacctacacccgatcctgaacctacacccgatcctgaacctacatcgccctctataaatcaaaatacggtcaatattccgaaagattctgtcaccttaaataaggcaattatccctaacaccgtagaaaataatataaacacattaccagaaaccggtgataatggaaaaacgaatatttctttcattttagcgggaatcattatgataagctcagcagcaatcttattatacaaaataagataaaaaatactcagtattcctgagtatttttttaataaagttaatctacttaccaattgctccttggtatattattgagatggcctacgataataactttataattgttttattcgttcaatcttttagttttataaattatattattgttcactttttatagattacttttaaaccttagtgattgacaccttatttgaccattgaggagtccataaatgtttgtgaaataatcgtatatcttgagctatcagcactatcaatcatttctaattttccgtcagcattaaccctgaactcattaattttagttttgttagcaattgccgctccaccatttggatttgctgagtaatctatttttaaaacatcagcataaactaagttattttctaaatgaatattgacatcataagttacatttaatctaggatcgacgcctttgctcgcaaaaattgcatcttgaaccgctaccacccagtagagtatttctttttcatttaagcctttttgattaattactggaaaaatatccgaagatactttcattcccggataatgttcaaaatctaagctttctaatgaaccattatcatttatttcaaaagtattccttgaatcaatttgagctgttgtgacttcagtctttgctaccgttctaccgtcactttcattattaaaaacataaatcctttcagggcgattatcaagtggattttctccttcatacattgcaacccattgtttaaattgtaaagccgaaaggtttttagtatcaactgttgagctttgttgactcgattgtgtagattgacttttagatgaactgctagactgagatgagttctcattttgtgaacttttttcgtaacttttgacgattgctctattttagaactattacttgtattagatttttgtgagctgcatgcccccagcgtcaaaagtgctgatacagaaactgtgataatcgcaaattttttcataaatatactcctatattttatattaatttaagagtatcatataaaataacttatcacaaacactttgtgattttttataaaaaaatatcaggaactgctgacagccctatttaagagttttattagtttatgtaaataaaaaataaaaaaagcacctaaactaataggcacttaggagttttatgaaaaagttttattttttggaatatatatatattatagccttcttttcttaaatgaataataaaaaagcgcctgggctagaggcacttaagaatgaatcttttaaaaagatttttgtactgtatttgttttacccttttttctcttatttatgaaatgatttgtttacaaaataaaaatagctccacccatagagtattaagtacaaagagcatgattaattatgtacgttgctactgttgcctaactcgatagtattgtaaagccaaacatagtaatatttaaaatacaattttatccataaaaaaccctaaccaaagttagggttaattttctaatttattcgtatttagttgactttgtaattattatttagaataagcgttaaatgctattccttcatttttccatccaacttgaattaatgaatctctttcataagaactcattgtaaagtgatgtgatccaacttttgcatttggattataaagacgataaacagggactccagtattcgctttagcaactgggaatctaaatgatgttccatcattagtccacccaactgaaacaagagtcgtagcttcaaaatcacttgttgtataatggtgatcacctgcatttggattatataaacgttgcacaactggatatcctgagtatggaggttcagttaatgggatataaaatgcgactccttcagatttccatcccgctttttctaaaattagaacctcccaaccagcaggtgtaagtaaatgttcacctgaatttggattataaattctatataatttttcgtgaggtggctcagtatcttcagaaacttggtgtgcattaataacccctcccattataaatgccattgctgctaaagcaactaaaactatttttttcataatattctcctagatattctcctaaacacacatattcatataattcaggtaataccatatagatagtcttaaggtcaaaaatagagagatgtgttataatggagtaccttaaacataagtgccagcaaatgctggctttttttattttcttagttatttgaagtgctataattattgggttagtaaattaaaaaaatgaatcacatctcttgaatacgatttttaaaagtgctagactacagtagaaagcatattataatctttagaaagaggttgcttatgatttggtcattaattgttggtgcattaatcggattaatcgctggtgcgattacaaaaaaggggagttcaatgggatggatttctaatatcttagcggggttagttggatcttttgtaggtcaagccttacttggaacttggggaccttcgcttgctggcatggcattaataccatccattgttggtgcagtgattgtggttgctgttgtatctttcttcctatctaaaatgaattagtagatcttaggatctagaaaggaggagttttggcaactggaaagaaaataatactcattatccttgatctccttttacttacgcttgttctaccaatgacttgggattattacaatttcatggagtatgattggaggacaacgacctctagtaacattccgttcataggaaaatatatgacagactatttgttttgggggaacatcgttttaacagtcatattaattatcgccttgattgtagtccttttttatcctcgaacctatatggatgtacaactcacttcaaataatggagatttaattttgaagaagtcggccattgaaggatttgtaggtgaaaaagtaaaagaaaatgattaccttaaaaactcaaaaatcgctgtttcactttttaaaaataagataaaaattgatataaagggtgagattgttcctcgagttgaagtggcccaaaaagcccaagttctggaacaggaaatcattgaagggttaaaaagtttctttggattggaacatacggttaaacttaaagtaaaagtcaatacattaagtaaagatgataaccctaaacgccagcgtgttatgtaggagggatcaatggattatttcgaaaaaaatcgatacccaattatagggggaatcgtaggtgcactcattgctgtgtgtatcttcactattggattttggaaaatgattctggttttatttttaattggattaggaatttatattggtctattcttaaaaaaatcaggaatcattgatcaatttatagatcgtaaataacattataaaaggagaatattatggtacaagaaaacatgaaggcatttggaacaatggcagaaaaagaaactcctaaaacaaaggaaacccaaccagaaattaaggggactttgacttatgaagataaagttgtgcaaaagattgtaggactagcattagaatcagtggatggacttctttccgtagaaggtgggtttttctcaaacttaacaggaaaacttattaatactgatgatgttacaacaggtgttgacgtagaagttgggaaaacacaggttgcagtagacttgaaagtagttacagaatatcgtaagaatgtgcctgatatttatgaaaaaattaaagaagtcattcgtaaagaggttgcggcaatgacagaattggaagttgttgaagttaacgtaacagtcacagatattaaaacgaaagagcaacaaaaagaagatgatgtaagtattcaagatcgagtgaatagtgcggctcaaacaactgggaaattcacctctgaacaagttgataaagtaaaagacaaagtaaaagacaaagtagaagacaatacagataaagaagctagagttaaataaatttctagataaatcgtgagaaataaaagcctctattatgaggcttttttagtaagtgacttcaattatatagttttttatttagataaaagcaccgagtcaaataagtctaaggataacatcaatctcttgttttttcccgaaaaaagagtaatatagagatatgtttaattttttaagtaaaaaattattttaaggagataaatataaacatgcaaggagttcttatcgcgcttgttccaatgtttgcttggggttctatcggatttgtagctaataaatttggtggtgatgctaaacaacaaacacttggaatgactttgggcgcttttgtttttgcacttattgttttcttattccgcatgccaacgttgacatggcaaattttcttaattggatttattggtggattgctttgggtaattggacaatttggtcagtttaattcaatgaaatacatgggtgtttcagtagcaagtccgctttcatcagggagtcaattagtaattggtggcttgattggggtttttgctttccacgaatggacaaaacaaattcaatttattctcggatttattgcgatggctgttttggtagttgggttctatttctcagctaaacgtgacccagaaaatgcagttgttgaagaaggacgtaattatactaaaggattgactgctttaacttactcaactttaggatatgttatctatgttattctttttaataacttagcagtactttggttcaatgttcattttgatgcactgacaattatcttgccaatgtcagttggaatgatctttggagcacttgtgatgggtcgtttcaaaattaaaatggataaatatgtttatgaaaatatgattgatggagtaatgtttggtgtaggtaatatctttatgcttatggctgcaagcgctgctggtaacgtaattgccttttcattctcacaattaggtgttatcatttcaactattggaggaattctcttccttggtgaaaagaaaaccaaaaaagaattggtttatgttggaattgggattgttctgttcgtaacaggtgcaattttacttgcaattgtaaattctaaaggataataaaaaagctgtcagtaaattgacggctttttttgtgagttaattttctgacaagttttctgtcagtaaaattttatagtttttcattaacgaaatttacaaaatgattccaaaaaacctttggagcgctactacgggggacagttttcttagcaaccaatggaatttgttctgcggtacaatttggaagatagcttaaactatcctttactgtagtagaaagtgtgacaagtttttggtttttagtcacagttgcttcaactggggctgtttttttcttactgaatttgactgtcagtgattttttatctgcactaccatctgtagcataaggaacaacgggagtgatattttgtggagcaacgagttgaacagatttttcttttccatcagtcacagcaatttctttaaaatcatctaaggattggtttttttgcacaagacttgtcgtacgtcaatgcccataaacatagttcatcagttgatttgtgagggtgaaaggagtcgagttgtcagcagcaggatctgtagcttctaaaacaactgtaatgattctaaaaccattttgatttgttgttccagcaaaacagtcaatttgaaaacttgttgaacctgttttcaaaccatccacaatagttcttgaagtagaaaaaccactaagcatttgattggtattagttactctagcttaattttacaatcggcgttttgataagtaaatttactgatgaccactcaaagattaacggtaaaggtggttccttttccaaaaatagataccacatcaattgtgccatgaagttcttggacattcttttcaacaatggcgagtcctaatcctgttccgctgacctctgctcggctctcatcagcacgatagaagcgatcaaagattctttctttttcaatttcacttaaaccaggaccattgtcagtaacactgaagataattttatcttgttcatggtgtaagctgacaaaaatttgaccctgagcaggagtatatttgatggcattttcaatcagattttcaaaaatactgtgtaccatttgttcattggttttgaaagtaatctcttcaatttgtgtttctaaacgaagagatttttcagaaatttggggacttgagctttgtaaaatattttgaattagagcagaaaggctgagtttctttttctcaatacgttgattttgcttagttagtagtagagtatcctgaacaaggctcatcaaacgagaactttctttatggataattgaagcaaagtttttggtttcagaaggagaaacagtgtctgtttcaagtaattcggcaaagccctttattgaagtgagcggtgttttcaattcatgagaaacgttggcaataaaggcattatgagcatcaactgttcgacgataagaacttacatcattcatggttaccatgaagcgactatcaagatcgggcagtggagtgatgcggacttgataataagcgccaagcttttcaaagaagaaaagtttttcttgtatatctggatgtaaaattttgtcaactagaaaatttaagaaatcggcataaggactgaaaatatcaagattctcggtgtctgaaaactcatttttgaaagaagcatttgttcgacgaatttttcccttattattataaataaaaatgggaaattggaaaaactcgatgaattcgtagagattttctttcttttcagtgtgtgataaggcttgcttttggattttttcgcctaatttattgagctcagttgtaattttgtcatcattttcattcatcagataactttgcgttaaaggacttcgctcaatatttttaatcttagccacagtattttcgcgaaaaacataagctctctgagcagatttcaaaacctgtatggcaactgccaagtaaaataaaatagcaaaaatgataattgcaaaatcggtaaagaaagtagacgtgcgattttctgtaactttcaaatagccatcgatttgtccttcactaaagatagggctggtaacagtaatatctttagaatctaaacttcgagcataggcagcgccatttttaatttttttagtatctgaatttaccgtattttttgaaagatgttcaaagttagcgggtaagggattatcaggatgtttttctaaaaaaagctgtatttgatctattgtttttaataccctatttgtatcattttctaagatattttggttcgatagaatcaccaagcttaatgttgcaatgatgtacagcactgtcatcagcatgatgtgtttaagtttcattttcttcaaaatagtaaccgaatcctcgttttgttttgatataatgattatttagttttttacggatttttgagatgaggacatcaattgtccgtgtttctgctgtatccgaaattccccaaaaatgttgaagaagttcttcacggctgatgatttcgccttgtctttttgctaagagttctagaatttcaaattctcttttggttaagtctaaaacttttgcatcaaaagtgacttctttttttgtaaaatcaatgaccagtctgtcagtaacaagtgttgcaggactttcgtccaaagattcactgacagaatcagaagctgtttgattatacatttgatttctacgaatgagcccttcagctctgacaatgatttctttcattggagtcgttttatctaaatactcatcagaacctgctgacagacctgtcagtttcatttcatcatcatcgcgagcagttaaaattaaaattggtgtaaaattaccttctttacgaagctttttagtgacttcaattccggaaaattcaggcatcattaaatcaagaagaagcaaatcaaagggattttttcgagctttatcataagctttttttccgtctgatacgatggttacttcgtaatcattttgccgaaaattataagataatagggtcaaaattgcccgatcatcatcagcaattaaaatttttttcatacttttaattataacgaaaacagggagctttgtatagaataaattattatttttgaataaaaaaatgaaggggtaatggcagcagaaacgagttaaaaaaattacatttttaaaaacttaaatgataagttaaaactaagaataaaactaaaaaatcacttaatttctgctataatagacattatggaaatcgaaaaaaccaatcgaatgaatacgctttttgagttttatgcgacacttttaactgacaagcaaatgaactacattgaactttattatgctgacgattacagtttggctgaaatagcagaagaatttaatatcagccgtcaagcagtttatgataatattaaacggaccgaaaaagtgctcgaaagctacgaagaaaaattgcatctttttagtaattatgtggtgcgtaatcaattgcttgaagaactgatgaaaaagtatccttctgaccaatacttaatcagtaaacttcaggaaatacagcagattgatgaagaagaattttagtagttagagataatgaatttactgacagaaatgctaaaatatgctataattaaacttcaaggttcataaaagttactgacagactgccagtaagaattccctgaatttgggggcgttacggattcgacaggcattgtcgcgcatgaactgcaactgctgagggatcaggataatcatccgcagataaatataactgctaaaaataatacacaaacttacgcaatggcagcctaaacagcaccatgcgtgcctgatttttgctcactgatggcaatttgacggcctaaacttttagtcagatacgttgttgtggagacttgacgcagcaaaagagatttaaagtcccgcaaaatgtcgctgtttgagactggctttggcattttgttaaatttgagaaagtcctatggttgtagacgttgatgtagcaaggtgtttggacaggggttcgactcccctcgcctccattatccagtttatatagaatcttatagactaagaaatcgctcaatggagcggtttttctttttgaattctttatactgtatttgagattaagttcgtccctagccaccaaatttgtaaatttattactttagacgtttattatgtacaagttttatctatgtgtgcacttgtagagctacacaatcgatttatttttgtaatatttaatataaaatgatagactcgaagcgttgaattatcaagaggcccacaatatatttgatagcttattgtttattatatatgaattaataagatgaaaattacatttgatgaaaaaacagctgataaaattaaagcatttggtgatgttgatttagtttttgattttgaccatactttgagtgaagtcaatactgaagttgacgcttgtgcaggtggaatttctcgctatcgtattgttgccgtggaaaaaggaaacgttcctgaagtctttgatgcaagtattgattctgaatttggaccaatttattataaaggctatggttcttacttcttccaagatgaaatgtataccaaaatcaatccttcatataatttgattgaattgcatagtacagctgaattgctcagccctaaccttttaatcgttgacttccgtggtaaacaaaaagctagctaattagttccaaccaaaaaagaccctccaagagggtcttttttatatgtcataaaatggattcgtcttttcttggctttcataaatcttgacacccaaatcaaaagaacgaagcttgtcagcaactaatccaataaaagcatgctcaatatagtgaccagggtctattcctaataaaccagctgaaagcatatcatgaccaacatgataataaatatctcccgttatgtaaatatctgcctttttttccaaagctttaggccataattttccacctgaaccaccacaaattgcaattctttcaattttttgagtcaaattatggtcataagtgataagacgtaatctatctaagccaagatattctatcgggtatcaagtcatggctaaataatcaactagcaattcgggtatcatactatttgtaacacataccatatctattaagccgtcatataaagaataaataattaaagtagcaaggaaaaatacatttgattgttctaatcaacaaattttttttaatctcttttttgagttgcaataatgatattagttttgcgggttctgttgcgaagtttaaaaatcaaactcgccctctctgaactccaaatatcttaggctgttattcccattaatactagctaagtttttgagtaattgtggataaaaaataaaaaagtgtcataataagcatacaagtaacaacgctactaattaaattttttattgtgataactttagagtttacttttttttctatatttattggaactaaatagttagcaatatagaaagaggtaactatcatgatatagtacagacaatatataaaaggttttctggaataaaaacctagatagataactaaagggataaaagaaatagaaagaaaaatagtgcatttcaaagtgtataatcttaatttcttaatagttcttccgctataaaaaaagcttatcttattctcttgattctttaaatacccaaaatatgcaatatacaaagaaactaacatggttgaaacaaatacaattgggttatcataattattatctatcacaaaggtaaatattgaaaaaaagtaaagtattaataagtcatatataattttggttctaaatataaataatgagtatctacttttcaagtcctataccttcgtttctaactttaagagaataaaatttccagtaagcagtatcaaaaaaataaagatgattatatataaatttccactttttaatattaaattaagttcaaaaggtagtatactacgtatgtttaaagcaagtataactccatataaaatacgcattgcaaaatacactgaatctttaatgtttttagaaaaaaatatagtaaacagagagttaattagcatcagtaaaagtagtatagatactaaatttatgaagaatttagtattgtctatactccacttcaatggcattaaaccatatatgattaacatcaaagataaaataatttttttgtagacaaagtattttttaatattataaatttttatgcttgggaaaaaagctcttataatactcatttttttaaataatttttttgtagaaggtgcaatatcacataaaccaactattagtaaaaatagagataccatgaggcttagttcaggataatgactatttgaaaaaagaagtagtttaattcctaagaatatggctaatagtactatagataggctagatatattaaaaaaaccatatataccaaatcgttgtcttattaactgtaattcaatcaagaaagtttcaatcaaataattcacgctccaatactgttatatcatgattattactaaaagttttaatcacttctccattttttaaatagacaaaattatcacaaatatcatttagagtatctaatatatgagaagatattaaaattgttgttcttttttttaattcaataagcattttttttaattgataaatatatttaacatcaacactgttgaaaggttcatccaatattacaagactgtagtcatataaaaatacattaattaaagttaacttctttttcattccctgagagagagaatttaccattgtatcttttttatcttctaattctaaatcttgtaatatctcactattactttttttagatttagagtattttctaataatgtcaacaaactccatgacagacatataatcaaaaggttctatattggaaggaacataaagaatattatctgaatctgattcttcacaattaaacagttcattagcattttggagtccagataaaatgttcatgagtgtagttttaccagctccattctctccaattaatccaataattctattattctctaagttaatatcttttatattcaatctgaattctgggtaattgtgaataatattttttatatacataatacactctcctaggttaaaatataatctctgaccaaccgtaaatttaagcaggtattaatgggaataacagcctaagatatttggagttcagagagaacgcgtttgattttcaaacttcgcaacagaaccttgatattaatattcttgccattttttataaattcattttagcttaaatttgaaaaaaaagatagttagaactggactaaattcaaataaatggatacaaaatggaatacatcttcttaggtcaatgttcttttatatttgagtgtccataaaatggtcattttctggacactttatattttctacaattttcatctatttcttttatatttagtgttcattaactcataaattaatctatgttcaattatatatgttattttaagttatgatacaattaaagaacggaggtgctgaaatttgaatatcggatatgcacgagtttcaactggacttcaaaatttgcagaagaaatgaagatttgtttctttaactcaggttttaaatttaagaattttaaagtattagataatagaaatgcaaaagaaaaaagtgagttaataagcgaagcagaagttgtcatacttgcaggaggacatgttccaacacaaaatatattttttcaacaaattaatttaaagaataagttaaaaacttcaaataagattatcggttttagtgcaggttcaatgaattgctcggaagaagtttatgctcaaccagaactacaaggagaatctttagacccaaactacaagagatttttaaataaattacatattgaaagacagaaataaaagaaccaacttaatcaaacgtaatgactgcttactattcttctatgaataatccgggaaaacaaacgaagaaaagggtttctaaaaatacacaaacattttctttttcatttaagtttcatttcagcattataacgtataatagtttccatactcctaaataaacttttttcataaatactcctaaaacttccgtttactccgcggaagtttttttagcctttgatttactaaagtggtataattatttttaaaattagagaaacaaacaaaggaagaattgaaaggatagtaaagagatgacacaaaaaactgttgcaattactggtgcttcaaacggaatgggctttgaagctactaaactttttgccaaacgtggttggaaagtttatgcaggggcgcgtagagttgacaaaattccccaagatggtgaaaaaattagagcgattaaacttgacgttacagactctgactccaataaagcctttgttaaacaaattttagatgaagcaggccatattgatgtgctcatcaataatgctggttatggagaatatgggccagccgaagaaatcccaatggataagattcgtaagcagtttgaaactaacttttttggagctgttgaattaactcaactcatcttaccaacgatgagagcccaaaattatggacgcattgttaatatttcatctattggtggcgatgtctatatgccacttggtgcctactatcatgctacaaaagcagcccttcaacaatggtcagatgttttggacctcgaagttgctcaatttggtattcgttccgtttgtgtacaaccgggaggaactcaatcaagctggggaaatatcgcactagaaaattccaaaaagaacatgagtgaaaattcggcttatcaacctcttgtgaattccgttgcttctggacttgaccgttttatgaaaaatagtgccaaggcttctgacttagccgaagttttttataaagcagcaacggagctcaaaccaagtcttcgatatcttcacgcctttggtgataaattcatggtgaatgtggctcgtagacatcccaaaattttccgaaaagccctacttataactatgcgctattttgaaaaacataatcattaataaaaaaacagctcttggagctgtttttttattatctctttaatttccaagcttttttctacttttaaaagttctatcagtactatttaaaaattctataaccagaattttctgaatctcttataatgataataagttttatagcacaaaggagaaagctatggtacaagaattgctgacgaataatcaacgaatgtgatcaataagtattttaaattctaatcttaaacttttcaaataggagaaaaaaatatgactgatcataattataaatttgatacattgcaagttcatgcgggacaagagcctgatccagttacaggagcacgcgctgttccactttaccaaaccacttcttttgtctttaacaattcagatcatgctgaggcacgatttgctctacaagacccaggggccatatactcacgtttgggtaatccaactaatgatgtttttgaagcacgcatcgcagctcttgagggtgggagtgcagcccttggtgttggttctggctcagcagccatcacttatgctatcttaaatatcgcaactgtcggagacaatatcgtttctgcaagtacactctatggtggaacttaccatctcttttctgggactttaccaaaatacggaattacaactaaatttgttaatccagatgacccgaagaattttgaagaggcgattgatgaaaagaccaaagctatttattatgaaacgctaggtaaccctggaaataacgtcattgattatgatgctgttggtgcaatcgctaaaaaacatggcattcctgtcattgttgatgccacatttactactcctgtaacctttaaaccttttgaacacggtgctaatgtaattgttcactctgcaacaaaatttattggtggtcacggaacttctattggcggggtaattgttgatggtggaaactttgattgggccaatgggaaatttcctgattttacacaagccgatgaaagctacaatggcattaaattcgccgaattgggtgaaattgcttttgtaacaagaatccgagctattttactaagagatacgggggcagccctttcaccttttcattcttggcttttcttgcaaggactcgaaacactttcacttcgtgttgaacgtcatattgccaatactaaaaagattgtagatttcttagacaaacacccaaaagttgaacttgtaaatcaccctctacttgaatctaatgcttaccatgcgctttatcaaaaatattatccgaaagatgctggctctatctttacctttgaactcaaggataaagatgagaaaaaagcgagagacctgattgaccatctcgaaattttctcccttttggccaatgttggagatacaaaatcacttgctattcatcctgcttcaaccactcaccaacaactcaatgatgaagaacttgctagtgcaggaatttctaaaggaacaattcgtttgtcagtcggcattgaagatgtgactgatttgatagcggatttagaacaagcattggaaaaaatataaaaaaatgagcggtaaccagccgctcatcttttatttaggagtaaacttttatgaaaaattttattggaataagtatattatattgaaactcacttaatttttactaaaattgggataaactgaaacttgattttgtatattcgatattttacagactaatattagaattcggtgcttcttgatgtttatatcatttgttctagtcatcatataatcaaaacaaatgtttactgataataagaattagaggttgatgatgactgataataaacaaaaaaacataattaaactttggcagatttgtctggtcttccttttttggattggagcaatgtttttacctgctacaatcaatcaaataaaattcggtactaattttgatttagcaaaaagtcgcgaaaattattttttctatctttgggtgcaaaaaccagtgacgagtaccctcctaattttattacttctttggataatcttgtcttgtttacgaaaatggaaaattactccctttctctcttttagctttatgcttctttatatttatgacttgtttttagaattcgttctaggaagaatatttgttggtgtttccttaaaattggccctatcgccagaaacttttataggactttggcgtacgctaggtttaggattctttttgacaagtcttttaggaagttgcttttcaatcctactctttgtttatcttatgaatctttcaagtctacaaaaaagttgaaatagaataaaaaaatgagcggtaaccagccgctcattttttgtttaggagtaaacttttatgaaaaattttattggaataaatatagtattatattatttattattaaattcatctcttagttctctggttttttcttcgatatcctttttagttttttcaagtcctatacttgtatattttaatgtttgttcccagtcgtttatattagtgggctcccaagcgtaattaatgtttgtgagcattagtaaaataaaatgtgtaaatttcaatgaaaaattaataaagtgttcaaaatcatcaaatgttaaagggttatctgctgttagtttatctaagttattcattgctaatttatcattatgaacatatattttatttcgttgcgcataaagatattctaatttcttgagagatttaaatcgatttaatttccactcatttaattttaatactaataaaggggaaacttctacataatcgtctttactgcaattagagtagttatttttttcaaaaaattctatctcatcttccgaaattttccatttccatagtaacttttcttcactaattttatcccatttatatatatcttgaaaagcagggaaattagtataatttttctcatattttagtaataatttttcaatagtaacagaagaggcacctgttgtgttgtcaaatattttttgaactgaaataaatatagctataacgagagaatctagcaaattgttatagaaaaaaggagatatggaaatagcatactcatattttgagtagagcgaattatattgttttagtaaaattaatttattataagcatctcttgattgtccaaacaaagtatttgaccatttaaataaagacacttcagggatagagctattaaggacttcaagtataactaacaattgtcttcggtcaagttttgtaagttgttcccgtgttattggaaaagtcagtttgattgaaacttttgaatttacttcaggaagaatttcatttactatatcaacttcatccttttttttaaagtattttaaaattgtgtcttcaaacttaatttgtaatggatttttttcttgtattgatgaatatatttttataggttgcatattattctcctatattttatagcttttgcacaaaaattattttattttttttttgaaatattataaaaccattatatcactaaaaaatataattattttcaaagtatgtagtacctcctcctcccaaaaatgttaaacaaaaaggagcaacaaaccgtctacggcctgtcgctcctttttgtttaattttcagttgtgatagtacttgagggatttgtatcaatgtgttttttttatgacaacataatcgatttttactattgtttagctgcttcttttttagagtttttactgaaagacttaagatttgtatctaaaatcttagttattaaacttgtacctttggcaattttattggttccgcctaattctttgtataattcatgaacttttttagcaataaatatgacttcttcagtttctatgtcagtattaatattattagctaaatcatcagttgtaattgtataattagaattttttagagcaacataaacaaatataacgtaaaataaaatgtctgtttgtattgcgattggataaatattttcctttgaaagaatttgtttaatagtcataccaatgtaagctgcatgataatatgtttctaattcaacatcatcgttgtaaacctttttatatgttttgtcatcgtttagtaatgtagatggcctagctctagcatagtctggttttttaaggattatggagaacagacattgggcaagaaaagataatgtaactatttcatgagatttttttccttcatttttataataattttttcgtctatcgtaaaataaatttctagattttaaataatgttcaatttccctatgtatactatcagtgcctctcaaggacgatttaggaattgatgtttgattgtttgtggcaagaattattttatctcttactacttcgtttctaggcaccattattttaaccataacttttctatcatctttaattttaataggatcatctaaattattaaaatagttaaatatttctctagaagtttgtaagccattaacaatagcaggatcctttaaaactaatgatcttgaagtagcctgatcaatctcagtagctagtatagttattccattattgacccaccaaaactcattatcatttgtagataaagtatcttgaatatccttattgacagcaacattaccttgataatcacgaacatttgactcaaatatatgtttaatcaatttcttacttttaggatgtgagataaaagtaaaataatcttttaaagaaaccagtccaatatattctttttcagataatatagtaataggatcattagcaaacagtaaattaaaaggtactttaagaggttcgtcgtaaatattcataagttctaaagcacctgtgtaggtaactgaaattgttgttttagaactggggtataattgtttaatctctgctattaattcctcaccttgagattcaacgttagggtgtatgtcgtcacctttggatatatatgcaaattcaatagttagatttggtgattttgaaactagttttttatataattttttaaaattttgagtttttgatattagcaagttagaatatctcttactgtacctattattaacagatatatctaataaatttttagacatggttttccatttatttagaacattttcattaaaactaaaagaattttttgattgtataatgattagtttcatatcaagtggaatggaaatttttttcttattatgttccttaattatagactcaactaaaagatcatcatctaagttaataatctcttcatttataaataagaagatagaatcacaaccaccatctaaagaactaccaacaatacctttttcaatatcttcatcgcttaaatcatattgttttagatacaaaatagcagaaaaaaattcgaaaaaatcatcttctttgttgatattagggaagtcttcaaaattttgatttatgatttctgtaataagtatttgagaattagttctttttttagacattaaaatccaccttctagtttatgtatatataatatcataatcaaagttttttaacaggttcttttatgattatttcattttataaatgcttggataattggactaccaccaaataattagacacaaaatgaactatattttggaaaatactttattagttcttactaaactaaacatttctctcaaaaaaaatattgaattattttttattgaaaagagtaaagagcaataagtttcggaaaaattagtcttttcaagaaacttatattttgatcttattctttaataaataaaatgctctaataatcaaaatcaacaaaatacatatacttgtcggaataagaaatctgaagcttgtgaagggagcaattcctaagaattttgtcacgggttcaatgaagtaagtaccataaaacagtgccgtcattccagtaataactattgctctgaatcgacttaagggtctacataagagataaagagagaagagttgaacacttccgataattaaagtcacatcactgataaactctttgtaatgagttacgacgtgtccatttgtgaagcttgtgtagattggaaatttataggctaaggctagcatagcaaagatagctactccaataattatcccagtcggcaacgcattatttctaattttttgaagaatatcttcttcgtttcgcttctcatctttctctagtacaagtagggcactaggaattccaacagtgaaaatccccatcatcatcaaatttattgactctaaaggaaataaatgatgtgtaatcaatagaagaacggtcagagtaaaagtatagattactcgtaaaagattcatacttgccactcgagtaatattattgattacctttcttccttcttttaaaatgtcaggcaagacagagaaatcattttttaaaagaataaattgagccactgattttgttgcttcatttccacttcctaaagcaatcggacaatctgattttttaagagctaaaatatcattgattccatctccaatcatcccaactgtatgtccattacttttaagtgaagcgataatatctctttttctttctggtgttatccgaccaaagattgttttttcctcaacaatttttttaaattctttttcatcatcaggaagttctgataagccaacataatcagcttctaaacctacttcttttgcaatgagtgaaacagttttagggtggtctcctaaaataatttttattttagtcccttgtttttcaaaatattctagaattcgttttgcttcttttttaggcctatcttttaacaaaatcaagcaaaccagactatctttctcgcttggtttactctgtgataaagcaagtatccggtatccttcatctagtgctttttcaatatcagcattttgtttagttgtaagttcttttgctactaaatcaaaggcaccaagattataagtacttcctccttttaattcaatcgattgatacttagtttctgagctgaaaggatgataagtttctaattcaaagttacttttttgactcgtgtcaaagtattttttgagcgcctccattgatgcattctgttcttcatccaaggcaatgataaatgacatgattttatcaacttctggtttttcttctgcataatagaggacttgttcaacattcatctgcccttcggtaatggtccctgttttatctaaacaaagaacatcaactcttgctaatgtttcaattgctgataactcttgggtcaaaacattcattcttgagagcttgatgacacccaaagctaatgcaactgaagttaaaagaactaacccctcaggtatcaaactagtaattgttgctgctgtaccaatgattgctgtctttctttgtggaatcacagacaaatctaaagatgaaaatacaaattggttcaaaagcactaagatagaaattggaataataccaataacgattatttttaggattttatcaatttgttgttgaatttttgactttgctttctttaaaacagaagcttctttggccaatttactaatgaaagtatggttcccaacagcctgaacttgtgcttttgctgttccttgcataaccaaacttccagagtagataaagtcaccagtctgcttttcaataaaatcagactctccggtaatcatggattcatctacatccattccattttctaaacttatcgcatcaactggaatctggtctccctttttcaaacaaattatatcatttaaaacgagttcctctttatgaatgcttgctttttcaccttctctaattacttctactttttcttgtttgagaaaagaaagcttttcaataattcgcttggccttgatttcttgatatattccgatagaggtatttgagataattgaaaaaataaataacatatttttataagaaccaataacaaatagcacaactgccaagatgaggttgagtaagttaaagatggtcattgaattttttataataatatctttatttgaattaccgactttgattgtcgttacatttacgtttccaagttttttctgttcttctacttcggtatttgttagtcctttggtcatatttactttatccattatccctttttcctcctagactaatatatataatacaacatttcactatctatacttctatcatacctaaaatatttatgattattcttacatttttgaaagtattaaggatttactatcttttttaaatggttaaaattttataaatctacaaagtttaagctttatttcaaaaattctcaatttttctattaatgatttatagcataattggtcaggcagagtcaacagctttcattttttataattctataaaataaaaaaagccttcaaaggctgctgtctatcatttggattattttattttcatgagaaagactactcatttgtgagtagtctttcttatctatctagttattaattctttattcaaatacaatttatattatttatatttttctagagaaaatgttactccaaatctaatttgatgctgtattttaacggattatttcgacttcacgttgagatgctccattaaccagtcttactttattttctccaaaaagtttgattaatttatcaaaatctgcactctttgcaaatttttcattattttttcgattctttttagcatttttggtggattttaacgaaatataaatttctcttcctttttcattatttggaataaaattagtttgttctaatataatattctcaatttccttttttgactttgccattgaaacagcactccttcataaaataattacattaaatatcatatcataatagccttgattttttaaatatttttttttaccgatactgtcaataattatgtgtaaacactcaagtagagttgaagaatattaatcaaattctattgattaataaggcatatcttgtaactcagacgtaaagttttccttaatcgtttcaatttttcctaatgagaagcttcttgtttcataggctttcggaacaatgacataaccattccattgtccattatgttttgcccaaacttctacatctaaccgtaacttacgaaattggaaattagaccaaatcccacggtcatcttgcaaccatctagattgtaaaacatctttgttcacgcttatcaatacagtgcccaccttcgtttgatccaagttagcatcaagcactaacacatcaagtacaaaatatgttgttgcaaatgtattcttctcaggaatcagttttaaaaagggaagtcccgcgttttcacgaccattagcatcactcgtgaaaattaacttgaattcctttgaaggactacttgcttccaataaaagctctgtataatagcttgtattttgagcatattgccaaaatatttctgccatatcgctttccttatagtaccaaggcttataagaacctgcataatgaacaatattaggcgtttttcgtgatttattgtagctatcactgatttgatagggcaatcgctcttgaataatctgaccacgtactgaattttttttccatcaaagtgataacattccaagactctggaagatagaaaactttatttttaaagcataggtttaaaatatcttgatccatatatatccagttacgcttttgcacaaggttaatgaatttctctgttgtaaaatctttacgaattgcttgtaagtttagcacaagtacacccgcttgaaaataatcttcaaagctctttaaattaaggtaattcaaaatttcttttttataaacttcttgtcgctcaggggtataattactagcaataaagtcaaaatctcgtaccgctcccacataattatcttcaatgtctatttcaaaaagtttcgcaatatcctcttcaacaacagtatcgcaatcaatataaactaccttatcatggacaaataattctggtattaggaaacgataataagtctcaacagaaatatgagcattagtttttaattccccatattgagaaattttagccgatacatctacaaacctaacagaaaaattatctttattaaaatgtttcaaggttctattttgtgtttcaactgagatgtcattatgtagaatcgaaatatcataattgtttttagaattcgcattttctaaaatcgattgaagaaggacactagtatacttcatgtagccattattacatgccataacaactgggatattgtttatgctatactttggctcaattttttgtggaagtggtcttgtatcgctccactgaacaactggtaatcttaagattgtaatttcttttctactgatttccaaatgtttggcaaatatcgcgaccaaacgctcacctatatgtcctaatgtacggtaaagttccacagaatatttttcatgatcaacttgtttttcaatttcttctaaaacaccaaaacaaaattcattgtattcttgaaacagttctcgtttcataataaacatattataaaagggtgctgtatcagaatacaatacttcaaataacgctctcgtgtattcaggatatttttccgaaatcaccgaaattaaagtatcaatatcacttttttcaagatgttgattccaatgctcataaagactaatattttttaaatttcctgttttctctaaattaacagtatcaattactcgccaactatcaggcatgattaaatcagctccatcgataacttcggccatatcgctttcagtaatcgcaaattctttgagctgtttttctgtgattttctcacgaggaatcacaccccaaattgttgaatctttagctttacctgtatcaaaagacatatatcttctataatgccaaaatcctaaataatctgaatctttatcattcttccacgcccagtattgagctgttaattcacagtaacgtttattctttgaagaaatattttcacctacattatcctgcaaaatatttggaatctccccagtggccagagcacttcctacttgaattggtactaagaatttattttttggaatatatgagggcttgtgcattgagacataaatttttgcttttaaatcttttggatttttaccatccaaatctacaaaatttgctttgactttttcaaactctctttcgagttcaactcccaggccaatcaaaggattatttaaaattattttagctttttctataacttctgaatttccaaaatgattattcaatttccacaaaaaattactaataatattatccttaaaatttacaaaactttcactaaagtctggaacttgggtcataatattttcaatagttataaattgaaattccagattgttaagctcttcttctaaattcactgaactcaattgttcttcttctgcctctgttacaagataagccatttcattgctatcactaactgccccatcagataacactgtatagagggctgtaaccaaacaaagattatcataagattggctattcctcaaaaaatcgttggagtaattttgttctagtgttcccaaataggaaacagctttatcaaaaatcttcttgcttataattttattcccaagtaaatagtcttctatagaagcacctgcagatttaataaattctgctaaacttttcggtaaactgtgaacttcctttgaaacttttgcaaattctccatcaaaataagcaagttttaatgaaatcaaatctccttctaagtttgatgccagtttttttgaatacatcatgtcactttcaggaaaaagaaggtactcattagttgatttgctagcaccaaatttttgaacatctacattatttctgtactttttagagtcaaaatcaacaatttgtattgaaaggtattttttgtattttttgatgataaagtcaagcatcgttttcaatgtatcttcttcttccttaggaagcatgataattatacttatattattttgacatagactcttgatctgatcttctattgtcatcaaattggtttctgtaataattgctgtcagtttattcatttgttctccttttatattcatttgttattaataaattttatcaaagtctccgtacagcctcttccacgattaagggcatggagaccattcgaggaatatataaaaagaaccgaagaaatggaacgctcttcggcttttcggtgtctactgaaatcaagggattaatgggaataccagcctaagatatttggagttcagagagagcgcgtttgattttcaaacttcgcaacagaacccttaataatagcttattcttactaaaaatatatcaaatttaaaatggcaactgaaatgcttaaataagttgcaaaaacaatccaaataaaataaggaattaagaaaaaagaggataacctattaatttttgaaaatttgatgatacagaggtaaacaatgaaatttagtaggagaataataatgactcccaaccaaaaatatcctttgaaaaaaataatactccagatgaagtttaaaataagttgtattccaaaataaaacaaagcaatttggctatcactcttttgatttttaagattataaaaaatcaaataagcggcaatagctattaaagcatagagtatcggccaaacaattccaaataaataatcttgcggagccagcggcggaagtatgagattattataaatttccttgatatttccagcaaagaaaccagataggccaccaataatttcgattcccacaataaataatagaagatatgtcaatgattttattttactagtcatacgttccctccctaaaactatgtaagcgtttttttgattaccatacctatattattacataaatagtttgttaagctagcatattcgcttgataactatataacttaatttaaatagcaacaatctttttatcaagaaaattcaagcaatactttgatttcatttatctactgatatccgtgcctaaatcaattcgtaatcaaaaataaggctcccttatactcaaaataacacaactaacataatttatgttatgtaaaatatattgtaaagacgatattagctaataaaaaacataagaaaaaaactagcaaattgctagtttttttcaggagcgatttgttcaaaatctactgttccttttcgtttattggcagcaataacacgaatttttatttcttttccaacttgataaattgtttccgattttttccctttaataatactcacttcttcgtcaaattcaagttcttctgttgtcccagtatgtaaatttggtactcgaactaaaccttcaacggtattatctagtgctacaaaaataccaaacttttgtactcctgtgatcgtaccagtataaacctcaccgatacgttctaacatgtattctgctttcttcatcgcatcaataatccgttcagtgacaacagcacggtgttccatatcggaagagtgactagcaatttcaggcaaacgttctttccattcatccttagtacggttggaatggtcagaaggatataaatgtaataaacgatgaataattaggtcaggataacgtctaattggacttgtgaaatgtgtgtagttagtcgctgcaagtccaaaatgttttgtatttttttcagaataaaccgctgttgacatagtatgacgaagttgataagttaaggctttttcaaaacttgtacctttaatctcatcagcaaagaaatttatggcttgatgagagtcagagctcaaagaaaatccagcttctgcagcagcttccatcaatttagcaaatgctttttccttaggagtttcatggacacgatacaatgaaggtaattttttcttttggaaatcaagagcaacagtttcatttgccataagcatgaaggattcaatcatgcgttctgcagtatcacggtcacgttttacgatttcaattgggtgaccctcatcatctaaaattatttttgcttcactctcatcaaactcaatcatccctctatcttttcgcattgtttcgagaatttcatgaagttcaacggctacttctatcgaatcagcaattttagaaaatttttctaatgcttcgcggtgtccttcttgcccctgatgaatcatcttgttcacattgctataagtcatgcggtaagttgtttttatgactgatggagatatcttataagtgacaatcttgcccttatcatcaatttccattaggcaagacattgttagccgttcttgagcttcattaagtgagcacaggttattagacaatctgacaggtaacattggaactactctatcagtcacataaaccgaggttgctcgcgcataagcttcttcattcaaagaagaaccttcggtcacataatgactgacatcagcaatgtggacccctaattcaaaatgtccattcgataatttcttaacatgaatcgcatcatctaaatctttagaatcctttccatcaatggtataagtgatttcattacgatagtcttcacgtccttgcaagtcttcttgggttaattcttcagaaaatgactcagcctcagctaatgtttcagctgagaattcttgtggaattttcatagcatacaaaacttctaagatatcaaggccaacttcacctttatgaccaatgatttgcgtaatttttccttcaaatgctttagtatctgttggatattgagtaactttaatacttactacatcttcttcttgtactcctgttaagggctgttttatgtaaagagtatctgaaatacggtcattaaagagttcgattcgacctttatatcccaaagctttggcttggcgattagataaagaacggtaagttccaactgtatcaacgactgctcgttcattgattttaataatttgtccgcttgcgccccgtctttctgtcttagggtataaaaccttaacagtaaccttatctccatccattgcaaatttagtttcgttttgaccgatgtagatatcattagttttgtctgtctcactctctggatgtacaaaaccaaagcctttaggatgtttagaaaatactcctttactttctgtttgtttaagtgctgatgctaattctgatagctgaaccatatatgtttatttcttcctccagttgtttcattctatcataacataatcagtaagtaatattcgactatattgaagagcaacgtcacaataattacggtaaatcatggacagtaaaagttgcagatacaagtaaaatcgaaaaaggaaagctaacagctttcaataaaaatcaagaagattttccagaagaaatgagtaagagaacggtcatcaaggcattgctcaaacctattattaaatcttatgcagagccaaccagtgctgcagtattggataacaacgaagaaggaacagtgattaaggaagcagaagttcttgatgatgattttgttcttgaagaggcggaaacgaagcaagtagaaactccaaaagaagaagttcaagcttcagagcaaactgaaccatcagaaaataacgaagaatcaattgccgaagaattaccattgctttaaaacctatgagcaaactgcagtcctcataaaacctatgcagtagaattagaaataattcaactttaagcaagactaccttgggcggtggtttcgtatttagtcaaagctggagggtggcgtaacgaccgtaaagtccatgagtattcagtgcctgcacataaccgctcatcgccagcttttaatttgaaaaataaaacttgaaatagatatagaagaaaggagtcttcgtggcacaaaaaaataaaacaaaaatctatttttggataaaactagatgaaaatttctttaaaaatctagccattaaaaatttgagaaaaacagtaactggtggagatactttagtgataatttaccagcaaatgttgttatcttctttacctaataatggagttatctattatgagggtactttacaagatatcgctcaagaaattgcattaaatcttgatgaaaaacttgatgatgtcagattggctatagattatttccaaaaagcaggtttattgcaaataggagatgatggaagtgcagaaatgcttcaagttccaatgcttataggacaagaaacaaattggaataaatataaaagagataaaaagttggaaaatttccaaccaacttccaaccaacttccaactagttccaaccaagctccaacagagatagagaaagaaatagaattagaaatagaattagaaaaagaaatagaaaaagagaaaaaaacagaaacagaagaattattctcgaactatttttctattttcactaatttatcaaaaaagaatctttcaagaagagcaatggcattgcaagtatttattacactatcttatgaacaaaaggaacgttctgttatcggagcaaacaactatgtagaatattataaatctaaaaatcctggagataatgaagcaaagtttagtattaatgcttatgaatttcttagcaatatgatgtttgaagaatatcagcaaaaagtaaaagttaaaaaagaaactctcgggggtcttatctaatggcttttgatacatggagagatgacggagagtttgctattaaagcaactgatgttttaaaaaactatcaagaaggtggggaacttggcgtgtgtgaagttcacggctgtgagattatcggatctaagaaacctgtgctttcttatcctaagaatgaaaaaggtgaagtgattggagaaccttacttatacgatgtaagagtttgtcagatgtgccatgctgaaggaataaagacagttgctactaaagctgtcaatgacttcttaggagaattcaaagctaaaaaaggtattgatttgactgaaaatgtcattgttaaatatgatttcgctgatgaattaagtgttgtatcttgtgacaacatggtcaagtggattgttaccaatgttggcagacagaaaaaagtaaaacgattaaaggttagaaagtacatacagatttctgaaaatagattttctagtgatgaagcaagagaaaaatatttgaagatattacatgatattgaagaagcagaaattctaattttcgattcattggcagatttcacagcaaatcaagctgaaaaagcattgacccctttattaagcgcaagtgataactgctcaattatcatattaacaattccagaaagtgatgaaaggcttgaacaattgccagcaagattgaaatttaaactcaataatgcgcaagtaatgaatttctcaagtacaggacaacaaagatgaagtttgaagtttacaatgaccatttccaaaattataaacgatatcaaatacctaaagcacagcttgtaatagctgacattccttataacttagggaaaaacgcttatgcaagctcaaatgcttggtatattgacggtgataataaaaatggcgaaagcgaaaaagcaaatacagaattttttgacactgataaagattttagaatcgcagaatttatgcacttttgcaatcggatgttaatcaaggagccaaaagaaaaaggaaaagcgcccgcaatgattgtattctgtgcctttcaacaaatacaaatggtaatggattacggtgagaaatacggcttcaaacacgcttatccgctagtttttataaaagactatagcgctcaagttctcaaagcaaatatgaaaattgtaggagctactgaatatgctgtggttttataccgtgataaattaccaaaattcaacaataatggtgaaatgattttcaactggatgccttgggggagagataacaagacaatccccaaaattcaccctacgcaaaagccacagtctgttttgaaaagattaattgaaatctttactgacaagggagatacaattattgacccttgcatggggagcggttcaacaattagggcatcgattgaacttggaagaaatgcttatggctttgagattaagaaagatttttataatttagcaaaagaaaaaatgctcaaagaatatgaggtatcgctctttgaaatttgaatttgaattggataaaatgccaactactcagcaacaaaaaggcattaaaaaagtgaatggtaaacttcaattatatgaccgtcgtggaacaaacaactacagtcttaaagctcaactcatgaaaaataaaccgaaagagtgctttgaaaaaaacgttcctttgaagctatccgttacttttttctacgctatcaagcaaaaaaagcgtattttctattttttccttcttttatttcattttttaaaaaacatctgataattttatgaaaaatatcttatttgaaccttttaaaatggcaaaaaaataaagtactacaaatggcagtactttattctcattaattataaaaattattttactttagctgttgttgcaataacttctactgcttttttcatagcaatgtcgtgtttaagcatgtcaactggaagaagtttttcaacttgttcaacaggcatgttatattgaccagcaagatcttcaatttcagcttttacttcttcatctgaagttgtaaagctttcagcagctgcaattgcttcgattactaagttagtacgaacgcgtttgtcagcatctgcttcatattgtttatggagatcatcctcagaagtacctgtaatttggaagtacatttctggagagattccttgttgttgcattcctccaaggaattcattcatcgcacgatgaacttcttcatgaatcatttcttctggaatttctttaatttcagcgttagcaacagcggcttcgattgcggcagtttctactgcatcatcgtaagcttctgattttgattcttcaagttctttacggaatttagctttaagttcttctaaagtttcaacttcttcgtcgatgtcttttgcaagttcatcatcaagttctggcaattcttttgcttttacttcattgacagttgttacaaaaagtgcttcttttcctgcaaggtcttcagcttgataattttctgggaaggttactttaacttctacagtttcaccagattttgtaccaacaagttgttcttcaaatcctggaatgaattgacctgaaccaagttcaagactgtggtttgaaccttttccaccttcaaattcaacaccgtcaactgaaccaacaaagtcaataacaactgtgtcgccattttcagcagcagtttcttttactacaagttctgccaagttgttttgagcgtttgttaaacgtgtttccacttcttcgtcagtaacttctttagttgcgtctacttcaactgtaaggtctttgtagtcaccaagtgtgattgttggtttaacaacaacttctgctgtcaattcccaatcagaacctttttccatttttgctacgtcaatttttggttgagcaactggttcgatagcagcttcttttactgcagcatcgtaagcagttggaagaacagcattcaaagcttcttcaaaaagagcttcttcaccgtacattttattgaacatttgacggctgattttaccttttcggaaaccaggaacgctaatgttagcttttactttattaaaggctttgtcaagcccagttttaattgtttcttgatcaattgaaaatgagagtgtacccttagtatcactaattttttcaaaacttacagtcatttttttctccttattttgagcctaagctcagaaattcatacctttcaagaatagcataaaataccctatatttcaaccattacttgctttttcagcacataaaatatgaatttctattttcattattactattttttaattaaaaaagcccaattttttcaaattgagcttctttttattttccagggcttagcttagtcataacttcattccataaatcatgattaaatatattggaaggatttcctccacctagaaaaccataaccaaccattagccctaaaacaatggcaaggactaacaaaatgataacaaaaatgataattgataatcttagtcctaaaaattttatggtcttcttgaacattattcttctccgtcttcatcttttactcggacaatatcagcaccaagtgcttttaatttttcatggaatttataataaccgcggtctaagtggcttaatcttcttacagttgtttggcctttagccactaatcctaaaagaatcaaagctgcactcgctcttaaatctgttgattttactgcggctccttgcaaatttgaatttccttggattaaggctgtatttctagtaatatctacttccaatcccatacgacgcatttcttctaaatgtttgaaccgattttcaaatactgtttcgaccattacagattctccagccgcgatcgcttgagcggcagccatttgagattgcatatcagttggaaaacctgggtgtggcaatgttttaacactagtagctttgagtttttcaggccctacgactctaagtcctgtttcttcttgagtgaaattaactcccatttcactgagttttgatattaatggacgattatgctcagcaattgcatctttaattagtacatcaccttgggtcattgctgctgcaaccatgaaagttccggcttcaattcgatcttgaacaacagagtgttttgcaccatgcattttttcaacacctttgattatgattgtatcagtcccagcgcccttaacatttgcacccattttgttcaaaagattggctaagtcaacgatttctggttcgcgggccgcattttcgagtgttgttactccttcggctaaggtagccgcaagaattagattttgcgtggctcctactgaagggaaatcaagatatatgtgagctccttttaatttatcagccttagcttcaatataaccagcattttgagtaattgttgctcccatttgctcaaatccacgcaaatgtaaatcgattggacgtgaaccaattgaacatcctcctggcatagaaacccgcgcttggccatttatagctaaaatcggtcccatgacaacaatagatgctcgcattttgctgacatactcataaggggcagttgtttttatttcagaattggctttagcaatgattttctttgcttcttgatcaaaactaatgctcgtccctagatgatctactaaattattcatcataaaaacatcacttaaaatagggacattagttaatacaacttcgccttcactcgcaagtaaagtagcagcaagaagtggaagaacagcattttttgctccttcaatttcgacttctccttgaagttttgtttgcccaccttttacaattattttatccatgttgcaacaaaaatgaccgtctactttttggtaggcgatcatttttgtagatgcaaagcacgaattcgcagctataccgctttcttcgcgacttcctttggtaacgtcaacgccaacagcaagccaatcaggcccacgccagcaaacacagcgaaggtaacagcaaaaccgccagtatgacttcgcagcgtggtttgcatgccatccaacaacactgtggcgaacatgacaccggcagaaccgaataactgacgagccgtcgttgtaaccgcagtgccgtctgccacgagctcattcggcaaagcattcgcgccagccgtcactgaaggcatcatcacaaaggcattgccggcttcagtcgccatcgccaacataattgccccaatcagcggtaaatgatgggcaaagactgctaacagaccaaagccgccagtaatcaacaacatgccaatcatggccacgacccgcggtccaaagcgatccagtaggcgcccgctaattggattcaaaatactcagcaacaccgcagctggcactaaggacaagccagaaatcaacggtgacaaaccaagtagcgtttgaaagtaaagcggcatcaggatagtggtgacaatcaaaccgacgtatgaaattccggtcagaaacaccgctttagtaaacataccagtggcaaaaactcgcatttgcaacattggtggttggcgattcaattgccgaacaacgaaaataccagctgccagaacgcctaaaatcaacaaaccaaccacgccaacagttaagccttttttcgacaaagcacccaaggcataaagtagaattggaaaacttgcggataaaaggaaggacacccagtccagttgcgtcggttgcaatggcatgacagacgcaatggtcaccgttgaaacggccagcacaagcagcgaaacgaccaagaagaacaagaataaagcctgccaagggaaccatgtcagcaaaacaccggaaataatcggaccgactgccaaggctgagcccatgaccaatcccgccgtgcccatcacccgaccacgctcactatgcggcgtaatcgtcagcaacacggtctggaaactcgggaaaataatcccgaccgcaatcgcttcaagcaaccggccaatcatgagcacggtaaaactcggtgcccagatacataagcctgtcccaatggcaaaaatgagttcaatcgcttggaaaagccgttggaaagtaacattatgcaacagccatgggctaaccggaatcatcaaggtcatcaccaacataaagccggttgtcagccaagcaactgtatccgctcctaaaccaaaagctttcataaaagcaggataagcggtgcttaaagaagactgagaaattgacatcgaaaaggtacctgtcagtaacgtggcgacaaaagccccgcgatgtttgatcgttggagagtgcatattaaaatcatctttttctatattagtattgtgggacgtttacattttcattcccattttttcataagactgcataccgcccatccaaatctcagatggtttgacgccacgttctttagccaaggccatcattaacgtatccatatccatcaatttatattcttgctttggcttggctggatcgaatgtttcaatctgtgccatcatgccgccatcttcgtgctcaatgatatggcagtgatacatataaacccctggcaaatcaaagcgaaccagcagccgaaccgtttcaccaggattcacgccaacggtatctttgaaaccatgttcatttggatacggcgcatgcccattccgcgacaagactaagaattgggttccatgcacatggaatggatgaaccattccaggcgcatcattgctattggtaacatcccagtactgggctttgccaattggttgcgtggcatcaatccgctgcatggcaaactttttaccatcaatcgcaacaccttcgtccatcccctgcatcacaacgtggcgaactggcaaagccgggtcaaccactggtgccttcacatcgaacaacttatcaggcaaggtagtctgatccggtttgaacgcatgaatgcggaactttagcaatggcacatcatccgtatataaggtgacctcgtcgccttcatggtattggccaaaatcaacaatcacttcggcacgctcagcacaagtcagcatcaaatgggtaaatttgaccggctccggtaacagtgagccatccccgccaatttgcgtaaatggcaggtcatcggaaaaatgcaaccgccattcacggcgattagcaccatccagaaaacgcaaccggaccttttgcgtggtgacatcaaaatagggattgattgtaccgttaatcattgcagttggcccagcaacaccgtcaggatcataatcagcccggtagtcccactggttgttctcatgaaaacgccggtcttgcaaaatgaccggaatatcgtcaacgccatagttccttggcaatggcaggctggcttcatggtcgtctttgacaatcaccatggcagccaaaccatgccaaacctgctcggctgtggatgggcacggatgcgcgtgcagccacaaagtcgtcgcaggttgttccaatgtgaagtcgatatgcttactttcacccggataaaccggcgcatggcatccgccatcaacataagggccactgacattagccccatgccaatgaaaagtggtcaactcaggcagggtgtttttcagtgtcacatgcgtatgctgaccacggcgatacacaatcgtctgacctaacagactggtattatagccccacgtcttggtcttcgccccaggtaacagttgcgtttccccagcctctgctgtcaccgtgtaataaacgtcggtcgccgtctctttatccggtttcaacaacggcggcacatttaagggcttctcaggcgcatcactgacctcaagcggcacgtatccgccatcgtggagatcaaacgctggctcatcaaagaaatagtccgtatagtttttcatcgtgatttccccctctgacaagaattttaacactttttaaaattactgacgacgaaccagattttacaaaattatttaaaaaataagcgctgacgcatttgtcagtgcttattttttcagaagatagccgttggcactttagcgcttacggatatactcaaatgtccatcagtaacttttaaattaatttttctttatgaatttgttcaaaagttttttcaccatcattgagtttttcccaaatgacaacttgtccttgttttcgagattttggtacatcgataatccgctgatttgatgacccacggaattggagcattaagtttttctttgataattcaaaacgaccgtcaactaaaatatctaacaaatcaagcatttctaatttgtcatctgtttcaagcaacatctcttcccatgtataacctgtccatgaccaaatatctttatccggtaactcacgacgaatccgtttgagcaaaggaatcaaaaatgtcgtattcaagaaaggttccccaccaagaagcgtcagtccttggatataaggctgagcaaggtcagccataattttatcttcaagctctttggtatagggcgttccataacgaaatgaccaagtggcttgattatagcagccctcgcaatgaaacatacagccactcacataaagtgagcagcgcaccccttcaccatcaacgaaattgaagggtttataatctgcaatataattttgtgagagttcatcagctctccattctcctggttttggattgttcatacttatttctccgcaaaatattttgatttcgcttcgtcaacttcgactgaatcaattaaatttccatcgttcaaagctccgacagaaccattcatatgttttacacgtgatgaaatttctttgtgacgaccatgaaccattggacgtgcttgcggatttccaagatatccacaagttcttttgacaacgtcacaggttttaggatcatcattgccacattgtggacatttaaatccacgttccgttgccgcaaaatctccttcaaagccacaagcatagcagtggtcaattggtacatttgttccaagatatccaatacgatcgtaggcaaagtcccaaactgcttcaagagctttcggattttgttgaagaacaggatattcacagtaatgaatgaatccaccattggcataaacaggatagtctttttcaaactctaattttttaaatggagttggatttttacgcacatcataatggaaagaattagtatagtaatctttgtcagtaatatctgcaactgaaccgaatttttctttatccattcggcagaaacggtcagttaaactttctgacggtgttgagtaaacagaataatgataaccagaggctttagaccaatcttcacaatcttcatgcattcgtttcacaatttcaattgtaaaagctttagcttcaggattattttcccaagttgggccataaaaagtagtcgccacttcataaagtccaatgtaacctaaacttacagttgaccgttctttattgtacaattcatcaactgaaccttcggcatcaaggcgtcccaatgcaccattcataaagagaataggtgcatttttaggttgtgcttctttagcacgttcaacacgaaaggcaagcgcatcatgagcaatttcaattctttcattgaagttttcccagaatttttctttatttccagcggcttcaagagcaatacgtggaagattaactgtaacaactccaagattattacgtccagcagtcacgtcattcccattttcatctctccagccttgcaagaatgaacgacaacccattgaagctttaaatgaacctgttaattcaacaattttatcatagctcaaaatatcagggtacatccgttttgttgaacattcaagtgcaagttctttgatgtcatagtttggtgtccctacttcgaggttaagcccacgtttgagtgtgaaaattaatttagggaaaatggcagtacggtgttctgaacctaaaccaccaatccggacattcaaaattgctttttgaatttcacgcgcataccaatcgtctccaagaccaaaaccaaccgttacaaaaggcgtttgaccatttgaagtaaacaaagtattaatttcatattctaaagattgcattgcatcatagatatctttggctgttttttcacgagcataagcttcttgtttttcagcaccatcaatccatttttgtacatcttttaaatgttttttataatttaatttcgcgtaaggcgccaatacttcatcggcacggtcaaatgaacaaccaccatattgtgaactagccacattagcgatgatttgactggcttgcgcagttgctgtttgaattgattttggcgaatctacttgcgcatttccaagtttaaaaccattttcaaacatatttttaaagtcaatcaaacaacagttagccattgtagtaaatggactataatcaaggtcatgataatgaatatcacctttttggtgagcatttgccacttgtggcggaagaagtttcaatccaattgctttggaaaccgcaccagctgtcaaatcacgttgagtattgaaaacgttagagtctttattggcattttcattaacgacagtttggtcgcgattaattaatttttcaatcgtaaaattgatatccgttgctttggtacgggccaaatcacggttagcacgataagagatatattcttcagccaattgagtttcaccagactcaaggagttcttgctcaacaattgattgaatttcataaattttgacattttcagaaaaacgagtaaagatttcactgactactctgtcagtaagttctgaaagaaccgacatatctgtcagttcgacttttttagccgctttagtcaaagcatcaaaaattttctcactgttaaatttcactgagcgtccgtcacgctttatcacattaatttcttctagtgttacatcttgatattttatttcacttttcatattaaccatcctcttcaattacatcatctattttatcaaattctcggaaatgacacaatatatagactcatataaactggtaaaataaagataataaaaatcatgcattattgagagggagaaaaaggaatggcagaagcaaaatttgaagctgctttaatcaaaaaactagaagcagaaggatggacctatcgtaaagatttatcttatgtccctattaaggttttagaagggcactggcgtgaggtgcttaatgaaaataatgcttataaattaaatggcaacccttagttgatacgacggggatttatcacggaattaatctcttgcgattccaaatgcgcaatggcgttgattcggaatttttatttcagagactaaacacgatgccaatgaaaaattgggcagtttcgcacgcgaatcccacagtcagccaagcaagcatcaatcaaacggaattaagtaaacagccaatttcgtcgccaacactaactgagcaacaacagattggtaattttttcaaggaaattgacaacattatcggtcttcatcaacgtaagttggatttgttgaaagaacagaaaaaaggcttattacaaaagatgtttgtgtagaattatgattctattaaattcatagaaggctatttactggctcaacaacgattaaggtcctggagaccattcgaggcatatgcaaaaataacccaaaaaattagaggaagtcatagagcggtattgacttgaataggtgagacattgattgaattattttcagaagttgcgcaaaattatttaacagaaaaaaataatgcttttaaagaaaactcactagggacactagtgagaaaagacatacctaatgagattatgacatttcttgatccagaaaaattcagtgtgaaaggatctataggacaaggacagtgggcagttatcccatgggtatgtatttataataaagctatctctgcaaaaacaacgtatggaattgatattgcgatcttgtttaaagcagatatgacggggttttatattacgttaaatcaaggatggacgttttttaaaaattcctataaacctaaacaaattgcaaaagaaaagattaaacaagcttcatatactctaagtaacatcgttgatgatctaagatacagtgtagatccaattgacttagggtcttcagaaactttagcagtcggctatgagcttggttcgatttttaataaatactacgatatcgaatgtttacctacaaatgaagagttcgaagaagacattaaagcatttactcaaatgctggtagaagtagaattatatataggtaaaaatcgtagttttgaggatttttatcgtgaaatcttaaataattcgttttatcaagcgcttatacatgaccaaagtatcttcaaagaagtagatgataatgacgaaacttatgtctatcaaattgaagaagaaatggcagagtcacctgctgaagaaatcattgaagaaccaacacagcggaaagatcctgttatcaatcgtggggggcaagaaaactggccccgagatagtaaaatagctgcgatagcgctcaagaaaaccaattttttatgtgaagttgatcctacccatcaaacttttacatctagaaaaactggaaaatcatatatggaggcacatcatctaattcctatgggaagacaaggtgagtttgattatagcttagataagatcgcaaatattaagtgtatttgtcccaattgccatcgattgttgcatcatgggacagatagtgaacgaaatcaagtgttagaaattctttatcaacaatcaatttctaatttacgacgtgtgaatttatctattgcattcgatgaactaaaaacattttattgataaatgtaaaaataggagttgatgttaagtcattttctcatagttacagggtctataattagataataacccctgagaaatcaaataaaaataacccctattattcaatttctgaattataggggttatttatttattaaatgttataatggataatgcatagagtataaatgcacaggaggaaataaacatgaaaaaaaataattactatattttctattatagttattttagtcggtataggatttggatacttttttggaattgcaaagccgcataaagaagcggttaataattttaatagtacttataggccaatcgaagacaaaaataaatctttggataaaattattaaaaatgcagaaaaaaatttagcaaataatgaactaccacttgataattcaacgaaaacaaaccttgaaaagattttaaagaaatctcaaaatgataagatcaaagttccagaaattcccaataaaacttctgacattaacaaatcaataaagtctttaccaaaaaaagttgattatagtattaacgaaagagaattaaaattggctttatctaattttaaagaatcaatcaataaaaataagttagtgactaacccgacttcagattttgtaatcgaaaaattgaaatctttacccactgttacaggggttcaagcagtaacagaaaccaatgatccaaatggatcattgaacaaacctggggggtatacctccgctatctattttacggattctgcagtacaagaccaaatagatggatcagatattgttgctaaaggtactgatgccggagggcaaattgaagtttacaaatcatctgaagaagcacaaaagcgcaatgattatttatcagcatttgatggtgcaggattatttaactctggttctcatgaagtttgtggtacttgtgtaattagaatatcaagtaaattaactgcaacccaacaaaaagaattaacaaaaaaaataattgatagtctaactcaattataaaaaaaatactataagtaattgatgctatccttaaatcttagagtcactattgtataatttagacaaaggataaaaacatgcaaaaacgctacttacaagaatttaaagacacccttctcgacttttatcattctgggcaatccgtcacccagctgtctaaagaatacggcgtggctcctgcaacgatttataaatggatcgacctctatccagcatctcgatagcgtctcacagccatagcgaggcttggaagaaataatgatatcccaataatagccataataaacaatggaataataaagctttcaaacgtagaagccaaaaaatcagtttcgtttgcactccctgaaatactcatagcagaaccaattgctacatagacaaaaaatataattggaacaaatgaaataatcattaaaattaacgtcatccaccaatatccagctcgagtcgttcttcccttgaaatcaatatatccaataaaaaaatccttcaatgctcgtccaaaactcacttgcccaggaacttcatttattttttccataattaaaaatcctccttcttctaaatcaatcataacaaaataaagaataaaaagagaatcctatagattatttctctaatatccaaccccaaaatagctattttattagtcatttgttcattattaatgcttaaaccatgagacgagcattgtaacaacgaaagctagtatgcataagattattgttatgaaaatctcttttctttgttgctttttagttttatcttccaaaattttaattctatttaaaaaaatagaacatcactgcaatatttacaccaataccaatacaagtggctattaaaattgatattggtaactctgcaccataatggctactcaaaattatgaataaaaaaactaaatctgtaatgactgtacagtatgaatatttttttaaattattaatctctgcctttttctttatattttctaccacttctgacccctccgttaataaattatctaaagatatttgaaataaagaagctatacgaataaggttatcaatatcaggagtcgtcttcccagtttcccaattagatatagttttgctactgacaaatagtttatcagcaagatcttcttgggttaaccccatagattttcttttagtttgtaacacttctccaaaattcatataattttccatacctccaatttaaacatttatgcttaatatttctatccaatacctttctagttccctagaaaatagtttccaataagtctattttagtttaaattgaagaaaaaatacagatagctgagatagataagttatcttaaaactacaaattctgttatatttcaaaaagaaaagcatttatataaatgctttattttttataaatttgtaaaaaacagcccctataattatatcttgtaagtataagggctgtttttgcttaatttcttaggggttattatataattatagaccctaagttaaggaatgtactgatgttttctagtataatccctagtttgataatatttattgtatttttctgtatttagttattcgatgatatcgaggctaatatgtcagtcttccaagcagccattggttggtatatcaatttttataatcgcaatcgtatctcaaatgttgcctaagtaactgaataaaaatagtccaatttattgacttctgagcagccgctgaagctattaaattattgaaaggaatcagccttttaaaaagtcaacaaagaaattctgctttaaatcatattagggtatcacaaatactttacaaatatgttttgcgtcgcatcaaaagccagcaaattagacttagtatagcagagataatcaatacggctaaaacaccataagaagacttttcaaacgggacatggacattgattccccaaaagccaaaaataattgctggaatagtcaaaacaattgatatctcggttagggttttcataatcatgtttagctgatacgaaatcatattgtttatcatattttccaaattggccaaatattggctgtaacctaaaatgattctatccattgtatcacttgtatcgtataactcatcaattatttttttagtactaaaattaatatcgtcaatagttgtgaaattttttttaatgaaatcaagcgctttatggttagctttataagttgttgacaaagctatcatgtatttttgaagagtcaataaatcaccaaacgttggtctgagtcgaccggacgttgatatttctgagtctaaatcatcaattttttccttgactccacgaaggtcgttaagcatcacatagaaatctttttgcatgatctttaaaagtacttcctccacgaaattattgacatcacgtaaaaccatattggataagagttcgggaatgaattttaatttttgttttgtaaaaattatcaacttatttttaaataccaagaaaacaacagatgtcgtcagattatctagatgcccaccttcatgtaccgcgggaaacaaaaaacttacgatcaaacttttttcatcgttctgatctatcatcgtgtcatatgcaacttgatcatcaaacgttagtatattgcctattttaaagtcatatttatgttcagaagattcgatatattctcgttcgtcaccgtaaacataaacaacagaagaatttttgatatttgattctgacgaaactactaatgtatcttttgttaaggaataagttttcagcattgtaatcctcctgctttatatttttctcaaaaataaatgcgtaattgttgtggaataaatacgttatcagttttaaaaacattttgtcttatgtatgataacctgccaaaaattttatctcacacattatctagacaatcttgtctccagcttctaatgtattatctaatttgtaattatagaccctttttattttttcatatacttttttggcttgtaaaacacctaaatttgtatactctctaatctttttgataactactacgtctttcttattttccaaaatcatagctttaataatctgttgttcttcatccgtcatagaccgaatttctggttctgtaagaacttcaattaagttatcactaaaattagatgaaacaagaaaaagtattgctaaaattaaaaaaatatcatcatcggtaaaaaagtaataaacaataaaaaataatgtaatacgataaggataataacaatacttaatcccaaagttaaaacagatagccagtaattgctattgtgccaactttttctataatgtacgacaagataaaaagaaatcgcaattagcagataaggaatcactaaataaaaaattaaaagaaggatgattaaatttgtcagtaaatactgtgaaaaatatatgccgagcatactaaggatatagagaagaccagtaattcggaagtaaattttaaaacgccctcgataaaccgtaaagtcaaatttatttagaagacaagacaaaagcaacaaaagtaaaattaaaagataaagaaaaatttcaagcacaatcattttcttactacctttctatcagaaacatttgatggtagcgcagatattttttgaagtgcactacatactccatttccgcttttaaaatttcgtttcattatttaattatttctcatttcgtgtacaaaaaatcacaatgaaccaacaaaccaaaagaaaccatccataattaataacaaattgacaaatccattgatagcaaccagaatataacccagatgcttgcgctcatgaaaatatcttttcaaaatagcaatcgcattccaaagaaataaaatgggggcacacagataaaataaaattagaattgccatcaaataatctgtcaaggtcatagaattagacgcatttccagttaaagaaacataatttgctagaaaagtcactgcatatacagccccacctatcttgaaaagtctttgataaaattttgcctggtctccggtaaaattataatttgtgaagaaatataaaagaataagaataattggtaaaacaaaagcggcataataaacaatatcgtcaaccatcatggctgaacctccaatccaaaatcatacaatctcatctaaatcaatactatatttaatcacttcttcagtaagtcaaattaacatcacatattataaaaagtagttaaattataaattatccaaatcaaatttataagacaaggaacaaagagcaggagagtaaaacgatagctcttctctcttttacttgctctgtattttactgtcaaataagaaagaaagatgaaaaagataaccggagtaaacatcaaccaacgcgataatcctgataatatttcccaacgggtatttccgattgaaagagtccccaaataagaggataagaaataaagaatagagataacgcgaaagacgtatttgacaatattttgcgttattttctcctcgacatagctaaaatttgatagaaaactaaagataatgtagggtaaatagataaaaatgagggggattactaagtcaatcattttgcaacgcctccaaaaatagacatatgatgataagttcgaggcattttttgtattgtgctacaagctcctgaattaggtttacaaaaaggattttttgtactatctttcttacaagtagctaaataaagaggaatatttgtcacaacattttgacagtcacttcccataaaatcaatccaaaatcttggatctgctttattatgatgaatattatccgtcccaaaagcattaaaatcattgcagcccactttttctccaactctatattttcttaccacgccattgctaagaagattaaaagataatggagtgagtttaatagttgaagtgtcctgattttgtggactaacatcttcgggcattgaattaccgttaaccatatccatttgattgaccacttcattaacatctattgtttgatttactattacagtttttgttttagcgaatggagttcgtatttttacagaatcactattttttccatcaatattacttcgaatagtaggagcacttgcagaatcagatgctgtgatattagttactatattcgaggtaactttagcaatcactttaccgtttacatccgtttgataggtttgattatcaatgacaaactgctgattagccgaataaatttgttttataaggttctctccactttcggataatttccaaccattttccttgtatgctgagattacttcttgtttgctttctgaagtaagaccagaaagagaaatttttgcatccgaatttgtcttgataactagatttgtctgtggcaacccttgcacgatatgctccgccttagccggtaagttgaccacactaaatcccacaagggcaatcagtccaatagcaataatcaatgagccctgactttgagaacgagaacttatacgccccttctttgagggcatgagatctagtccaagaaaagccaaaaacaaaatatctgaaactatctcggccggaaaattattaaatcctcccaaaatactactaactggagaaaggagccaaatccatggacttaaccctgtgtctcgaacgcgcctaataccaagatttgatgttggaatgagcgtcgctaacgaccacaaaataagcaaacttccgaaaatataagtcgcaacattgaaaccctcaaagtcaaacgacaaaacgactgtggcccctgttgtaactatatataacaagatgagtgtgagcgcaatggctagattcataataaaaacccaccaaaaactcttacgtgtcgtacgccccgaccaattaaaatattgtttccaatattcgatgtagacttgaatcataatgattgcctttgtttgtagcaataagtatcttacacttttgttaagcaaacgctctctttagtttgataagtttattataactctattaatttccattgcaaacttattttacaaaataatttcattttggtgtattttataacatcacagatatattatatagaataaataaaaaagaagcgggattaaacggattaaccgacatccatctaaaactcaattaaggagacaatacctgtcactcaaaatgtctcaactcttcaatgctaaccgaggaatctatggtgctcctaaaattcatcatcttctacttaaacaaggggaaaaagtcgggttaaaactggtacagaagctaatgaagcaagttctccggttatttgtgtttgacttgaacgcatccattctactaactctgctttgacaactggtcgattcatcatggggttacttgtacgtttatatgtttcaaccatttttaaagatggactcctttttcaactaatttttctaattcactcaatcgattttcaaaaagctcaaaggcagcatctaaataatcggtagattccatatcaactccagctttggcaattacttctaaaggataagctgaagaaccagcctttaaatattcaagatatttttgacgatcctcagttgaaccatgaacaactttttcagccaagaaagttgccgcagcaaaacctgttgcgtattgaaaaacatagaaattataataaaaatgcggaattctagcccattcatactgaatttctggattttctttgactgctaaattatagtatttttcatttatttcgccataaagtgagtttaagtattcacttgttaacacttcaccggcagcatctgcttcatgaattttttgttcaaattcggcaaattgactctgacggaaaacagttccacggaaactatcaagccagtggttcaaaagggcgaagcgctccttatcatctttactttcctttaataaagtttcagttaaaatattttcatttgtagttgaggcaatttcagctaaaaagattggataattcccataaacatatggttggttttcacgcgtgaaagcactatgcattgaatgccccgtttcatgaactaaagtaaaaagatcatctaacgtttcttgccaatttagaagcataaaagcattggtatcataagatccacctgaataagcacccgaacgttttccgatattttcttcgacatcaatccatctttgttcaaaagctgctttaacttttcctttatattctttaccaaatatcgctaaaacttcttctgcttttttcactccatcttcatagttaaatttataatctaaattagataatggagtatagatatcatacatctttaaatcagtaattcctaaaattttcttgcgtagttcaatataacgatgtaaaagtggcaaatgttgatgaatggcctccatcaaaacatcgtaaactttttctggaacaaaattattagccagagcagcttgacgggctgaatcataagagcggatttgggcattaagattatggacttttacattagtctgtaaggtctttgcataactatgctgatattgttcataattactataaagtgctttgtaggctgcttttcgtactcccctattcttactttccattaaggaagagtaatttccatgcgtgagttggatcatctcatcagattcatttttgaccataggtaacttaatatccgcattatcaaaaatttcaaaagtttctgaaggactttcaaaaatttcaccagccgcagccaataacttttcctctttttgactaagaatatgcgctttttttgcaaaaaggcgctcaaacatatggtcatagttttttaatttttgaagctcccccaaccatttattataaacttcttttgaaattttcaaaaattcaggttcatagaaggcatagacctctccgaatttcacatagagggctgttgcttttgattgatactcctggtatttagcctctctggtatcttgatcatttttcattgaagcataaacatatagtttttcaacttgttgagaaatggatagcattttttcggtaattgtcagaagactttcagctgaatcaagtaaatgaccagggtctgtctcttcaacgagtgaaagttcgctttttattctagttagctctgcttcccattctttatctgttttataaattgttgtcaaatcccaagttaatttttcaggaatttcatttctattcttagccatgaagctcactcctttttattcaaaataatttttattcacattaaaaacttattagcagaatttcattcattcatatccttcttctgctttttcattatagcatagaaacggggaggatatactgccttaaagctatttttctgaaaatttattaaaaagttttcataatatagattaatattctgcttaatttgagtaaatttatgtaaagggatttcatcatcaaaaacttcaagtaagttcaatcccaaaggcgcaataaaagaacgttcaaaagtcaaattcaacaaattttcacctctttggtaatatttttcctgaagtttcaaccattttggtgaacaataataaagttgccgacgaataaattccgctagtttaagatcaacaataagtggtattgtcagtaacttttgtgataaaaaaggcagtcgtaattgctcaataagtcgtccttgaccaaaagggatttcttcttgtaaataaataattttcccacgcaaatcttcatgaatcagtgtcttcaatctcagcttctgagttttaaaatctaattcccaataatagaaaagaatccaatcaagtcttgcgtattacccaatctttcgccttagatgaactgaatccgaaagttcaaaaagactggcaaaaagccaatgatttaggcgttgaattagcagaaaacctttatcctaaccatcaaagcgctgtttatacgcatttagacggaaaaaatcacgtcttacacaaccacatcattgtcaataaggtcaatttagatacaggaaagaaattaagagaacaaaaaggggaaagtgttcaacgagcacgagaaatgaatgatcgactcgcttctcgagaaaactggcacattttagagccaccaaaagagcgtcaaacagagacagaaaaagaactaatcgccaaaaatgagtattcttacatggatgatttgagagaaagaatcaataaatcgcttcaagatgtctctgtgagctcatatgagacgtttaaagagcgcttatccgataatggtgtaattctatcagaaagaggtcaaacgttctcatacgcctttttagacgccaataataagcaaagacgagcacgagagacccgattgggttctgattttggaagggagaccattttacatgagttggaaaaccgagcaagacaaaacgaatttagcgctgttgaacaacgagaaccagcgattactccgcttgagcgagacactcaacaaagagaatcagaaattgttagccttgaacaagcaattgaaccaagaaaatcagaagctcgcaagcgagaatcaaaaattaatcgatttattgacacaatcaaacagtttgcaggacgagtaccagaacttactcaacgcgttacaagaaaattaaagcaaacaaaagagaaaatcctcgatgattttgaacgtcgcttttcaaaggacatgaaaaattacgagcaagaacaacagaaaagcctagaaaaacaagcaaatagagacgtacagtccgaaaagaaaccaacaaaagatcatgatcgggggatgagtcgatgaataaagatgaacaactcgttgttcaagtattaaatgcttataaaaatggaaaaattgatttcagtcacgttccagaactagaaaccttagtccgtcaagaggttaataaagagtttcgggactaccaagaaaaaatagaagctgttgcgagtcaaaaaatggaatctgccattcaagaacaactccatcgtttagaggcagaaaacttaaaagcggatatactgaaagaaattcaagatgaaaaacaagaattaatcactttgaaaaaagaactaaatgaacatcaagagcagataaaggtagatcgaaaacatgcgattgtcgaacattacagtattttgattgtgaatattatctgcctgttctgtttcttagttgtcggtattctcatcggacgatggatttataaaggtatctgggacggttggggcttacatattttgtatgacacagtgatggaaatacagcctaaacatccttatggggcagtcgttcttggattaggtggttttggtttaatcgctgctggaatttatggcagttttcgattaatgtataccgcttcaacatggtttgatcaacgtccaaaaattttcaaaagaatctttccgaaaaaatagagagtgaggggatattttggttttagataataaattaggcttaacaaattcagcagaattagctaaacaagaagagttattaacgaaaaaaagagccaaagaattgtttgagtctggcaaaatagaggatctggaaattgggacgtttcaaggcttatctgatattcatcagtttttattccaagatatttacgactttgcaggaaaaattcgagaagtgaatattgcgaaaggaaactttcaatttgcgccacgtatttttttagcgcaaacacttgaatatattgataaattacctcaagaaacatttgatgaaattattgataagtactcggatatgaatgtagcccatccgtttagagaaggcaatggacgagccactcgtatctggttggatttaattcttaaaaataaactacacaaaattgtcgattggaatcaaattgataaggatgaatatttaaatgccatgatccgtagtacagtcagcaccaatgaattaaaatatttgattcaaaaggctttaaccgatgatttaggaaaagaacaattctttaaaggaattgatgcgagttattattacgagggctattacgaaattaaaacagaagatctataaacacgatttaaagaaacagactgctcaatataaaacttgagcagtctgtttctttttttggatgattttgacttttgattttaaatttttgaaaaaaataaaaaaaggcgaagcctatattaatttatcatatatattttaatcttttcttcttttgcgtcaaaaaaaagtgagtgttttcaaggggttaaagaataatatgtggagaaaaaactgtttatatatggagaaaaaactgtttatatatggagaaaaaactgtttatacatggagaatgtctattaacttctccatgtattatggtataataaaagcatgaagaaacacttttcgtcgagagaatcttcatgcgtatcttcggcttttcggtgtctactgaaatcaagggattaatgggaataacaacctaagatatttggagttcagagagggcgcgtttgattttcaaacttcgcaacagaaccaccatctctattaaaatttgtccaagatattgacccaaatacatattatctgcaatatttacttaataactgtaattgagattggagaatttttaaccatataagtagcatgcgaaccaaaatatcctttaattccatgcattgatcgcgatccaatgattaagatatctgcagatgttgctggcaaaatcgtcttagtaatttcctcggccggatcaccttctccactgtacagctgaatgttttttacaccgctattttctgcatattgtttgtactttttcaaattaagtaacaattgactttgtttctggctcaagtactcagggtctaacgcttcataaacattcaactcttcaatttctaaaattgaggcaatcagtaatgcggctccagttttactcgcttgctttacagcatattgaaaggctttttgagctccttctgattcatctaccccaactaaaatatttttaaattcatcaaatccttccatagtgcatcttacctttcattaattaattgattatattttttatttcctttatacagttcaataattgtccacgctaacagtagtaatactgcgacgataatgacataagcaatagaatcagctagtacaagttggcttgatgtcaccttttcaccaaaaaaaccttcaatttggccgggcaatccaatcaaatttaaatatgtcaatccaattactgaaccccatcctagtatccgaataactatcgaatttttaaaccggcttcccatttccacctcactattggtcatcattaataatggtaccaccgaaaatggtaacgcaaaagctaagaagacttgtgaattattcattagtgtatttaacgctgtgtgctcccgaatcgttccttgcctgcttgtaataattacacagattaacactgggataactgaaatcaaacgcgtaattaaacgtcttagccaaattggcattctcatatgaatgaatccctccataattacttgtccagttaaagttccggtaatcgttgaattttgtccagaagctagtaacgcgactgcgaataatgtagaaagaagacctgattttgcaacggtgattaaaattccgttactcaatgtatccgaatttgataaagcctcatacaacccaaagaatgatggatctttcactgcccctgttttaaaaacagcaactcccattatgagcaataaggagttaacaaaaaaagcgagagtcaattgaatgttagaatcccatgttgaaaatcgtacagcattggcgatttcatcttcatccgtacgatttatctttcgagtctgagacacagccgaatgtagatataaattatgaggcataacggttgcaccaataattcctaatgcaccagttaaaggcgtttgaccaccaattgaatgtgtagaggagaacgtttcaccagtcggaaccaatcctttaagtacatccccccaattaggatcagacaacgctacttgataaacaaacacaaaaagaattacaaaaatcaaacagacaactattgcttcaatttttctaaaaccaactttcgttaacaacaataatattaaaacatcaaataccgtaataaagactgcgacgacaagcggaatattaaaaagtaaataaagagcaattgatgcgccaattacttccgcaatatctgttgccataatcgctaattccgttaaaatccataaaatgattcctagttttttactcgttctcgctcgaattgcttgagctaaatccatttgactaacaattcccaatttagcagccatatattgtaatagcattgcaattaaactagacattaaaatgaccgacattaataaatactggaagttttgcccacccgtaatcgaagtagaccagttgcctggatccatatatcccacagcaactaatgctcccggtccagaataggcgaacagggttttccaaaagcctttgcctttgggtacctcgacagttccgttaatttcctctaaagagggaccattcgcatgctgaattaatcgaggtttgtgctctttaccagactgacttgttgtatctttcaaaatatttcaaccttcctttaagaatatcataagtatacaccacttttttataaaattaaagcaaaatattaggcaaacctaaaaaaaataaacattcgcctaatttaatattatttgccttcatttcatttgtgtcggaatgaatcaattgtacacgttaaaaatatatctatatgataattaccattgttaatattcaagtttttttgttgaaatagtcgataaaaaaaataaggttgaccaaaatatttttagaggcgcgaattgtaaaattaagttagaaaaataaaaaggcatttatggtacactcaaattgtatttccgacgaaagaaaacaaaggagtgtaaccataaatgacctacaaacatcttaccatagacgaacgttaaattatgtaaacacacacaatatcttgtgtttcttgttttcattcccttttctcaattttgcaaagcaaaatataatctctttgtattcaaaacgtaattagtgcgtcttaaatcagattttttctctaaattctcacattttctagccaatataaaacattaaacccgaattgctagttgattatatatcatgatatcacatttaagttacaaaagaaacctatagattattatttcgtaacatttatagaatacaatttttttccttgactttgataatttacaattgtaaactatatatagatagaaatttcaaagcattcatttaggaggaaaatatgtcaaataaaactcattcgtctaatcacgatgaaatgatggctgagcatcatcataatcatgaaatgatggatatggagcacgaaaaccatgagatgcacaatatggataatatgcatgagatgcatgatatggacaatatggatatgatgaatcatggaggacacatgatgcatatgggtgatatgagtaaaaagctcaaagttgctatcattctaatgattccccttctactcatttcaccaatcgctggctttactatccttaaattccccggaagtgaaattttgcaactcatccttggtacaattatcttcttatactctgggactcctttttttagcggagcaaaaggtgaattaaaaagccgtaagccagccatgatgatgctgattacaatgggaattaccgttgcctatgcttattctgtttacgccacaatcatgagtcttaacggacatatgggcatgaacttctggtttgaactggcaactttaattgtcattatgttgattggtcacctgattgagatgaaagcaatcatgggtgctggcgatgcattgaaagatttagcaagccttgttcccaaaaaagctcacttaaaaagcgggaaggatgtggagctttcagaactaaaagttggcgatttacttttagtgaaagaaaatgagaaaatacctgcagatggccttatattaagtgaagcgctcgttgatgagtcaatgattactggtgaaagccgagcagtcaataaaaaaacaaatgaccttgtttatggtggttccctcaatcaaaaccaaccatttgagatgaaagtcacaacccttggaaaagattcatttctcaatcaagtggccgaattagtcaagaaagcccaagctcaaaaatctaatttggaaaatatggctgacagagtggctggttaccttttctatgctgcacttattgtcggtatcttctcattaattttttggacaattagctctaactttagttttgctctacttcttgcggtttctgtttttgtaattgcatgtccacacgctttaggtcttgcggttccacttgttgtttctcgcctaaccagtatttctgctaaaaatggtttattaattcaaaacagaacttctctagaaaaaataaatacaattaaatatgccttaatggataaaacgggaacattaactgacggtaagtttattgttcgtaatgttattgattttactgatgaaacagacattctccaaatcatggcagcacttgaaggaagttccactcacccgattgctcaatcaatcgttgcagctgctaaacctcttggaaatctaaaagttgaagcggttgaaaatattccaggagttgggattaaagggcaagttaatcaaaacttttatcaaattgttaactataaatatcttcgtgaaaatcaactttcttatgatgaacaaaagattgctcaatatttagatttaggtttaactgtatctttcctaatcaatgaacaacaagatgttttaggatttattgccttaggagattctcctaaagcagacgcgaaagactttattaatggtttattagctcaaggaattacccctgttatgctcacgggtgataataaagaaactgctaaaaaaattgctagtgcactaaatattcccgaatttagagcggaattaaaacctgaagataaagcagaaattgtgaaagagtaccaaaagaaagccggcgtgcttttcattggtgatggtgtcaatgattccccagctcttgcaactgctacgattggttttgcgattggagcaggaacttcggttgctatcagtaccgctgatgtcgtcctagttaactccaatccaagtgacgtcttggatatgattaatatctccaaacgcatgcttagaaaaatgaaacaaaacctctggtttggagcaggctataacattattgctattcctgttgcagcgggtattctttatccatttacagggatttatattgaccctctcattgcagcagtcctgatgtcaatctcaaccgtgattgtctcaatcaacgcgatgggattgaggtatgataaaaaatagaagagcacatgctcttctatttttttcatactaattatgaaacttttatcacttaaatatacttaaagattaagtatgatatcacacaaatactaatgattgtaatgatattttttaaatacataatgtgcgcccagatagggtgttaagtcaagtagtttaaggtactactctgtaagataacacagaaaacagccaacctaaccgaaaagcgaaagctgatacgggaacagagcacggttggaaagcgatgagttacctaaagacaatcgggtacgactgagtcgcaatgttaatcagatataaggtataagttgtgtttactgaacgcaagtttctaatttcggttatgtgtcgatagaggaaagtgtctgaaacctctagtacaaagaaaggtaagttatggttgtggacttatctgttatcaccacatttgtacaatctgtaggagaacctatgggaacgaaacgaaagcgatgccgagaatctgaatttaccaagacttaacactaactggggataccctaaacaagaatgcctaatagaaaggaggaaaaaggctatagcactagagcttgaaaatcttgcaagggtacggagtactcgtagtagtctgagaagggtaacgccctttacatggcgaaggggtacagttattgtgtactaaaattaaaaattgattagggaggaaaacctcaaaatgaaaccaacaatggcaattttagaaagaatcagtaaaaattcacaagaaaatatagacgaagtttttacaagactttatcgttatcttttacgtccagatatttattacgtggcgtatcaaaatttatattccaataaaggagcttccacaaaaggaatattagatgatacagcggatggctttagtgaagaaaaaataaaaaagattattcaatctttaaaagacggaacttactatcctcaacctgtacgaagaatgtatattgcaaaaaagaattctaaaaagatgagacctttaggaattccaactttcacagataaattgatccaagaagctgtgagaataattcttgaatctatctatgaaccggtattcgaagatgtgtctcacggttttagacctcaacgaagctgtcacacggctttgaaaacaatcaaaagagagtttggcggcgcaagatggtttgtggagggagatataaaaggctgcttcgataatatagaccacgttacactcattggactcatcaatcttaaaatcaaagatatgaaaatgagccaattgatttataaatttctaaaagcaggttatctggaaaactggcagtatcacaaaacttacagcggaacacctcaaggtggaattctatctcctcttttggccaacatctatcttcatgaattggataagtttgttttacaactcaaaatgaagtttgaccgagaaagtccagaaagaataacacctgaatatcgggaacttcacaatgagataaaaagaatttctcaccgtctcaagaagttggagggtgaagaaaaagctaaagttcttttagaatatcaagaaaaacgtaaaagattacccacactcccctgtacctcacagacaaataaagtattgaaatacgtccggtatgcggacgacttcattatctctgttaaaggaagcaaagaggactgtcaatggataaaagaacaattaaaactttttattcataacaagctaaaaatggaattgagtgaagaaaaaacactcatcacacatagcagtcaacccgctcgttttctgggatatgatatacgagtaaggagaagtggaacgataaaacgatctggtaaagtcaaaaagagaacactcaatgggagtgtagaactccttattcctcttcaagacaaaattcgtcaatttatttttgacaagaaaatagctatccaaaagaaagatagctcatggtttccagttcacaggaaatatcttattcgttcaacagacttagaaatcatcacaatttataattctgaattaagagggatttgtaattactacggtctagcaagtaattttaaccagctcaattattttgcttatcttatggaatacagctgtctaaaaacgatagcctccaaacataagggaacactttcaaaaaccatttccatgtttaaagatggaagtggttcgtggggcatcccgtatgagataaagcaaggtaagcagcgccgttattttgcaaattttagtgaatgtaaatccccttatcaatttacggataagataagtcaagctcctgtattgtatggctatgcccggaatactcttgaaaacaggttaaaagctaaatgttgtgaattatgtggaacatctgatgaaaatacttcctatgaaattcaccatgtcaataaggtcaaaaatcttaaaggcaaagaaaaatgggaaatggcaatgatagcgaaacaacgtaaaactcttgttgtatgctttcattgtcatcgtcacgtgattcataaacacaagtgaatttttacgaacgaacaataacagagccgtatactccgagaggggtacgtacggttcccgaagagggtggtgcaaaccagtcacagtaatgtgaacaaggcggtacctccctacttcaccatattgtaaatatagggagaatctaaggtcttcattaaattaaattctctttcaaatctctttaactcagttggggttaattcagctttagcccgttttaaagcaaaaatagtatcataattagtatccatgtatttatataccctagcataagacccttcatttaccattgtaagaggaaaactttcttttactccttcatttactttcagttgatggtctaaaataataataggttcatattttaaaatcgaaagaacatcatactcttcagggatacttgaacctcctgaaggaactagtgtgggctcaatagttgtaagtgcgctatcgtatgtttcgactaacttaaatgcattgtcagtatctttaaaaccaaatttgaaatctttaaatttatctaataattttatcaattctctgcttggttcagcattaaagtgcatatttgattgtgcttttgaattatagaataataataattcattaaactttttttgaaaagcggcaaagcaaaatttaagtttaggattcgttacttcttgatatagtgtttcttctctcaattcacctggactcttctgtagcacaaactgaaaatagtcaacaagttcatttaataaaaaattagtattcattttttcctcattatagtatctaagtgctcgataacataagagttacctctcttatgttgttctaacttttttattatatcatttctcacactaacgaaatctgttaaaccttcttttttgagtcgcaatgctgattccagtttttcgttcaatcattttgtaggtcattccctctttctttaactcgtaagcaaactgaatttgttcctcagtaaatttttgagggcgtccttctttaaaattagggtcatgtatcttcgcataactcttaccttcttgagttcgatttacaattaaatcacgttcaaattgtgcaaaggcactgaaaatagtaaaaattagttgacctgttggtgtattatcaatcattcctatatttaagatatgaacttttattcctcgattaaatagtgtttggacgatttccaaaacttcacgagtatttcttgctaatcggtcaagtttagtgacaatcaaagtatctccatttgttaatttttggaccactttattaaattctggacgctcaacggttgttcctgtaaatttttcttggaagacttcttctgctccagcttctttcagaacagaaatttgagactccaatttctgttcaaaagtactaacgcgtgcatacccaattttcatattttgacctccattaataaccctaagttgcgagccgttctttctcctttaattataacatacaaaaaaagggctcacaactattaagttatgagctgatttaaatattactatttcacatttaaataactgatttaaaatcacttgttaaattttttctcatatacttctattcatctttttttaagtcttcatcaagtttattcgaccatatagtgaattcttttttcttattaaataaatttttcaaaccttgtatgcaagaaataattaaaatcgtgagggcaattattgcaagcgaagttcccaatgaatttacttctattacaataaacatcaaccctgcaagtgaaaccactagaactaacccaactagtattacatttttttttatctcagttaacattatccatatccctccacgttaaaactgcatccactgctcgtgatgaaaaatcatttacacaatatagaaatgatgaagcggaaataccggatagtccaacagttgctaaaacgctggtaataacaacactaagcgcccctcctgatatcaacccagcaattgctacaaatattgccacactggctcctgctaaaatcgtatttctatcatttctcattgcatccacatcattttcaaaacttctggttaaacttcccgccggagaaatttttatattactaccaagtctcgccctaacatagtaacctccatttttactctctgcataaccaaatgtttcattagtgaagtaatttttacaacttgtttctgaacccatttcagaaaccaatcccttaaaaacattgttttgaggaagaggagaagctttaaagagataatctgttggattaggagtcttcgggttatatagtgctacttttggactcattttaggaagtgtcttcactttaatggcttctggattaggggcactcgccactttctgttgagcaatcacaggcgctgttttcgtcgttgcgcttgtcgtcactttacgccaattatgccaagttcgagcccatttgtattgggtacctgctaagttaaagtaagttgctttagaagaaacatagaatgtatttccccaccacggattccacacttcataataaggcgcatgttttctgatattctgttttagacaataattataaataacattgtataaaatcaatgaggcataatatttatctctatacttggaatagaacgtacttctttgaaaaatagcattacatatagttagtatagtaattatctttgtgcagtatttcaaaaattatgcttgtttataagtaagacactaggagaatgtgtccatgcgtgtgatacttcttctaaattaaacgaagctgttttaaattttatgtcctctttgttaactaaatcatagaccattttcagattttcctgcaagtatttttggagaacacttgctggaaagcttcctattcctgagccaactatctgaatttctttactacgtaatagttgagagggaatattcgcagtattgttagctaaactcccaacagagatataagttatagaactgcctaatctaacttttaataaggaagtcataatagcttcagctggttggccccatagatagtccagaatgatatcaaaaggactctctttataagattcaataatcgcttttataagtttatcattatcttgtttcaagtctatagttacatcagcacctatctcttttagatattctaattttttagagtctcttccagtaacaataacagtttttgctccacgaattttcgccatttgtactgccatagctcccgttcccccagtcgctccattgatgaaaacacaatctccagacttgatccctcctttaaccataagcgctaaatcagaacctactagcgtatttggaatcgcagcagctacaccatcatcaagcccttttggtataatgattcccccctttttctttataatagctttttcagccatcattcctgtaatgcccatcgtataaatacgatcccctgcatcagtaattcctacaccatcagtaccaacaacactaggaagtttatcgaattttgtataatgagtgcctgctgctttagatatgtctaattgcttaattgctgaagcagtaggataaatgagagtttcatcagctttatgtactactggatcaggaaaatcttgatataccggtaattttccatattttgacaagatagctgctttcatgttttttttctcctttgtttctatcactaatcattttatattatattaaattttgattgacgactttatattactattattagcaatgtacaaacacctcaaattatataaaaaaatttttttctaataaaaagaatcattgtttttttataattctttaatattttgtatgaaaaaaacgtacgcatgattaaaaaatagtaatgccataaataaaattgtatgctatactttagaaaaataaggaggatttagacttatggcaaatattgtaattttggatgggtacgaacttaacaacgatctagactggaggaaactaaaaaatttaggaaactgtactttctataatcgtagtcctattaatgatgataaagaagttttgaaacgcattggagatgctggtattgtaattacccataaaactcctttgaatgaccatgttataagtaatctacctaaactaaaatatattggaattatggggacaggatatgatgttgttaatatacagagtgctcacagaaacaatgttgtagttactaacgttccaacttatgcaagtgatgcagttgcacaattcaccttttctttgctacttgaaattacaagtcaagtaggattacataaccaacttgttcataataataaatgggctgaggctcccgatttcactttctgggctaaatccttatatgaattaaaggacaagacactaggtttgattggatatggtcatattgctaaaaaagtagcaaaaatagctcatgcattttcaatgaatgttatcttttataatcataaatctaaaactatacccgaaaattggataaaacaggtaccgctagatgaactttttgagagctctgatattattagcttacatgttattcagactccagatacaattaacatgataaataagagaaccatctctaaaatgaagccaacagtaattattttgaatacatccagaggaaaattaattaatgaacaagatatagctgacgcacttaatagtgaaaacatctatgcattaggaactgatgttgtcagtaacgagcctatccctaagagtaatcctttgctgggtgctaaaaattgttttattactcctcacatagcatgggcacccttggaaacaagggagagattactggaaattacaattactaatctgcaatcttacttgataggtaaaaaaaagaacataattatatgaagcatttacctcaacaaattatattagttttcacttctttgatagttttcttttcataattcagatttgacgattaagtcttaaataagttataatctcaattgcgtaatttcttaaatacagaaataacaactacattggtagactgattaaaaaatatgcttgatgaactgttataaaccttaaaaaaacaaaaataatagtttggaggatgttaaagatgtataaaaaatatggagattgttttaaaaagttgcgaaaccaaaagaatttagggttatcatactttagtaaacttggaatagaccgttcaaatatatctagatttgaacatggaaaatgtatgatgagttttgagcgtatagatttgatgttagaagaaatgcaagttccgttatctgagtacgaattgatagtaaataattatatgccgaatttccaagaattttttatattagaattggaaaaagctgaatttatccaaaatcgagataaaataaaagagttgtattctgaagtcaaagaaacggggaatcatttactgacgattactgtgaaaacgaagcttgggaatataagtcagacagaagttaaggaaattgaagcttatctttgcaatattgaagagtggggatattttgaacttactttattttattttgtatctgattatctcaatgtcaatcaattagaattgctgctttttaattttgataaaagatgtgaaaattactgtagagtcttaaaatatagaaggagactattgcaaatagcctataaaagtgttgcgatatacgcggacaacggagaaagaaaaaaagccgaaaatattttagaaatgactaaaaaatatcgaactgtgggagtcgatttatattcagaagtattaagacatcttgctagagctatcattatttttaattttgaaaatgcaggggttggggaagaaaaaataaattatgctcttgagattttggaagaatttggaggaaagaagataaaagaattctatcagaataaaatggaaaagtatttgaacagctcaaaagagattttctttattctggagcatatactagagggtgaagataggttgtctgaagcattataacttgtcttttaaaaaattcaatcataaatataaggaggtatgatgaatcaaaaaaagttatcattattcggttttttcgcattaaccgcttcaatggttttgactgtctatgagtatccgacttttgccacgtcaaaattacatttggtgttctttttacttctcggaggactactatggtttttgcctgtagcgctctgcgcagcagaaatggcgacggttgaatgctggaaaaatggtggaatctttagttgggtcagtcaaactttaggtgagcgctttggttttgcagccatattttttcagtggttccaaattacagtaggttttgtcactatgatctatttcattttaggggccctctcttatgtgttaaattttcaggcgctcaatacagatccattgataaaatttattggtttactaatcattttttggagattgactttttctcaattaggtgggacgcaacggactgccaaattagtaaaagccggctttgtagttggaatagtgattccatcggttatcttgtttggattggcagcggcatactttatcggaggcaaccctatagaaataccaattaacagccatgcttttgtaccagatttttcacaagtatcaactttagtagtttttgtttcttttattctggcttatatgggggtagaagcctcagcttcacatattaatgaacttgaaaatccaaaacgaaattatcccttagcaatgattttattagtaattttggctatttctttagatgccataggtggattttctgtagcagcagttattcctcaaaaagagttatcattaagtgcaggggtaattcaaacttttcaaacgttaatcttacattttaatcatcatttgggatggttagttaaagtgattgtactaatgattgcctttggggttatgggagaagtgagttcatgggttgttgatccttctagagggatgtttgcagcagcacaaagaggtttattaccaaaatttttacgtaaaacgaatacacatgaagtccctgttcctttagttatgattcaaggaatcattgttacactttggggcgctgtattaacttttggaggaggaggaaataatttatctttcttagttgccatttcactaactgtagtgatttatttggtgggttacctcttattctttattggttactttgttttaatctcgccgattgtaaaattaagctagactcagaatttgagaattgctgaagctagtagattttggagtatatttttctcttacgttactttcgtcaattccgtttgcgtggaaaaaatgctgtagtccaattgttcccaatttttgtttaaggagaagtgggtcagcattcgcaagctctttgatagaagtgattccaagtttgtttaatcgtttctcagttcgctttccaattccccagaaatctgtcatcttaggaattgtccatagtttattagggacatcttcataacggattagggctctcatattatcattgtgcttggcatagttatccattgcaagttttgcaagcaaggggttgtctcccatcccaacagtcacatatagtcctagtttatctcgaatctcacgttgcaagtctaaagcaattcgattcatctgttcataacgatttttaatctcagggtagaagaagttcaatgattctgtgatatccaaaaaagattcatcaatcgagtaggagtgaatctcatcaattgacgtataattggtcagtatatctgtcacttcaattttatagtccacatagagctgcatttgtggaggaacaatccacgtgcgtttcgcccaagactcaataaaagcgacatattgcaaagttggttcagttcgctgtccatgaatgtctgtatgtgttcgataccattgcggataattgaactttcgtgtttctataagaaaaggtaaatcgctggcacgactgacatttttcataccaaaaacttttttaaaggttggactagaggcaagcgttaaccctttagaatgatctgctcgactcatgacacaaagagaagtggtcagaggatttaaatttcgctgaacgcattcaattgaagcataattagacttgacatcttgaaagaggatggcacgacgtggttcaagcgagtagtcaaagtatttatttaattttaattgttccatagttcctcctaaatcaaaaatatcagttttactgatattatatctttttttagagtgaaaaacaataaaaaacacattaaaactgataaaatgttattgttatggaaaatctttagtgattcaacatccttcctatgcttttagtataatagagttaagcatattatcatttgaaagagaacgaggagaaataatggataaatacataaggcgagcctatcaaagaatgaatcaaatgtcttttggaggacaggcgttggcttggttcctttcaataaggttatcagatttggttttaaaaaaatagaaaatatcggtgttcctttttttaattttatcctagggtttatattatcagtgctttttctgactgtcggaatgttgcttcttgactctattgaaaaaataaataagcactttgtccttcgtcacgttttttttaaaatataaaaacacgtctattcctagaggtgtttttatattttggaaacaaatctatggattaatgttttcattgactttattctcccttagggctcagttttctttactgactcaataaaatctttcctataatgataataaattgataaaatatgaataacgaagatcaagtaacagtgggaggaagagaaaagaatggcagaagcaaaatttgaagctgctttgatcaaaaaactagaagcagaaggatggacctatcgtaaagatttatcttatgtctctattaaggtcttagagggacactggcgtgaggtgcttaatgaaaataatgcttataaattaaatggcaaacctttgtctgatgttgaatttggcttagtgattcaagaagttcagaggattaaaacgccttatgatgctcaacttttattggtaggggcagggggtgtcggctctattcctataacacgagatgacggctctaacttagaagtatggaccaatgtcaaatatttagacacaaaatgagctatattttcttaaaataattttcttctttctaatttggagttaaaccattgttggcggaatgaggattataattgttataaaattgttcgatgtattcaaagcaagagagttgaacttcttgaatggagtgataagttctgcgattaatttctcgatgtttaagatacttgaaaaagacctcagtgacggcattaccataaggatatccaggcttggagtaagaagcaagcaattgatgctcatctaataactttctaaaggaagctgatttaaagtggcttccatgatccgaatgaaaaataattggttccttaggtttcctcttatttatagctattttctccttttaatactttcattatacggaaaaaaatgcgaaaaaacaatgtattctatgtaattcaaaaagcaaaaaaacgaataatcaaaacattgaaatgaccagataggacctatctctaaaagtgaaaaaaacacatttagtgattgaactactgtcaaatttatccaataattacttaatatcctgattttggttaggattttttatgttatactaaaagaaatatcagatatagaaaaggtgaattatcttatggaatataaagtaggagaattagtattattaccagaaacaaaatatcccggggttattggtagcgtgatttctgaaaataaatcagggatattggttaaatttaacggagcacaacaactatattttaaaaaagcagaccttcaaaaatataaaaaataaaaaatggaaattaagctcacttcctaatttgagcaaacttttatataaaagtttataattgctttagactaggagaaaaaaatggaaataaaagagttacttgagagaagcattgaaattcgtaagagatatcatgaattagaaataaaaaaccatggtgaaaaatggagtgtagaagaagacctattggcactttctaatgacatcggtaatttaaatcgacttgtaatgactaaatttgaacgttactatgacgaaacgccctatactttagaagggaaaatagctgaaaatatttggtggttaatcgagctttcagacagactagatgtcgatattgaaaaagagttagaaaaattcttgattgtaaaagaaaaactttaactttggtcagagtttttttgttttctttaaagaacagtggtctacaaaaaaagtagactgggaaaatgaaggagttatattcaaatcatcttcagaaaattattaaaaaataaagtgataaattagtatgtgaaaataaattcatagtttttttacatactatgtggacgcttctagttgagtgatttctaattaagtttgatctgctataatgaaattcttaaacatgtctgtcagcaaattgctggcattttttacttgtgtgaatagtataaaatcagaagggatattgataagttcataattatatattatgaacttttttgtaagaacctttttattgacaaagtttgctgacaacttttgtctacaaatttaaaataactgtatttgttttgttactcaattggtttgtttttgttgttttcaggtaaaaatgatataataaattaatgaattggaggattacccaagtctggctgaagggaacggtcttgaaaaccgtcaggcgtgtaaaagcgtgcgtgggttcgaatcccacatcctccttaagcacctgtccatttttaggtgcttatcactattcttcctatatgaagatttctttagatgcccgccagatggtgggttttcattttaagttccaaaagggatacgagatttttacattttagagggaattaaaaataaaaatatgcctcaaatattatataatgaaagaataaaaaaataatgaggtttgttgatgaaaaaaatttattttctttgtacgggtaattcttgtcgttctcaaatagcagaaggatatgggcatgtatttttaaaggattgggaagtccgttccgcaggaatagaaagacacggtttaaatccacatgcggtaacagtaatggcagaagatggcattgatatttcggctcaaaaatcagaattaattgatatgacttattttaatgactgtgatttaattattactttatgcggtgatgctcttgataagtgtccaatgattcctaaatcagtgagccatgaacattgggacttacaagatccagctcgggttgttggaacagaggcagacattttaacagaatttagaaaaactagagatttgataaaagaacaagtacagaacttaagcaatatataaacctatccaatgagttttagactgatttccttttatgtataaaaatgacgtctttaaggcgttttttagtttgaaatttatgaaatagacaatatgatataatctaaagatatgaaaataataaaaatagtgttttcactagtcattttgttgatgctcacttgcttaggtggcttatattatgcttttaaaattgagccctaccgattagtagttaatcaacatcagttggaaaatagaagttctaaagaaaaaataaagattgttcagttatctgatttacatataaaaaaagtatcaaaaaataatccgcaattaaatattaataaaagaaaaagtttgtgttggcaattatttcgagcttttgaatacatacattcaaaaagtatttttcacagagacctgtcacttggaaacgttcttgtgaaagtccatgatgacgatacttgtatcataaaagtatgtgattttggatattttaaggagaaggagagcactctaactcggcaagatactctttttgctggtagcctgaatgacccagcgttaagattgttagggtttgataagtataatgtacagcatgaaatatatgcgttaactcaagtgatattttatattatgacgggtaagaaaaacatagagaaaataaatcaagcatcgataaaatcatttcttgagtttggcatgaacagtgatttgctgaatagagctaagacgctgcaagaattaaaagataagttttcaataacaaattgggaatcataaatgtattagcatggaagtatatttacatctatcgtgataacttgtcttttcaagaaacttagttttaactttttcttttgataaaaaaagcgataatgagtcagtcattgtcgcttttactattttaatatcttatggtgtaagtgtttctaattataatcgagattataaggcttggtatataattataacaagtgtttttttggggcatctatactacttgattttaataaaaagaggcagttagtaatattttttcatttatctaggtttatactactatgtcattattattttcactatctttttcttcaattttaaactaaaatagatttattaaaactctttgtaactgaaccgtaaataatattattggttttagatttactagaattctaactcagaaagttaagaaagatgaaatttaaaaagaaaaattatacctcacaagtagatgaaatggatagtggttgtgctgctttatcgatgattttaaaatcttatgggacagaaaaatctctcgcttcattgcgtttacttgctggtacaacaatcgaaggaacatccgctttggggataaaaaaagcagctgaagagttaaatttttcagtccaagccctaagaacagatgcaagcctttttgatatgaaggaagtcccttatccttttattgctcatgttattaaaaaccaaaagtatccacactactatgtgataacaggcgcaaataaaaattcggtattcattgctgatcctgacccaatcgttaaaatgacaaaattatcaaaagaagtttttttatcggaatggtcaggcattagtttatttctttcgcctaccccatcttatcagcccactaaagaaaaagcttcttcattactatcttttatcccaattatcacccgtcaaaagaaagtcattctcaatattgttattgcctcattcattgtaacgttgattaatattctagggtcttactacctccagagtatgattgacagttacattccaaatgccttaatgggaactttagggattatctcagtaggactattattgacttatattatccaacaaatattagagtttgctaagattttcttactcaatgttctttctcagagattagccatagatgtcgttctttcttatattagacacatctttcaactccccatgtctttcttttcaacccgaagaacaggagaaattacgagtcgtttttctgatgcaaattcgattttagatgctatcgcttcaacgattctttccctctttttagatttaaccattgttctaatgacaggagtgattttagggcttcaaaatatacaactctttcttctcgtacttttagccattccactttatatcgttgtcattatcatttttaacccactttttgaaaaacaaaatcatgaagttatgcagaacaatgcagtactcaattcctcaattattgaggatattaatgggattgaaacaatcaaagcactcgccagtgaacaagaaaggtaccaaaaaattgattacgaatttgcgaactatttgaaaaaggcttttgttttacaataatcagaggccattcaaacggcaattaaaacaacggtacaattgacattgaatgtttttgttttatggtttggtgctaatttagtcattcatcaaaaaataacgcttggacaattgattactttcaatgccttactttcttattttacgaatccaatcaccaatatcattaatctccgtagccttaatttgtcattcaatttagtctttcggccacatcgtgaccgcttgtattcggcatctgtttgggccacttcggcctggtaaggttcacatcgagctaattcataagaaattgtggcaggtgatcgttttaggcgattgctcatttggatattggacaggcctagttcacaaaaggtttcgattttaattcgttcagaataggttatactagacaaaagatcagctcctaaaagatgtgtttgtggtaaacaccattttaagggaagctgatcttttttgtccgaacagcgtcggattaattttacaatctacctattaaccaaaatatcaaaaaaagcgtatcattgaaagcgtaatgattaaaacgttttttacaaacgttatagaggggagaagttaatatggacttagtcgaagaactagtcaatgttgttggtaaaaaaaatgttattactaacaaagcaaaatctttacgttttaggaaagggtaccgctcaggtaagggcgatgcagttgcagtcgtatttccaaccactttaatggcaatgtggcgtgtgcttaatgttttgcatgataacaatattatcattattatgcaagcagccaacactagtttgactgagggatccgtaccagccccaggttatgaccgttctgcagttgttgtgaacggcatgaaaattaaagatttacagttaatcaataatggggaacaagtactagcattccccggtacgacactgtttcacttagaaaatgaattgcgaccacttaaacgtgaaccacattcagtcattggctcatctaatttgggtgcatcggtcattggtggtattaacaacaattctggtggtgctttgatcagaagaggtccagcttatacagagctatcattgtatgtttggattgatgaacatgacgaaatgcacttagttaaccatttaggcattgatttgggcaaaacgcccgaagagattattactaatttgcagaaccgcaattttgatttgaatcaagtaccagctactgaacatcatggttcaatgttccatcatgaacaggttgtgcgtgacgttgaatctgataagcctattcgatacaatgcaaatcctaaagaattgtatgaagtatctggatcgtccggtcacgttgcggcattggctgtccgcttagatacattcccaatggataaaaaaacacaaatgttttacattggaacgaataatcctgatgagttggaagatattcgtcgccatattatgacgacattcaaagaattgcctgtttctggtgaatatatgcataaaaatgcttataaattggccaagaaatatggtaaagactcactaattgtgattgaaaaaattggtacgggtcatttgccccaaatgtttgcgctaaaagcatggggcgagcgctttttgaagcacattccgtttttcaaaccttatttcccagatcgtttgcttcaaacattaagtaatttatttcctaatcaaatgccaaagcggttagatgattattacgaaaagtacgaccattacctacaattgaaaatggctggtaatggtattgaagaagcgcgagagtatctcaaatcttattttgacaaagccagtggcgactactttgaagccgatgccaatgagaccagtaaagcggaaactcaccgctatgtaacagctggggttgcgattcgatatcaagaattaaaacaggatagtattgacattttgccactagatatcgcgttggcaagtaatgattataagtggttcgagcatttgcctaaagagattgaagacaaaatagaacacaaaatttattatggtcacttacttgatcacgttatgcaccaggattatattctaaaacctggcgtcgatgcgcatgaacttaaaaaagaaatgcttaaaattttggatgagcgtcacgctgtttatccagccgaacacaatgttgggcatctatatttggcagcaccggccttaatcaagcactataagaaaaatgatccaactaatagtttcaaccctggcgttggtaaacaaacaatgtctaaatattggggcgaatactaaaataaaaagtttgttaaaaaataaccgttatcgtcatttgtcgattctgatgtgcaccccaaaagttagactttttatccaagtaggaaagtttagaggtatcatatgaaactacttaataatttgttgactagcttaacacaatatgagaatgaaatgattcaaattaggcgtcatcttcatcaatacccagaaatttcttttcaagaaaaagaaacatttaagtatattatgggcttttataaagaacttgactgtgaaccaaaacttatcggaaagggatttggaatcatcgttgatattgaaggtggaaaatccggaaaaactcttgcgttgagagcagactttgatgctcttgctatttttgaagataatgatttaagttttaaatcggtcaatccaggagtaatgcatgcctgcggacacgatgcacatactgcatatttgatggtacttgctagagaactagtaaaaataaaacaagaacttccgggaagagttagaattgtccatcaaccagcagaggaagtatctcctggtggtgccaaaggtatgattaaagcaggagctcttgacggtgtcgataatatgatcggggttcatgtgatgactacaattaaaacaggggtcattgcctatcataataaagaaactcaaacgggacgttctaatttcaccattacaatcaaaggaaacggaggtcacgcttctatgccacaattaagtaatgatgcaatagtagccgctagttactttgtaactgaactccaaacagtaatttcaagaagaatagatccatttgacatgggtactgtaactattggatcatttgatggagcaggaagttttaatgctatacaagataaagtagtgttaaaaggggatgttcggatgatgaaagaaacaactagaaaagtcatccgagaccaagtgaaacaaattgctaaaggcgttggagtaacctttggggttgaagtgattgtagattatgacgataactatcctgtactctttaattcagaaaatctcactcactttgtagttgacagcttaaaagatcagaatatttcagaagtcaataatatagtcgatttaggaccacaaaatccttctgaagatttttcatattatgggcaagttgtaccaagtactttcttttacattggtgcacagcctgaagacggcggaaattatccccatcatagccctttatttaaaatgaatgagaaaagtattttaatcgcggctaaagcagttgcaactgtaactataaactatctatttttcaataaaaaaatgtagatttacaaatagcaagatttgtagctaaagttgcttcttcgttatttaataaacttataaaaatatttctatcctatgtccagaaaaaggtggtttttttcagataactttgtttttgccttatcaattctttctttcattgtcattgattttttcggaacaggagcaacatatttttctaattcaatatcaattttttcaattaattcttttgcggtcgcttgaacatttttcatcacattttctaattgttcatcagaaataatgaaactttctccataaactatttcatattgaccatcaccatatagataacatccatcatttaatgtaataaatgctctgccaaaactatctgtataagtgatttcttcaaaaagtctcttaccatctaaatcttcgttttttattaaattataatgaggcaaaatctgtgattttgttattcccaaaccttttaaaaatctcttgtagtttgggtctaaagattctccttgtagttctggttgagcataaacttcttccgagccattcattgaacctgcactaaaaccgataataatcttatttgaagtttttaactcattctttaaattaatttgttgaaaaaatatattttgtgttggaacatgtcctcctgcaagtatgacaacttctgcttcgcttattaactcacttttttcttttgcatttctattatctaatcctttaaaattcttaaatttaaaacctgagttaaagaaacaagtcttcatttcttctgcaaattttgaagtccagttgaaactcgtgcatatccgatattcaaatttcagcacctccgttactttaatcgtattataacttaaaataatatatataactgaacatagattaatttatgaattaatgaacactaaatataaaagaaatagatgaaaattgtagaaaatataaattctttaatatctattctaatatacatacctgtttgtatacacttgaatgtatataaacagaacgaaataagatgaaggcaaatcacaaccaagaattgaactaggaatctcttacgactcaataaagacagcttgccaagacattggtaattgccttattggagatttagcttttatttatgagtcaagcgttcacggtttaagagagggaggagatataatcattaaaataaaacaagcacgactagaaaaactaatctttggaaaataaaatattatgtaagaaaaagatatcattgttttttaggctttgtcaaaaagatgtatataataccgtattttatttaaatataacatttacttgacaaatgatacaaattatgatataatagtagtatagttaatttagaagaaaaattcggctattaactaaaaaaactaaacataaaactaaacataaaactaaacataaaataaacgtaaaatattttagaagtccagccattctttggttagtcttatataaatatatttttttgggttattttatgtttttttgtttctataatttctacaataaaaagaaagcaggtaaaatatgacaacttggacagacgagatgaaagaatcagtaagtaaacaaaggctcaatcccttcctagttttagattatataaatgagattgtaggtgtataccgtaatagtaaacaatgtgaaagagaaagtgaatttggatttagttctcttggaatccgtcaagcactcaacaaaattcacaaaagtcataaaggattccgatttgaaaaaattagtattgaactctataaagaatataggtgaagaataataaattaaattaataaaggagaataacaaatgaaaaaatcaggactagttgttaaatcatatacgctttatgacccaaacaaaaaggtattaaaatatcatagttttatttttaacgaagaacaaaaccaatctattaataatgtaattaagaaatacagaaaaaataatggtttaagactaattgattgattaattatgtttaagtttaaaagataaggtcaaaagagacacggtttgaaaagctgggaactatgttcccctgtcgcttttccagcaccgtattttcgtcctcacatgagcaagctcacgttcgaacaaaaatgacaaatttgtttattttacatttaattaataataaataggtgagcctttccattacctaacaagaatactctgtaaggtaactgacaggcacacctatttaattaaaacttattaatttagaagactaacaaaatttgtcctacgaatatgagcggtcgtagactgcgaatatgagtagacgattgacagaaaagcgcccaagggctttagcccagcttttccaatcgcaatcttttgaccttgtggttataaatataaaagaaaaaagtgtaaaaaatttaggaggagtaaatttatggaagaaattaaaaaaggaaaaattttagaaattacagtaaatgaattggttgaaaaatacgattggttgttgacagagtccagtgttcaatcaattaaaaaatatggaaaaatgcaaaccaaaacaaaaaaatcagtaattaaagcacttgaagaaaagtttgaatcagttgaatatatagcaggtaaaaagaatcaaaaagcaaaattcattttaactaattataattgtaatacagaggtttataatccttataaaaataatggtggtcagcctctagattggacaaatgagattaattgtattcaagaactaattaatcaagaggtagctcgtaatcaggatgaattacgtaaaggatttacaatatctagaattttagctttgatgttggggtttggaagtgattctgaatttgataaggctaaaaagaaagatatcttggagaatgcgataaaagaaagctcgattctatcaatgttaggtaataaagatgactattatggtcttaaagagactgttaataatttgataaggaatcaaagacatatctatgtggcaatgattgagaaagaaatcaaaaaaactaatcatataattagttatttagattcaaatggagaagagattgaccaaaattatagacaagccattccaaacgtctagacaagaatttctcttttgatgcatcatcaggaaaaacttgattgatgtaacctagagctcgtaaccaagaaatcataaaatctctgttgaccgttttacttaaacttaaattatcattgtctcgattcaaatatgtggttaatttctcaccctgagtaatttttttggaaaatctcatggcttcataaaaaaagtcacatcatcggctaccctttgacttggaaaatgaagattattgttctcaattaactttctccttaccatgataccctgaggacccagccattcataaaaagcagcaggaagttcttgtatgtcacggtctatcttattcccatcgaaaaagtaggctctactcttaaggctaagtttctcatttacactttggactataccgaaaaatcccatatcatcacttgatttttccagagtttcagacatatactgaagagcattctcatcataccagtcatctgcatctaaaaacacaagatacttcccacgcgcatttattagtccaacattgcgaggcccatgtgcaccaccggtattttttgtaagttgataaaattcaatactgttatatttttggatatacttttgtacaatttttgctgaattatcagttgatttatcatcaataaaaagtatttgaagtttttctagcccaatactttgatttactaatgaattaaacatcttttccagatagggttcattattataatttgcaataataacagagactttaggtgtatcaaagacttttgtagaggagctttttttataaattggaagattaaatttccatttttcgttatttagataattataatgatcatattccatttgtaattcttttgaagacattatttttaacccttatttaatataattcgtaaaatgattacgaagttcgtgtcgagaggctagtatccataaacctcttctctataaagtaaagaaaattaaaagatagttcttcttttttcaaaacaaaagaaactggaagtttatattaagatatctttttctattctctttaaattgttgtttctgttactaatccttcccaagttctacatcatttcaaaacaatatagtcatttactgaccgattatcttgactagcataaattgcttgcccgtttaatgacatttgactggagccgcccccatccattacgagagcaatttctaaatgaagactttcaagttctgacataattgccggataacctgtattggtatctgagataataagatagatgttattgtctttatcatttcctaaaaaagaatgaatttcccaattaacagttccatcgcttggtaaacttttcccattttttataagaatggaaccaaaactaaaactcatatcagcgcctttttttaatatttcacttgctggtgtagttgaatcataaacctctgatgaaccatccttattaaatacaaaagcatatttggctctttggtcagagttccaatctttgaacagctttccattgttaatttgaaaacccgtgattttcccagttgtcatgttaaagccagaagcattcataattaagctatctggatacttactgaccacttctgtcatgctcaatacaggactatcagtcgaagttgcagtttttagaacttgcggactatgaactttataaattttaaaatttcctgttgaaagatctgtaaatttttctccacttccttgagattttacttgaagccaatctgatacgccagtattttctactggaacaatcgcttgagccttttctgtagaactttggctttttgatatctgagaacttgaagaaagataaccatttgattcagaagtttttgtaacctgttggctggtcgttggaggaatatatgtcgctttatcaaaaatgtattttcctaccattattaacaaaataaaaaagattaggatgagtgatgaaaccaatatttttttcggaaaattattctttaccatttgcccctctttctttataatgattttctagtctaatttggattaaatctttcatattatatcactctaaattttatttaattaattatttaatttcagaaaggtatatataaatcatggcgcaacaaattgtcctacccatcaaagactccaacgtcttaaagatggtacaagatacacttctcgatagcttctgtacttcttggcattttagaaaggaaatcttctcatgaaaattcttgttaccggatttgatccctttggcgacgataaaattaatcctgcgattgaagccgtgaaacgtttgccggatgaaattgctggggcacaaatcgttaaattggaaattccgacaaagtttaatgtttcagccgatgtcgttaaagatgctattgccaaagaaaagcctgactatgtgttgagcattggtcaggctggtggccggtttgaactcacgccggagcgagttgcgattaacttggatgacggtcggattcaagataatgccgggtatcagccacttaatcacacgattcatggcgatggcgagaatgcctactttacccagttaccaattaaggccatggccaaagccattcgggaagctggtgttccgtcagcagtctccaacacagcaggcacttacgtctgcaaccacattttttatcaggtacagtatatgcgggataagatgtttcccgatattaaggccggcttcatgcatattccatttttgccggaacaggttgtcactcgtccggaaacaccagcgttgtcattggatgatgatgttttaggcatcactgccgctatcaagtccatcgtgtcccgtgacggcaaaggcgatatcgaaacgattgaaggcaaggatcactaaaagcctgtttagtgtttttggactattatcaaataaatagacataaaaaagaaaagcgttctaatcgtttttccttttttatcagatgttcagaaaatggtcattttctgaacactcttcttttcttattaagattattaaaatcatttacttttattgttcataaacccgtaatttattctttgttcatttatatacacatttctaagttatgatacaataaattaaaatgaaggaaaaaaatgaatatcggatatgcacgagtttcaactggacttcaaattgcgttaaaacaaaaatctatttaaaacaaggggagtgtactgaacttattgtttatgaaaacggttgaattagaaaagcgcctttcaaaaggtgctttttgtctttctagtttgaaaaatatagtctatttttttattcttcgtaactcattatatatacttacaatcaaggctattactaataagcattcccatattttactaaaaatatcttgcccataaaaaatactgaatacagaaataattaatagagggaattgccataatagtgactgtatccttacattttttcttttctgtatcgaaatgattgtagcaattaatcctaatataaataatcaactagcaattcgggtctttattaaatactaatgattgccttaaaaattgctttttgagataattgctaaaaaagagaggattctcaaatggataacaaagatatagagctgattcaacaaatggaaaacaaatatgacacttttatgccagtcttaactaatttaattgatagtgttgaaaaatttaactcaatttacaataactatattgaattaagaaatttttatggtagtgaaaaatggtttgaatatatggaaattgaaaaaatcccagtaaaatgtggtgttttaacagaagaccaattatttgatatgattagtgatcataatgaacttcttggagtattacttgacctaacttcaaaaatgtacaaaaatttttaaaaatatcaaagattcaaatatcttaaaaatggtgcaggatacactacttgatagttttcgtgctggtcgtcgcaactatacaattttccaagttgggaaagcgaccttgttaagagtaagtgatgtcatgaaattaaagaaaacagatgtctttaatcttgatggaacagtcaaacaaactgcatttattcatgatcaaaaaacaggtaagggaaatacgttatatttaaaacctgtccaacaagatttaatgctttatcatgcatggctatttggaatttggaaaaatgggggggtactacgaccccccctatgtggtaatttggtaatttggtcaaaatgccctctagcccagtgataacaagggtcaattttgaccacggaatttcaaaagatttggtaacttggtcaaaattgatactaatatatatcaaaacagcacaaaacagaatattatgatataataagatatactgaaatttgaaggagtaaaaaatggcagaagagaaaaaaagagttttgctaactttgtcgttggacaaagcagaagaattagaaactatatcaaaagaaatgggaattagtaaatctgctcttgttagtttatggattgcggaaaattctagaaaataaaaaaagagccacggcgaatggctctagtatatttacggttaggaatattatagcatatgacagaaaaaaaactagaaaaaaatgacccagttagaaactggagttgggttgtttatccagagtctgctcctgaaaattggagaacattgttagacgaaactggagaaaaatggattgagagtccgttgcatgataaagatattaacgaaacaacaaacgaaccgaaaaaggcacattggcatataataatttctttttcaaataaaaaaagttataagcaagtattaaaaatttctgaaatgttaaatgcaccagagcctgtaaaaacaaaaaatttacaagggtcagttcaatatttgtggcacagaaacaatcctgaaaaatatcagtataataaaagcgaagttgttgctcataatggctttaaatacagacaatatttaacagatattggagttgatactgattctattttacaagaagttatagaatggataaaagaaactggatgttctgaatatagagatttagtcgattatgcagtatcagaacgtttcgatgattggtttcctacagtcagaagtcaaaccatatttttaaattcttatttacgctcaaatcgtcatagtcagaaaaaatataatccagaaacaggagaggtgttatgaaagttgaaattatagctagtgtttttagtgaaaaatcagttcagaaaaaagtaaataattttattgattatttaaatgacaataattttgaagtattggaagttcaatataggcctacatttttttattgctctgctatgattgtttatcgatagttttttatacagataagcgtgcgacgcttgctctttccgaggaggaagtcatgctgacaagcacggcagagcctccgcatgaaatgctctcaatgaaattgccggcggagcttttttgagcttgtgccacttgcgaaaaaacaagaacaaaagagacaggaaactgtcttttttttgcttgcttggggattggggcaacgccccaaaaataaaaagaatcgtctgaaacgaggaacaaactaaaatgtaaattttaggtgtgatcgagtggaagatgattactttttaccgtaagtgtatacacacatagtaagctcgctataatactttataacgtttttatttacatgagcaaagcgagtttttccaacacgtttaatctaaaatattggcaatttataccatgattttcatggtatataagtgcgcccttaggaaaataatttgaatatatttcagattttaaatctgactgctcctgtcatcgagcagaccgatgaggaaaacaaaaagaggactaaacaaaaaagtttagtcctctttttgttttgaatagttctagaacgtcatattttgcgttttaagcaattttgactaactaggcggggatttttacttagaaattattcaaaatgtctgtaatgtgcttaaaatcgtttctaggagcttttagcgtttatttcgttcagttatcggcataatcgttaaaacaggcgttatcgtagcgtaaaagcccttgagcgtagcgtggctttgcagtgaagatgttgtctgttagattatgaaagccgataactgaatgttgaggagcaacgacacaataattacggtaaatcatggacagtaaaagttgcagatacaagcaaaatcgaaaaaggaaagctaacagctttcaataaaaatcaagaagattttccagaagaaatgagtaagagaacggtcatcaaggcattactcaaacccattattaaatcttatgcagagccaaccagtgctgcaacattggataacaacgaagaaggaacagtgattaaggaagcagaagttcttgatgatgattttgttcttgaagaggcagaaacgaagcaagtagaaactccaaaagaagaagttcaagcttcagagcaaactgaaccatcagaaaataacgaagaatcaattgccgaagaattaccattgttttaaaatctatgagcaaactgcagtcctcaaaaatcctgagcagtagaattagaaataattcaactttaagcaagactaccttgggcggtagcttcgtatttagtcaaagctggagggtggcggaacgagccgtaaagtcaatgagtatttagtgtttacacataaccactcattgccagcttttaattgaaaaataaaacttgaaataaatatagaggaaaggagaacgtgtggcagataacaagaagtattactacatgagattaaaagaaaacttctttgattctgatgaaatgattatcttagaaaacatggataacggagatgggattatttacagtaacatcttactgaaactttatttaagaagtttaaagtatgaagggcgcttgatgttcaatgagagaatacctttcaatgcacaaatgctttctacgattgtacgtcatccagtcggtgtggttgaaaaagctcttaaagcgtttgttgatttaggcctagttgaagttatggataatggagcaatttatatgctagatattcaaaactttatcggaaaaacaacaacagaggctgataggataaaggcttatcgttctaaaattaataaagaaaaaggtctagtttcaaatgatacacaaaagttagtacaaatgtacgacaaaagtacaccagagttagagttagagttagagttagagaaagagatagagaaagagatagaagtagaagcaagcacagctacttcaacaaaatctgattttcaaaatctaattgaactctaccaaacaaactttggaatagtaaaaccaattctttatgatgacttgaaagctgatttagaagattatggccttgagctaattattgaagcagtcaaacgagcggtaaaaagacaacgtgagtatgcctatgcacaaggcattctaaaatcttggaatcgttcaggaataaaaacacttgagcaggcaaaagctgaggaagtgagctttcaaaataaatctcaaaataaccagaataaatttcagcagcaaaagccagtcaaaaaagctcctgactggtctaatcctcaaactaaaaaggatagggaatatatgaccgatgaagaagtggaggctttaataaatggcttgggaaatccctaaaagtgcatttgataaagaacttgcggaatactacttaagttttgttccgggagtaacttatcagcagtttgtaagatacgtcaaatgggcccatgaaaaagaaattgtaatgaacccagtgacctttattgcatcagttaaaaaaatcagcaatgaagcagcaaccgaattaatgatatatggagaagcgagtgaaatttgaatttgaattggataaaatgccaactactcagcagcaaaaaggcattaaaaaagtgaaagggaaacttcaattctatgaccgtcgtggaacaaacaactacagtcttaaagctcaactcatgaaaaataaaccgaaagagtgctttgaaaaaaacgttcctttgaagctatccgttacttttttctacgcaattaagcaagaaaatcgcgtgaatccatttagtaatcgcttgttcaagttcttcaaatgaattgaaaacatgaccaaactgtcgtcatcaaatacggcggcaatgccatgattgatgaaaaagtgaaagaaagtattctaaaagatattttattacttaaaacagttggaattaaagttgttttggttcatggcggaggacctgcgattggagaattacttgaaaaatatgaacaaaaaagtcaatttgttcaaggcttgcgcgtgaccaataaaaaaacagctcaattagcactaacagctttagctgggaaagtaaatacaagtttggttcaagatatcattcgcttgggaggtaatgcgattggtgtttcaggaattgatggtaaattaatagaagccaaacctatttctgaagatttaggctatgttggagaaattacggcgattcatccggaaatcattgagcgcatcaatcaaacagatgctgttccagtcattgcgtcagccgctattggtcttgatggcgaaatttataatgtcaacgctgataccgccgccagtcgaattgctggatcgctttgtgccgagcaatttattttattaagtgatgtacgcggtttatatggtaattttcctgacgagggttcatttattgatgaaattaatctgaccaatctggaaaagttagttaaagagaaaaaaattactgacggcatgattccaaagatagaagccattaaatacgccatgcaagaaggtttgggacaggccgtattactcgacggacgagtgccacatgctttattgctagaattatttactgacagaggtcaagggactttgattaatcactgacagatttactgacgatgtaagcaaacaaaggagagagaatgtttcaaggaagaagttttttaaaagaaatagattttagtaaagatgagttgttatatctgattgactttgccattcatctaaaaaaattaaaaaaagaacatattcaacataaatatttattggataaaaatattgctcttatttttgagaaaacctcaacaagaacaagagccgcattcacgacagccgccattgatttaggggcgcaccctgaatttttaggaccaaatgatattcagcttgggaaaaaagaatccatttcggatacggcaaaggttttgggaaccatgtttgacggcattgaatttcgcggctttaaacaaagtgatgtagaaatcttggcgaaagactcgcaagtgccagtctggaatggtctgactgatgattggcaccccacgcaaatgttagctgattttatgacaattaaagagcattttggttatttaaaaggtttgactcttgcttatgttggcgatggtcgcaaaaatgtggcccattcgttgctggtgacaggggcaatttttggggtcaatgtaacaattatctcgccggaaagtttgcaaccagctcatgaaattcaaaaacttgctcgtaattatgcgctaagaacacacagcaaaatcagcattcgttcggatttaaatggtcttgaaaatgccgatatcgtttatacagatgtctgggtcagcatgggcgaagaaagccaaacagccgagcgaatcaagttactaaaatcctaccaaatcaatcaaaaagtggtggataaaattataaataaaaactttattttcatgcattgtttgccaagttttcatgatttgaatacggaagtcatgaaagaaatcaaagaaaattataatcttaatgaattagaagtcaccgatgaagtttttaattccaaaaattcagtcgtttttgagcaagccgaaaatcggatgcacacgataaaatcagtgatggcagctactttaggggatttatttattcctaaagtgtaaattttgtcaataaggataaaatgatggaaaatactttgattgatttggaatttggaaaaaaatggggggcaaggaagcgaattttgcttccgtactacgaccccccattaagtgccgagtgccaatttttgtgccaaaaccgctctatcccaactggctcaagggtttaaggggtttttcaatcgccaacgaatcgccaacgttttcgccaacgttttttacaaatctatatttaagtagctttattgttgtttttatgattacaaagtgatacactaattttataaaattatttgattggagttttttaaatggtgatttcagaatcgaaaaaaagagttatgatttctctgacaaaagagcaagataaaaaattaacagatatggcgaaacaaaaaggtttttcaaaatctgcggttgcggcgttagctatagaagaatatgcaagaaaggaatcagaacaaaaaaaataagcgaaagctcgcgtttttagaaggatacgaggtttcgctacttgtttttgataaggtaattatatcatggctattaaaaatactaaagctagacattttggatttttattatatcctgactcaattcctaatgattggaaagaaaaattagagagtttgggcgtatctatggctgtcagtcctttacacgatatggacgaaaaaaaagataaagatacatggaatagtagtgatgttatacgaaatggaaagcactataaaaaaccacactatcacgttatatatattgcacgaaatcctgtaacaatagaaagcgttaggaacaagattaagcgaaaattggggaatagttcagttgctcatgttgagatacttgattatatcaaaggttcatatgaatatttgactcatgaatcaaaggacgctattgctaagaataaacatatatacgacaaaaaagatattttgaacattaatgattttgatattgaccgctatataacacttgatgaaagccaaaaaagagaattgaagaatttacttttagatatagtggatgactataatttggtaaatacaaaagatttaatggcttttattcgccttaggggagcggagtttggaattttaaatacgaatgatgtaaaagatattgtttcaacaaactctagcgcctttagattatggtttgagggcaattatcagtgtggatatagagcaagttatgcaaaggttcttgatgctgaaacgggggaaataaaatgacaaacaaagaaaaagagttatttgctgaaaatgaggaattaaaaaaagaaattaaggacttaaaagagcgtattgaaagatacagagaaatggaagttgaattaagtacaacaatagatttattgagaggagggattattgaataaataaaagccccctgacgaaagtcgaagggggtttttattttggtttgatgttgcgattaatagcaatacgattgcaataaacaaaatgatcgatgctgtttggaaaaaaagaaaaagtgattaatttatattttatttatggcgctaatttattagcgctttttttgttgtcggctagccgacttctgatacatttttttaagcacaaaaaccacccaattttggagtggtgtgtaagtgcgcattgttcgaaaaatcgaactatgatttatttttgcttttgtatttatttttcatcttttgggttttggttttgttttttattgctatcggagtttatttgctttttaagggctctatttttcgttctacggcatttttataatttgccaatataatttatcgattttttattaaaacgtctcaaaatcgtttctgagacgttttagcgtttatttcgtttagttgtcggcataatcgtcaaaacaggcgttatcgtagcggaaaagcccttgagcgtagcgtggctttgcagtgaagatgttgtctgttagattatgaaagccgataactgaacatcaagtgttttgaatccatcagattggattgctgagaagtgagcgaacaaatctttaccttcttctgaagtgataaagccaaatcctttatctgcgttaaaccattttactgttccatttgccataatatttatttcctttcgacaaaattgtaaatctcattttgcgaaaagtgaatctataaaacattttactcatgacaaaatttacttcttcataataacactaattatagtcaatgtcaaactactctccattaataaaatccatgtcgtagtgacatggattttatgaactgtagggaaagcaactaatccttccctcactcagtataacattttaattcgtttttgcaatagcaataaataaaaaagcaaaggacaccccatgctttaactcatttatcttttatgtacgtttgaagcataacgtccacgagacgtcattttgatatcaaaagtaaccttttgaccttcatcgtattttttaaaatcatttccttgaatagataagagataagcaaacacatcttgcatatcatctgccataataaaaccatagcctttgtcagcgttaaaccaatttattgttcctttattcatgtaatacatcctttcgcatcatctgtaaatcctattttgcgaaaaagtgcattcctaaaacatttaaactcgagacaaaacctacctcttaatagtaacacctattcttaccaaagtcaaattggtctatttaaaacttattgattttcttgtgattccccagattttcatgaggatttgctttagcaagtgtcagggtttctctatcaaccaccctgacatcatggttttctaattcaacaactagtgcatacttatagagattaatatctccagaaacgactgttgcttgttccccattagataatgtaattttatctcctgttttcatttttcacttccattctaggagctgcctatttcacgaaaaaatttttacttaagggtgagttttttataagaaaaataagggctccctaaagcccttaaaatattgcgggaataggatttgaacctatgaccttcgggttatgagcccgacgagctacctaactgctccatcccacttcgcaagtgtaacactaatatcagttaaagtcaatttaacattaggattcataaattatttaaaaaatgtgttaccttatccgaacattaagttatttcttacattagtaaagctatcactagatatatcactaaaatacttactacaaacccaaaaaacagtaggcctatgatcgcctttttttctttatttttattcgttagatgctccatactcttattatcaaactgatttttgtttatagttacacattatttaaaaaagctacccccatttgagtagctaatgatgaaggtgtggtgctttcgctaaaccacccatgagctaagtatatcactttaattcgaaattacaatatcaaccaaaaaaatagaaaccaattttggcttctattccacaacagatactgtaatctcataaaattaagtatagcaccttgttaagctcaatactgattattagtttataaagagaaaaacatatagcttaaaagcatcaaacaaacttaacataataaaaagtcattaattcaattcttaatgactctttaatttattttttgtgcaaatcttccaaaataatatgcttagttccttaactttataaactcaaaaattcaatgagattaaatcgtagctatgattttataccataattgccccaaatttgtcccaatttatttttcaatttaagaggttttctatgaaacaggtttataaaggcttataggttctgttgcaaagttttccaaaaaatctattttagtgtaaaattgagaaaaaagaccttctggaatcattggaaaatatctctcaaagacatttatagaagtaaaaaaacgtccgaattatatcatcaaggaaagtaatatagaaagaaggtttgattgtgaacaaaaaggctaaaatccctctattattagtaattatattttatgctttatattttacactaacaaaagttgactggatgagtggagatgctcaatggttttctaaggttgattcttccccaatcagttttgtgataaaaaggtatgaaacttggtcgtctcggttttggattgagggggcaactctgattgcgagcaaacacttaattttattttatattttcacagtaattttgacgcttttatttttttattctctgagtgaacttttttcttttaatgaatatgatagtaatttagttcttgttgtcttttttatggcactatttccggttgtttctcttcaatctgcagggccaattgctacaatagtaaattatatctggcctagcgcgttatttctttattggttaatgacagatagacacagaaaaatgaaaaatattggaagtttacaaaattcgcttagtatcctatttctgggactcgctgtttttaatgaagggttggcaattattctctgcctctatcttattctttgccttatagtagagaaaaagaacttttttaatacatatagaatgatttgtcttgtcatttctctattaagctttttaaacgtcttgctttgccctggaaatcaaaatcggggaatgttggaaatggcaagatggtttccgacttttaatcacttatcatttttagataaaatactcatacagtttaataatattgcctcaaatttgatagtaagtcacaatctccttgaagttttagttatattattatttatcaaggcgattcaaaggaggcaaagactgtcaataattctatctggagctgtcataatgctgacgagtgcctatcatcaactaatttcagaccgacttagtgtaatagtaaaggagtctccagagaaagaatttaatcagcagataattgggacgcttttgcaacctactctcatttttgcgactctaatccttttgattgttttgattattattcttttatatggtaagtcaaaaacaagcttaatgataatcgtttctatagttattaccttttcgtcagctatggctataagcctatcaccaaccttgttagcttcggcagatagacctctattgttcttatattttgcacttgtatttaattgtattttcttagtcaatgatttaagtgaatttaatgaaagaaagaattgataaggcaaaaacaaagtgttctgaaaaaaaaccacaagaaactgaactaaaaaatgataaactttcaaaccataaaatcaaaggagaaaaggaatgatgattaactatcaaggcgaagattttacagaaactgaattttatggacgtgaaattttagaagccattcaactgaaaaataaatttccaactccaaaaaaattattgatagataggttagaagaaatgatacatgaacaattagatttaattgataaagaagaattaaataattacattcatgcaaaaaaataggttcaaactttgaccgaagatgaagttaaaaatttgtgttttgaagtcaaagatttatacgaagatgtcttaaaagaatttgaaattaagctctaatttttttcaaaaagggggattgggggacaccaccaaaaataaaaagattcgtctgaaacgaacaaaaataaaattggaaattttaggttttgtgagtgaaagatgaatactttttactgtacttgtgtacacaagtacgaagttcactaaagacactaaccccctattttgactttgtctaaattatacaatagtgactctaagatttaagaataacatcaaattaatcttaaaatagttcaagtaatttctaaaaatattactagatatcgtaaaagatagatattatacagcaataaactacgagcaatatctcgaatctcgttaaaagctaggtaggaggatatttatgagcacattttttggagtaataggcatattagcatttttaattggccttgtgatgctttttattaacctggttaaaaagaaatcaaagaaacaacctttgattatacttattgttggtttcttactatttattattggtgtagctattccaagtaattcagatgcaaaagaatctaaaaaatcaactacttctgtatccactacagaaactaaaaaagaagaaactaaagtcacttctcaaagttctacaaaaaaaccaaagccatcttctaaagtactgacagctcaagaaaaagctattgatggtttaactgggaattcgttagctcaaacaaaaactgcaattagttatttatatacaggacatatgagtaaacaagggctctatgaccaattaacttctgagtatggctcacaaatgacagttgatgaagcaaacaatgcaatcaatagaattgacccattagtcaattggaacaaccttgccatacttagtgctaagtcatatcgtgaaactggaaatttaactggacaagcgcttattgatcaattaacctctgaatatggctctcgttttactcctgaacaagcacaatatggagttttacatatcgatgatgaagtaaaatcttcggctatctggaattaattatttgtagaaaaattccattctatctttggagcgtaaggatggattaaaacattaaaacagcgagcaaaccctgattcttactaaaagctggtaggagaatttatatgaaatttaatactattcaagtcctaattgcatccacacttgcattaggtactgtcgcagtagctcaagaggttagtgctgctgaacaaaccaccagcatttatcgcctctataacaagaatactggtgaacacttttatacccaaagtcgcacagagcaattgaatgctattattgcaggttggaataacgaaggaatcggatgggtagcaccatcatacagtaattctcctgtttatcgtgtttataaccctcatgctaagggtggagaccactattacacaagaagtaaatacgaagctcaatctcttgtaaacaaaggttggaagtgggatggaaatgggaaaccagtcttctactcaggaggaaaagcatctgtctatgttgcctacaatcctaacgctcaatcaggttcccacaactacactcctaattcatttgaacaacaatcattattaaataatggctggaaatttggttctactgcatggaacgctgtgactaagtttaactggactcttgctcaatatcgtgcgttaactgtaggtgattctgatggtaaaggtggcgtaaattataatgctatcattgctgcacacgatattccttccgatgtaactatatacgaaaatggcagctactcatctaaaaatgtactctatagtaattctgatttcaacagtggagtctatcaatatgtaagcttaacatttgttaaacaagcaaatggcgattaccttctttcaaataaatcttatttaagtttataagcaaaaataatttttaaaatagctagtcatgttactaaaaaataatgttacgcattaattaatttataaaaaagagcctgctataaaattaatattttagaaattctattttttcttttattaaacattctttatcaatatccccttgttttagtttttgcctatttctttaataaaagaatctttttctttaccgattttttatatactaattcttctttgaccttcccactattaatgactttggtattaatactcatttttatatttgcttggaagcttgggtatctaaaaaatacacttaaggactggaatttaaagcgtattttttggctaatggggattgtgtttttcactttaacaattaattatctagtaacagtacttgtcctaaaaacacaaattatttcttccgtgacgagtgatactggtatgtcggatattttaggccaactaccaatcctttgtcaaaaatatattttaggaattattgttccactttcggaagagctattgtttagaagttatatttttggttcaataactaataaaaaggttgcctttatcatctcttctgtacttttcgctcttgtccatacaggattttcctggtacatacttccatacctcattctttcttttattattacttgggtttattcaaaaagaaataattttatcgaaagcgcgattgtccttagctcagtgaatctcttaggtggacctgcaatcaaactactagacacattttttaaactattaccttattaaaaaataatgtaaaaaggagaactatgaaaaattttataaataaaccaaatatttttaaaaggtggatcttatttctatattctatccttacactaattattaccatcatttatattatttttaaccatacattttttaaagtagattggcaacggtatgatattgatgggacttaccgaggaaaggtggatgaaatactaaaacatggcgtcttctggataaacaaaaacctaacagaaatcaactcttcactacttgttttacttctagctataggcgcgattctttcactattaattttctatctagcctggcataatctagcgaccaggacatggacccctattctatgctttgtaggatttttgattccccttatcgtccatggggatggaaatttcctcaaatccttgattatcggatatattttcatccttattggagcaagtgtctccattcaggctttacgatttttttaactaaggttaataggcatattcactaaaacaaaaagtactaactttaataaaagtcagtacttttttgtttatcaatactataaatatctataaaaaaagctaacaataggcaaagttagcttttatgttatgccgaaggccggggtcgaaccggcactcccgtgaaggaaccagattttgagtctggcgcgtctgcctattccgccacttcggcgaaacataacaactggggtagctggattcgaaccaacgcatgagggagtcaaagtcccttgccttaccgcttggctataccccaataaaataggcggatgacgggaatcgaacccgcgagtgccagcgccacaagctggtgtgttaaccacttcaccacatccgccatactataaacacgggcagcaggaattgaacccacaccaaaggttttggagacctttgtactacctttatactatgcccgtacaagtataaaacaaatggaaggggagggattcgaacccccgaacccgaaggagcggatttacagtccgccgcgtttagcctcttcgctacccttccaaactgcgaagcctatattaatttatcatatatattttaatcttttcttcttttgcgtcaaaaaaaagtgagtatttttaaggggttacagaataatatagcataaaaaaactgtgtatatagcataaaaaaactgtgtatatagcataaaaaaactgtgtatatagcataaaaaaatcatcagtttatgctatattatgatataataaaagtatgaagaacaaacttttgaacgagaatttcttcatacttacttatgaacacgcagaggagcgtatctttatgtctattataacagaatttgaaaaaaatcagaagcaggtgaaagccttgaatgaattgtcaaagcgtaaagtagtcgagcataactctttaattaccagcattgcgaaaatggataaaacaccacttaaaatgtttgagttagcggtatcatgtattaataccgaggctcctcctaaagatcatacggtttacctctcaaaaaccgaactttttgcgttctttaaagtttctgacaatgacaaacatagtcgtttcaagcaggcagttgagaatatgcaaaaacaagccttctttaaaatccaagaaaaaaaagaatatgggttcgagtttgaaaatattgtgccgattccctatgtaaaatgggctgattatcatgatgaagttactatcaggtttagtcctgaaattatgccttatttaatcaatctaaaacaaaatttcacgcaacatgccttgtccgatatagcagaactgaatagcaagtacagcattatcttgtatcgatggctatctatgaattacaaccagtacgagcattacagtgccaaaggcggacgccgagaagaacaagtggaaacctatcgcaatccgtcaatttctatacgagaattgcgagaaatgacagatacaatgaaggattatcctcgttttcaaagtttagaaagctacataataaagaattctttgaaagaaattaatgagcatacctcttttaaagtgacttatgagaaagtcaaaaaaggaagaagcattaattctattgtttttcatatcactaaaaaacgaagagcagatgataatagctacaagttagaagataaagtatatcaaaaagcgaaagttcaaaaagaacaaaaagaaaatttattatatgcagaagctatgcaaagcaaatacaccaagttattgctggaacattttcttttatcaccttatgaaatgacaaatccagctactatggctggattgcagagaaatgtttatccaaaatatgatgaactcaaagatttaatgggtatagatggagttaaaaaacacctttcatacatttacgataaacaagaaccgtattctaaaggaaatattgcaaagtatcttaaaaaagccattgagcaatacctaccaacggttaaaaggcggggattataatgagtgataatttaaaaaccataaaggagctagcggacgagttaggcgttagtaagacagctataaacaaaaaggtcacagatagagaacgaaaactttggttttcgaaaataggaaacaagtttgtgattaatgaagatggtcaaaaatcaataaagagaatgtttgaggggttgaccgaaaaccaagaatcgcaaaccgaaaacttccggaataataatgaaagggttctgttgcaaagttttctgataagtctattttagtgtaaaatgaataaaaatgacagcgaggggtgatttatattttgatgtcgttattttctcttgtttgcctctcagttttttctgttattatgataataggtttaggaaactatttatgaaaaaagcctctacaagctaaatggcttgtagaagctttttttgttataataatggagtagagtttatgaacggtagctttgattggaggtggtgcttatgattatttcgtgggcaaaacctcacaaaacatgaaaggcgaaaattttttgactgtatttcaggcattgagtctcatgattgcatttgcaactttgatgattcttgtcattaatacgagtaacaaaaaatgaccgttcatcttagcggataaggtcatttagatagtatttgctaccgttcttaaaacggctacattggacttgttactagcaagtccttttttctttatctttattttatcacaacttccattttttgtcatctcgtttatttaagaaagaaaaaacgctctgacgaatcgtgtgtgaaatcagaatgctttttgcttttgtttaagactctctaaaaataacataatttttgaagataaacaaatcttattttctataaaaatatactaagtattttgattaaaaacactctcattttctcatgaatttgccatattcggcgatttttagcccttttttatcactcataatatgagaatcgcttaaccgtgtgttttacggtcgttataagtgtacgaaaaatcttaatttttctgaaaaaagcattttgaaagctacttctcctaaaaaatatttgctcatctgcccgaatgctcgataaatttatcttccactaaaaatcgatggttctgataatttttattctttttgacttcaccaatatacaaagcttcataatccaacaattcacctacaatatatttttttggcgctcgaccaataaaacttctataatttattgatgactgttcaataatttctaaccagtcatcatcaggtatctcttttattatttctcgtaatttcattttaaaatattctttctgtctaacacttcaatttggaagaacaaaagaattaaagcccctgggagagcaaataaaaactttgagctaaaaagtcaataaattgtttttctgtcatcattattatttgttgtcccctttgttcagcttgtttagcttccgatagtttttgtgaagggcgatatccttttattaagtcaataggaaagtaacctgtaacaagtcgagtcgtatttttagtcacagaattctgattatgtccttttaaacctgtaatgattgattgtgcttgtttccttatcatagttgtaagtgtgctagtaaatacaaaatactcattttctaacattcaaaacacctctgctgttcttctgaatgcactcaatgctcaacttttttgaccttctatgaatccaatcatatcagaaaacaaatatgaaatttagaagtataccctgttggccttatataattccagatataaaaaaagtacctgagtaatgtagtgacccccaaaatatagacttttcaaatctatatttcggaggtcttttcttatggtcaaatattccatagaattaaaacaacgcgttattcaagattatttatcgagcagagtgacttcaccattcaattggtcttctgtcgcattcggatagctatattttaacacatcacgaacagaagcaaaaaccgttaaattcccattttcacccactttgtcatgggagagcacactaactaaagtttgagctaaagaatctgagggttttgcatgaacacttgcaaataggtttttaaaattatcaatttgcttgatgttgactgagacgttgttttcattggtgacagactgttgcacggtaaaggcagcagcagagggcgcaatacttgaaaaaagcagtaagcctactcctaaactaaccaatccctgaatgggtttccatttcactttcataaacttctcctaattttttattcaaaaataatgactgatttcgtctgaccatcatagtcatctctcaaattggtcatttgtttaagcgtgtattccttttcgagggccttcaatttttcatccgttgctcgctcaaaattcatgcttcttccataaggatacttgacataaacttcttcagcagttgctttttggttgaaagcttttaaatctgcttttgagttttgtgtttccgattgagccgttgatttttctgtttgtgaggtttgagtggttgattctgacgtcaaagaatcagttaagggcttcgaaaccttttcctccacttttttctcagagactttcaaactcgattggacagtactcgcttttttggttttctcttgagccatctcatgaggtcgagtcaacgcatatctactacctgtaatcacgacagcaagcataacaattaagcctgcccaaatcatccattttttatttttcatttctcctcctaaaaccaaccaattaagccgaggttaagttttctgaaaatattatatcatacaaaaattaagaaaacaattccgtttttaaatatttgtgaatattcatattatagtgaaataaagcttgccaaaaactaacaaatggattataatttgaaacatgaaaaatacaatcaatcacttcgtatcccctttattaatcttgggcagtcttcttattttgggaaataccttcccttctcatgctaaagcagggatggttagtattaataatactcctgaaacaacgactcctgctattgtcacaccaccggaaaataaaattgattccgaacaagaaccgctcttatctgcgggatggacgatcgaccttcctgttcactcagaaaaatattctgaaaccagttatgcttataaacaatgtacttggtgggtttataatagagcacaggaattcggaattcacttcagtaccgcaatgggaaatggaggagaatggcaaaataatcttgcttatgagatcacgacaactccgcaacttcatagtgcggtgagcttcagccctggacagattgttggcggccaatggcaagctgatccaacttatggacatgtggcatttgtggaggccattcatcccgatggttcaatcttgatttcacagtctggaacaggattctctaccttatacaactatcaagtactgacagccactgaggctgctcaacttcactatgtgattggaaaataaaaagaaaatgctaccgaatcaattcagtagcattattagatcttaggggctattttaatggggtttgtgaggggttattatctaattatagaccctatatcgagttaaaattatttcaatgtccaatttttttatattttatcttttggatcacatagaagatacttccaataatgagggatagtattatccatccgagtaatattgtaattaaaaagataaaaatagcgagtgctcgattgtccaaatctaaaaaactcgatttaaggtcttgaaaagtactttgattaaaaattacttttattagtacatttagagtcataatccctaatagaaaaaaactcgtttgtttaatacatctagtaaaatttggttgttcttgtttcataagaaatctcccttgcttatacaaacattttttgtagaaatccttttttctgctctttgagaagatctagcttacactgatgaagagcgatagtgttatccagctgcttgaaaaatgaaccgattttattctgttcttcaagtttaggagttagaaaattcatcatagaaaagtcttttcctgtaatttgattgatagtggctcccaaacttttatgaacttctttttgaaaattattagtactcaataatgcattaatataatccccattttctcctcgaaaagcggacataaatgctccgattaccgtatgaggcatttctttggtaacaatagcgtgtttcccaattagagatctacttccatttcgtacaactacaataacatcaccaacttttacattatttgaattgacgacatcaggattgacatagacattgtcagcatcaataagttgatcgttttttacattcgatgaccgtaaaacaaatgtgcctttatcttgtacatcagttggactatatgttaatccggaatagctataagttacatcggttaacttacgcacttcccaatcgtcagcaaaccccgcaaatcgcaattcaggaactttggcaccatttttagggaacattttttgtaagtagccttttttctgctccttgagtaaatccaacttacgttgatgaagagcgatagtgtcatctaactgtttgaagaatgaacctattttttgttgttcttcttttatcggaactttaatttcccatttttttacatctgacataggaactaaatttgtgattgctgatccaggatttgctcctgttaattttctttgcataaagtctgccctaataaattgcaaaaaatattctgaatcagtaagttctttatttattctaaacctaattaaagcctgattaaaaaccccttttttaataccttttggaacttttgatattcttcctatcgtacccgcaccactcataataaaatcatcagctattaactcaaatttgtgtaattcttcgaatttttctttagatatattgtatctagtttcataatggtcatagatagcattttgttgttcatacaccacatatggactttcttttacaaataaatctttttttaatgcacttccaaatggtcctcttcttacgccttcatttttatctaacaggctttcaaacttacgctcttcccaatcatacgtaaatcccggaaacctttactggtcaggttattagcttcacaggcggtcaatctggggctacagcacgaacttacactgtacgctcaggagacaatctttcatcaattgcgagccgattaggaataactgttcaaggtctagtttcaatgaatggtatttcaaatcctaatttgatttatgctggtcaaaccctaaattattaaaatcaaccctgacttcggtcagggctttttttgttaataaatgttactgctctcattaagataaattagtataatattcttatcgtaaatgctattccaattacaaatacaaatagctaagtgtttatgaagagataaagcgtccttttccaaagcgagggcgtttttctttacaatggaaacggaaagttatataatgttcttattccaaaaatacttttttcataaagtttatcctaagcgtccctctcctaactggggcgctttttttatgctataatatagtcgggatgtttgtgagatttcatcctattcctagagtcaagccattcttcggagtggcttttttatatcaaaaaagcactagcattaagccagtgccgaaaagtgattagagcaaggtatgaataatatagtgcggaactagattaacttgcaataacttttataatattatcaattttatgaacaattgtcaataataatatgttataatgtattcgggatgattatgggatttcatctcctttcaagagtcaagccattcctcggagtggctttttcaaataaaaaagctctagctggatgacttcaaggagtccaactagaggatgatgagggttagtacaaattcagaaaaaatttattatatgcaaaaaataagaagtactaacaatttaaatattatcaatttttcagacaattgtcaattatttatagtagtatgttataacgtatttagtggatgagaaattgatttcttttacagtatctttgataatctgcagttccgtccacatatatctaatataataaccaagatatgtgctgcagattgtcatattttggttctttagctcagttggtagctaaccgttcggtcgctggttcgagtccagcaagaaccataatgcccccttttaatccccttttgttaaaatggcttgttgaaatgctgattttaaagtgattttctctgtcgctaggatagagttttttatattaaaaaagtacaagctgatacaggtagtacggcataaaatattcacaataaattaaatatttaggagcagaatcaatagaggctatgggtataaaaaattacatcaatttataatgttgttttttaataacaaagtaatttaaaatttgttttattgtaatttagtaaccgaagagttataatgtaattgtcgattctatctcatttataagaggtgattatatatgtcagaaagcaaaatcaaagaggaaaaagtactcgcgcttaaagccatagaaaaacagacggaagcttacaaaaatttagctgaaatcatcaataaggaattagaaagtgagggagaattatctgataaatcttcaaagcgtttgaaagattatatagaaaaataaaacaggctctttttttgctatttttaatcattttaatgaaagttggactatcaaaagccaacaatatcaacactttattttttaaagttatccatgaggtccatgcactaccgacgtttttcatcatcttccaaaactgttaaaacacctatttcaaagggtttatagcacttttaatgaaattagatatacttacttttttacggttctagactatttctgctacttttttgctacctaattttttatggttcttgctggactcgaaccagcgaccgaacggttagctaccaactgagctaaagaaccttgacgaccgcatactggtacgcatgctaagcataggcgaaacacggtctatagttagataaataatatttaaccaccctttattcttatattatatcatatttaggcggccatcaaaaatgatggtcgcctatccacaagccgcataataccaaatattgttgaggtcaggaataatgtaaacccgtgaaattcgacgggtttggatttaatttggaaaataaaaaaagcctgaccgaagtcagggttaatttatccttttgaaatgtcacgatttggagttgttgctccagttccaaactctttatcgacttctgcttggaacatagtatccacaggaagtttgaatttcaaccattgattttgataatttccaagaactctaacagttttgatataacggatttcaataccgtttgtgatgtaccagcgtttagtgtcttttgcaaaaataagataagtcatttctttttcctccatgttaggtgtgtagttgattgcgggtgttgaatcatcgttattagattgattagatttcgatgccccaccaataccgtttgctaagtctttggcgagttggtctttgctaataccaatacgtgttaaataagagtaagggtcttgatggtctccccaaaggttatccgaaacccatttatgagttttgataccattacctgctccatcaagagtaagagggataccgaatgcttttgcttgttcacgcacagcattgatatagttgatatatgaagaacgttgtttagctgggtctgaatagtgagagagttcgatttggaacggtgagcgttcattagctggactccctgcaccataagcaacatatccaggttctcctaccaaatacactttatcccagccagcaatggcatgagtataggcattttgccagttattgtgcatataactcgcttcatttgtggcactattatcaccttggttattatcattggcggtatcgtgaatcacgatatatcgattactcgccttttgtgacgaaccttgacctgtgccgagtaggaacgttttgtcgtaaattgtcatttattccccttcttttttattattgaccaaacttgctgtatcatcgccaattcctaaacttgcgattgacgtcaagatagaaagcagaccagcaaaaccagcaatagataagatatttacccaatcaataccaattaagccagtggcgccagctccaagtgcaccaatagcagcttgagcagttgttttaatggcatacatatcaatattttcttcaaaataataaaaaaatagccatttaagactatttttcatactgataattgtagattttattagttaagctctttatgttttctgttataaagtacgctagataaaaatgatgctcctatgagaattgcaccaattaatcctgtaataatttcaggaatctcgacattaattgatattaacaataaaacagataaaactaaaattgcccaatgtgcaccatgatctaaataaacaaaatcattcaaagtacctttttctactaaataaactgttagtgaccttacaaacattgcaccaatcaatcccaaacctaacataatgacaatcgggtctgaggtaatggcaaaagcgccaatggcaccatcaaaactaaatgaagcatctatcatttcaagatagaggaatagtacgaaggcttgttttcctgtcgcaagaacagtttgagcaattagtggttcgtcattttctatttcttctgttacctcagccaaggtcccatgatgttccatcaaacttcctaaaccttcaacggccatatagagcaccattccagctgcacctgcgaaaaaaatcaaatatgattgactacttacccattttgaaattcccatcatgactattaaaacaatcattggcgttgccattggaaattttccgattctaaaaagaagtttctcaggaattacaatccaatgataatcgttctcatcaaaaaagaaatttaaagctagcatcaataaaaatgctcccccaaatgctgcaatcattggatgggcatgttgaagaatatagccataagtacctatagtctctggatcacctttttccattgctaagtgcagtgcttccaaaggactcaactgagcagaaatagaaacaactgccaacgggaaaataaaacgcattccaagtacagcaataagcattcctacagttaagaaaatattacgccaacgatgactcattcgttcaaggatacgtgcatttacgattgcgttgtcaaacgataaagaaacctccataattcctaaaatagttgccaaaacaagtgcatccactccgccataaactacggcaataatcaatgcaataattgttacaataatcgattctctaaaatatttcaaaattcccctccacgggcttataaattaattgttctttatcagtgaataagaaaactccaatttacttcaatcagagctttttcatagttcaataatgcttaagtattgataacctgatataaatttatcaatttctatttcttgattttgtgaattagttttactagattcagattacagcgtcaatcattttatatataagaaaagtaatccaatcccataattataacttatttgaaaatgcaattcaagcatcgtaaatatattatcttagaagatagttataagtgataagtttctctaattatttaattgctaaaaatagtaatcatgaatcattgctgtttcataagatgaaaaattatctttataatagttgctctacttccaacggagtaagttcaagaactgctcttaaaaatggatatttctctttcatcatcgcatagtctggaccacttgaaataagttttgctttagcactcaccctaaagccaatcccttgatagccatttttaccttcgacttctctaaccccaagcataagataaattgtatcatttactttaatgtcttcttctaaataatgcatccctgccgctggtgccaatatccgttcatcattggtaagatgtaaataagaaatccatgttcccgtaacatgtggatgattgtcagaccctcatgaagttaaggaaactgacccttcatattctaatgtctctttaaatttttttgttagcattttttctctttctataattccactcataatatttatcattttttacactttgagttatttttattacgtatttttaagaagatactttgattataacaaacctagagttaattgaaaagtaattctttcgatattcacaatttgagctctttatattttgggggcaactaaaaacttatagtataatgtgattatggaatttaacttcattttacccgaaaattttatcccacaagttctttcagatttacttgaaaaaacttggctcgtcccgcgtaaacaaagacattttttacgaatgaaaaaacatgctttagtcaatgatcaaataatcgatgaaaatcaactccttcatgctggagataaggtgactcttatttttgataaagaagatttttcaaatttgtcattaaaatttggctcagcctccttagcagatattctctatgaggatgaacatttgattgtagtcaataaacctgaaggaatgaaaactcacggaaatacagctgatgaaattgctttacaaaatcatgttgaagcagcaattaatcaaaatgtttttgtggttcatcgacttgaccaggcaacttctggagctgttttatttgccaaaaatcaattcgtactgccaattcttggaaaaatgtttgaagaaaataaaattcatcgtgaatatttagctcttgttgctggtcatttcttagaagaaacctttaccatcaaccaagccattggacaaaatcgtcatgaaaagaataaacgaatcatttctaaacatgggcaaaaagcaatcacacatgttcaacttatacaaaattttactgacaaaagtttagttaaatgtattttggatacaggacgaacacatcaaattcgtgttcatttatcctctttaggtcaccctatcattggagatgcattatatgggcaaaaaagcacctcacgcttgatgctacatgctgaaagcatcattatcccccatcccttcactaatcaacttttaaacatttcggcaccgagccctagcttttcaaacattctaaataaaataaaaaagaagtaatttcctttacgcaaacgccacctacccattttataaaaataaaatgggcaaaagatctttctttttgtatgacaaaaagaagaaaaaaagagacgattttcttcttccgaaatcgtccctcttttttctaaaaccatggatgaacaaacaaaaaatctctcgtattttgtttgttcatccactaaaaatatgcgaacagtatggattcattcaatccatctttggttctattataccaaaaaacataaaaacagcccctgttatctagggattagataacaggggctgtttttataagttttcacaggggttattatctaattatagaccctaaacaaacatcttttgtaaaaatccttttttctgttctttcaataaatctaatttccgttgatgaagagcgatagtctcatctaactgtttgaagaaggaacctattttcttttgttcctcaattatcggaacaaaagaaatgaaattttctacactgcctttagagatattcagttgtgacattccagctccttgtgccttgaaataatattggtgtgcattgatataagagaacagaaattgtggatcagcggttgtatttggtctcaataaagcaacacgttgattaagaacaaacctatcatcttccggtatcaacgcaacacgtcccaataaatcaccatgaccaacgtcactaagaatcataactaaatcatctttctggagagtatcatctgcttcatcaataaatttacccgaatgttttaaaccacctgaaatagagatagaatttaggtttatcaattcaagttttccgctcgtagattgcttatcctcatgactcttaccgttcttataattcgtcattgatgataacttacgctcttcccaatcgtcagcaaaccccgcaaatcgcaattcaggaactttggcaccatttttagggaacattttttgcaagtagccttttttctgttctttcaacaaatctaacttacgctgatgaagagtgatagtgttatctaactgtttgaagaatgaaccgattttttgttgttcttcataactgggaacagaagcacccacactattaattacagttttcgataaactaggtacaccagtagattcatcaaattttttccaatttatttttttaaaaatagatagtgaaaattgaaggtcaatattttgtttaggaacagcgtaaaacaaggtatcgacagtccaaaaaggcgcttttaataaataaggcttatcaattgtccctttccttccgatcccaatggcatctatatctgatagcgctctatctacacttagcatatatccaccagttccatagacaggtattgatcccgaattcagatgtttgtagtcttttccagacttaacatcaataaaatcagcaaacttacgctcttcccaagcctcgtaattctttcagttcgtcataaagcggataaacgtttttctgtaagcctgccaatatctttttgtccataaggtcaagataagacaataagaaatgttccataagtaacttagtataagggctatccattgcctgcaagactaattcgtcttctgtttcagctttacgtgctttatcttcttgataggttttatcctctagcttgtaagaattatcgtctgctttccgtttcttctcaatatgaaagactatgcggtcaatgctccgccctgctttctttttctcataggttacattaaaagaggtgtgagcgttgatttcttctaacggttcttttaaaattttacgagtaaaatttgtcatcgctttatattcattaatcgtatcagtgatttctcgcaactctttgactgtgattgaggggttacggtaggcttccacttgctccgctctccgcccccctttcacgctgtaatgctcatattggttgtattgcatagacaaccaacggtacaaaataagactgtacttgctattcaatttctgtaattcagaaattttatattgcgtaaattctgctttcaagttaatcagataaggcatgatatgctcgctaaactgaatcgttacttcatcattataatcgttccattttacgtaagggataggaacaatactttcgtactcaatacctagtgctttattggacttaattttgaaataggcttgtttctgcataaattcaatggcttctttgaattgactatgcttactactagacgatacttcaaaaaaagaaaacagctcttttttggaaagatacaccgtattattttcaggtaggttttccgtatcaatgcaagacacggctaattcaaacatttttaaagcggtcttttgcattttagccacgctttgaattaaagcgttatgctccaccactttacgtttttcaaggtcattcaaggtacataccacctttttattcttttcttcgttattctttggtataataggcatagaaatacgctcctttgcgtgttttgtgattaagcatagagaagtgatttagtcgtcgtttttctctatgcttttattatatcaatttatagatactttttcaatattaagtatctatatacatcgattttagtatctatatacatcgattttagtatctatatacatcgattttagtatctataaaaatctgtcctcccttgtaaacaccggtttttttttcacgcaaaagaacaaaagattaaaatatataagataaattaatataggcttcgcctttttttactccgtttaaaaatcttaaaatcaaggtcaaaagaaaaagtcaaaaccactattataagtcatataagtcgtgagctttctaatgcttagtggtttaagattaggatagcacgacttatttattttacaatgaaattaactagcaattcgggttatgctaaatgatttgaaattcattatatcctcaaattctgctatatcatcaatactttttaatttattctcataatcttttcgtttttctatatttttaccttcattatcgttagtaaagattgataaatcgtcttgaataatttcgggtttaggaattacgaaatgttggtcaattttaaaatctttttcatctccaaataaattagttcctattaattcaatacccagtcccaagcccctcttaacatagagagaattgataagtattacaactagttcttcagaagatagctgagtccgcaatattcctatataatttttataatcactttcatctaatttcttttcgtcaaatcttttgtttaggctcttcaatattctgtgaaatattttaaagtatgagctcattttattataaacatcatcaaattgtcgggaaataactaattctactttttgctctttagttaaattcttgcctttatattttgaactgttatatgtcgtagaaaaccattgattactttcaaataaattaaatcgaaaattcagcccatttcctatatctatattgtaatcatttataaatgagttgccatttttgtcgttaattgcattcttatacaaaaaacttatcgcttttattgtttctgatttattttgttcttttttaaataggtctaataaactataaaactctctattagcactatcagaattattaagtttctccgactcctcttgattttttttctgtatacttaatgtgttcatgaagaccaaaaaagttagtataggagcaattaaagatattaatatttttaaaagctcgactctactgatattgattgcatttggactaactttatctttaacgtttgctccataccataatccaaaactaggtaatatcaatagcattacaaacacaaatacaacaaatataattgtcggaatccaaaaactttttttcatataaatgggactatcttttgtattttccttttctgacatataaaattcctcttgctatatgatatcagaagtgtataaaaaaatcattgattaatcaataagcattatattaaatagatgtattgatttttaatttatccattgatactattgtaccataacttgaaagcacttatataaatgaacatagaataaattacgggttaatgaacaataaatgcaaatgattttaataatcttaataagaaaagaagagtgttcagaaaatgaccattttaataaacaattcgaagagcctagagtcattatgacagagaaaggcaccatctattggcgctgcatttaggaaactataaaataatagtctgtacaccaaaactgaacatcagacagtaaaatatctcaataacttaattgagcaagaccatcgacctattaaacgtcgaaaaaaattatatcgaagtctacgcactgcctcttccacgattaaaggcatgaagacaaccagaggaatatgcaaaaagagccgaagaaatggaacgctcttcggcttttcagtatctactgaaatcaaggtattaatgggaataacagcttcagaggaacactggtcagaaacgttgttttaaaatttcaaactttgcaacagaactgattgggttatactggactattaggtgaatttgttggtagacggctattgactacttctgttgttcccttcgataaaatcttttaatttataatactctattgcctgttctactacatctctaaaattataaacagataaatagcctttataaattttccttctattaatctcatttttactttcaaaatacctttgaaattctaaaaaatcatcataaatatctaaaggaatatccttaaaaataactcggctcttctttaaattttttagtacatatgaactttggattattgtttttctatttaaatagtgttctgctaagtgtattgacgtatttgactcaaaatctgtcccaattaatactatttttgcattattattttttaaatacaattttcctaatggggagtgctttcctaatccataatcaagttcttgagtatttaagtatctcgctaattcaccccaaattgcaaaagagtatagcggatgtgaagttctaataacaccattaaattttctaaaagtttccggtatcactccaattccttttgatacaggagtagtatctttgttgtatggtaagagagcttttcgaataatgtcccaaaattcaggagctactggaggatacaaccatgtgcttggatcactcatctcaatggtctgagtaggcattataattgtccctttttctcccaccctgtctataatggcatttattactgcttctgcacccccaataacataccctaaggatttcaatgaggaatgtacaagtacagtatcgccacgtttaatatctaactctgtaagtatatctacaatgtttttttgggttaaaattggttttccatcaatagttggtgccatttttttacttttgcattaatggttacccattaatacagcctttctataattttcatatacttaaaggcgataactaagcaatctgatgttgcgagatggacgttctttcggttttgaacctcaagggaaacactcgtttgataaagcgtctcaatggttgtcagtaaataaacaaaaacttttggaagtatgctattataagtcatataagtcgtgcgctttctaatgcttagtggtttaagattaggatagcacgacttatttattttccaatgaaattaactagcaatttgggtataaaaatataatgatgattgaaccctaatgaaccctaatgaaccctcttgatgtatggtataatataaaaatgaatgtaaaaaaacaaatttttaaaggcacactttatgcagtagttgccggttgtatgtttggaatttctggcatttttggtcagctttttttccgtgattatcatggtagcccgctttggattacatcaacacgtttaacgattgctggtattattttattggccatgtctttttcgcgagaccataagcgtttttttgatgtctggaaatcaaaaaagaatatgccaaccctctttttgtatgtttttggtggggtattttctgttcaatatttttattatgtggccattcaactttcaaatagtgctacagcgacaattttacaatatacagcacccgtttttattatgctttatttactcatttttcaacgtcaagtaccaaaacccaaatcggtcttattcgtcattttagcaatgataggtatttttttgttgattacggacggaaatatcaaacatttatcaatcagtcccctagcccttgtaacagggcttatcgctgctgtagctgttgttatttactcaatcatccctcggccattattggataaatatggcgcacttaatatgaccgggtggggaatgatgcttgcggggattgcctgtaatatcttctatccagtttggcgtattgattttcgaattgaaccgttgtcaattttttatgttttaacaatctctattgttggaacagcactggcttatttgttgcttttaagggcctttcaattgatttcaccgcttgttgtttctgttgcaacagctactaaaccattgacttctgtttttttaagtattccattatttggcttgaagttaaccccactcgaattactagggattgttatggtcatcgtgtctgttattcttttatcaaaatcggaacaagcttaaaagaaaccctgaggtttcttttttttaaaactattttattagaaaattctaatataatgtttttattaggagagaatttttatggaagaacccgaattgctagtttggaaagtcaacgaaaaactagacacggagttaagagaatttaagaattatatttttcaaagtcttttggagacttgtaatcaagacctgaatgcatcctttttgtattgtaataggtctcaatgtatttaaatatttcttgagtagcctcagctcttgtctcaaaatgagcatcattaataagctccctctttagcgtcttataaaaagactccatcattgcattgtcatagggatttcctttacgactcatgctagattgagcaccgacttgacgaagagtagattgataacgagagcttgtatattgactcccttgatcagtatggacaatcaagccaggctgaggatgttctttcccacaagcttgtaagaagcaatccctcaccagtttatcttgcatccgtgaagacattgaccagcctacaatcttacgtgaaaaaacgtcgatattcacggctaagtataaggtgccttctttggtagggatataggtcatgtctcccagccatactttattaggagctgttgctttaaagatctgattaattaaattgggtcttgaaagcgaagctccttttctgttgtaatgtttatatttataacggcttcccttggcataaagtcccatcaagtgcatcagtttcccaacacgtttcgtgttggtcataataccagtattatgaagtaccttggtaattctaaccgcaccatagcgtcccttatgctcatgaaagacagcttttatcttctctgagagaatttctctctccacttgttgttttgaaggacgacgatgcatgtattcatagaaacctgagcgagaaaccttaagaacttttactgcatgcttaatttttatcttcccatgatgtttcaagagaaattcaaaacgttttacttgcttcgcttcaagaagacccggaacttttttagaagttcaagttcctcctgaagataacgattttctttctctaacaatttaatcttatgttgggcatcagctagggctgtcccattgcctggaaaagcactttctccatattcttcaacttcttgaacccagcgataaagactattggcatgaacctcaagctcttggctgacttctttaacagagtaaccctcttcaagaatgagttttactgcagaatttttaaattgtttatcgaattttcttcttgccataataaacctttccacgatttctcttaactttgtgtctagtttattataacctttccattaatttgtatgttttaaatattaacttcttaatctatgaacatgcaccaagttagatcttaggggatattttaatgggatttgtgaggggttattatataattatagaccctctaaaaatagaacttttctattattccattggtttaactttctcctcaataaaattaatctcatttgtcaaaagattgtgagttgatatgagagcgcaaaattacttcctagatttatcgtttacaatcagtccaaagttgcaggattttccattcaaattatgttttaatagtattaaaataactgatggagaatatttaatatgaaaataggtaagcgaattttattaggtttagtggcagtatgtgctttatttttaggaattatctattttttggggtataaattcaacatatatttagtaccaccttcccctcagaagtatgttcgagttgccttaaaaaatatggatgaacttgggctatttactgattcaaaagaatgggtagaaactaaaaaaaagacgatagaagaaacatcaaatgctaaaaactatgcagaaacaatcccttttttacaaaaagcgattaaagttgcaggaggaaagcattcttttattgaacatgaagaagacatatcaaaaagaagcattacaaaatatataaaaccaaagtcagaaatcgaaggcaacactttaatattaactattcctgaatttactggaaatgatagtcaagcatctgattacgctaattttttagaatcttcattgcataaaaataattataatggggtaattgttgatttgagggggaatagaggtggagacttatctcctatggtattaggattatcccccctattgcctgatggaactctatttacttatgttgataaaagtagtcattctaaacctgttgaactacaaaatggagaaataaatagtggcgggtcatcaacaaaagtaagtgataataaaaaaattaaaaaagctcctattgctgtattaatagataataatacagggagctccggcgaattaaccgctttgtgctttaagggaatacctaatgttaaatttttaggttctgattcagcaggttatacttctgctaatcaaaccgtctatttatatgatggctcaacattacaaataacttctgcttttgtaaaagacagaacaaataatatttataaaaattttcctattagtccggacattcaaacaaataatgctaaaagttctgcaatagaatggataaaatctcaaataaagtaaagcaaaaagacttgccaagaaaaacatatggtaagtcttttttgctagtcaagagattgatgttgaaagatatgaagaatacatgatttttaaaaataaattatcaagtaaaattcaagtggaaaacaataaagaaaaagaattaaaaaatgaatattttaaagctgatatgcgtactaaggttttcaaagttaaaactataattgaaatagaaagagaggttgataatgcagttcaagaaaaatttggatttaaatatgcttacagactgtttactatctttgatgagattcaagttggtggagaaggagatattgataaggtaagagaaagcttctataatcgtgtcatgaagaatgcaaatagctcacagagcaagcatgaacaaacaaaaagagtaaaaatgaatgagaaagtttactatcgtttggtacatagcggattgtatgttcaagtaatggattcagttttctctcaactgattgttgaatctaagatgatttatacggttgaggaagacccagaagctaaacaaagacatttggatggcttagaacggtatatggcagaacaaagactagaacaagaagaattttataatcaagatgattttattgatatagaatggatattgcaagaacaggaagcacaagaatatatgactgataaggaacaggaagcgctatataatcaaatggtcaatgaatatgagtatgagtataagtaagtcgctagggctatcacttacaactgaatttaaaataaagaggagaaaattatgaatacacttaaaaatttaaaagaaatgcaagaacaactcgaaaaacaatctatgttgatggacgaagttgaagcaagattaggactaatagaaaataaacagatataaaaagaaatttatttttaaactagtatcgttctttttgatttggaattaaccaatattgtcttaacgagagtgtttgaataatagttcagtataacctgggggatgggtttttaccaagttaagtaaactaatacttctaaatattattaccactatactcgttcaactatcaaatatttcaaatatttgtagataaaaagatttgggtggattaatacatactttatataaatgtactctaaactttgttttcaaatattaattaatttagaatattgcacgcgcttttgtccatttatattcaattgtttgtaaataaccatgtttcgcccaactattcaagaaatataaaaaagtaatcgaaaaaaaatactatgtgatacatggtattttttatatatttgtttatagctatgctaattttttttatttaaagaaaaaaagcacgcagcgttctaattataacacaatgtgtccctttttttataggcttttttaaaattattgcctcatttataaaggatttcttaaggctctattgatcttgatatactctatttttaaagcaaaataaaaagccactagatcattgacctagtggtaatttttatcgataatttatttttaaatactttcaggggaatatttttcagacataatctgaattaattttgaacctaaaaaaatacagtatctgatgagcacataagtaacgattgcaattgctataaggatttccatattcgctaataattctaaattcaggaactgaaaaacgctgagtttacttgttaaatttaccgcagttgcagaaataacgagaggaaatgtaaaggcagcataactagaataaaaggcacttctcaaaagttttgtcagcaagcctaaagttataaaatagatagcttgcgataaaataaataaaaagataacgaatattttagattttgcttctacaacagtgaggtatcctactaaaccaagtgaacctggtgccgtgatatttgtaatcaaaggaagtaaagatttgtgcatttttcgtaaaatgaaaactctatgcataacaatgggaagaagaataaagtaaaagagtaatgttatccaaaccacaactttacccacttcaagaccgaaatctggtgatgttgccgatattaccccaatgcctacaaaagtaataaaccagcttggataaacatcatgtatttttaattcttttggtagtacatgaagataaataaaatacatcattaagataagatgcaaaattaaagcagtccaccaaataacattcgcaagaagactaaaggcggacaaacgttttaaaaatacacttagtaccattaaagacatcgtaaaagttggtgaaacagaggctacaattgggtcattcaaagtcgaaattgtatgtttcattgccagtactatcttgagcaaaattaaaaacatcaggaataaacctaacatatcgtaagaatttcctaaaatagggtaacctttactgtaaaggagatttcctaaggatattaaacccaaaattaagccacatatcgggagaggaatttgttttaaaaatgatatgaattttgaatacatcataaacttatctttctatattttttattaattcgtcttaaataattgattctattaataataatggtagtgtaaaataagttgtgtaaacacaaaaaggaataaatccgttatagtagagttgcgaaacattactagaaagagatttattcctatgactcagtttaccacagaactacttaacttcctagcccaaaagcaagatattgatgaatttttccgtacttctcttgaaactgctatgaatgatctgcttcaagcagagttatcagcctttttagggtatgaaccttacgataaagtaggctataattctgggaatagtcgtaacggaagctattcacggcaatttgaaaccaaatatgggactgttcagttgagcattcctagagatcgtaatgggaactttagtccagctttgcttcccgcttatggacgtcgagatgaccacttggaagagatggttatcaaactctatcaaaccggtgtaacgactcgagaaattagtgatatcatcgagcgaatgtatggtcatcactatagtcctgccacaatttctaatatctcaaaagcaactcaggagaatgtcgctacttttcatgagcgaagcttagaagccaattactctgttttatttcttgacggaacctatcttccattaagacgtggaaccgttagtaaagaatgtattcatatcgcacttggcattacaccagaaggacagaaggctgttcttggatatgaaatcgccccaaatgaaaacaatgcttcttggtccaccctgttagacaagcttcaaaaccaaggaatccaacaggtttctcttgtagtgaccgatggcttcaaggggcttgaacagattatcagtcaggcttacccattagctaaacaacaacgttgcttaattcatattagtcgaaatctagctagtaaagtgaaacgagcagatagagcggttattctggagcaatttaaaacgatttatcgtgctgaaaatttagaaatggcagtgcaagctttagagaactttatcgccgaatggaaaccaaagtataggaaagtcatggaaagtctggagaatacggataatcttttaactttttatcagtttccctaccagatttggcacagcatttattcgacaaacctcattgagtctcttaacaaagaaatcaaacgtcaaacgaaaaagaaggttctttttcctaacgaggaggctctggaacgttacttagttactttgtttgaagattataatttcaagcaaagtcaacgcggtattcagaagtagaaacagcacctgcataaagggaaagattgcttgctagttttccgccctttctcaatcttatcgctaagttctcagccatttctttaatcacaagttcaatttctttttgcttatgatagtcacgtggtagaatttgagaattactgaagcttgttgatttagggacatatttttccctcacgttgctttcatcgattccgttcgcatggaaaaaatgctgaaggccaattgttcctaatttttgtttaaggagaagtgggtcagcattcgcaagttctttgatagaagtgatacctagcttgtttaaacgtttctcagttcgttttccaattccccagaagtcagtcatcttaggaagtgtccatagtttactagaacatcttcataacgtatcaatgctctcatattctgattatgcttggcatagttatccatagcaagtttggcaagtagtgggttatctcccatccctacagttacataaagccctaacttatccaaaatctcacgttgtaaatctaaagcaatcaggttcatttgcatatactgatttttaatctcaggataaaagaaattgagcgattctgtgacatcaagaaaggactcatcaatcgagtaagaatgaatttcatcaattgatgtataatttgttagaatatccgtaacttctattttatagtccacatagagctgcatttgtggtggaacaatccacgtgcgtttcgcccaagattcaatgaaagccacgtactgtaaagttggttcagttcgctgtccatgaatatctgtatgtgttcgataccattgcggataattaaactttcgtgtttctataagaaaaggtaaatcgctggcacgactgacatttttcatgccaaaaacctttttaaaagttggactagaggcaagggttaaaccttttgaattatccgctcgactcatgacacaaagagaagtggttaagggattgaggttacgttgtacgcattcaatagaagcataattagatttgacatcttcaaacaggatagctcgtcgtggctcaagagaatagttgaacaaatgatttagttttgattgttccatagctcctcctaacactaaatatcagttttactgatattatataaaatttaaaggctattatttaatgggaactgttggagttatctcatcagcattcacaattgtaaaagtaactagagatgaccaagaagatgatgaacgttataatgaaatgtttcgagcagttaaacaagaacaagaatagaataatagccctttaaagggctttttagatttctgcttatttttttaaatcttatatctcgggaaattaatatattaactttttattgaatgactacaaagtcatacagttgataggcttaggctttctttttagcgacacgattaagcataaaagtagccagtcgactgaataatcttggatgagctcgcgcaatatgaacgactggtcgatcaccaaatgagttgaaataacgacgttttggattttggtcagttgccgctttataaaaaagttcagcaaggtcaagagaagtcgcccccacggaagcattaccagaaagtgcgccttgtatcttttcaactaatggttgataaaaactatcttttttcaagtttttaagcgcatttcctatggcaatctcgccccagctggacgcagttccgccaggttgtataatgattgattgtgcaccaaagtccttgatttcaacatccagtgcatcgctccattgttgaagagcagcttttgttgcatgataataacttcccaaaggcatatacaaatcgccaccaatagatgaaatattaataattcgcccagatttttgagcacgcatcgtaggcagaacaagctgagttagctccacagcgccaaagaaattcgtttcaaattgcttacggacattttccattggaatttcttcggctggaccaaactcaccatagccagcattattgataagtacgtcgatttgctgtgtttgtttcaggatttcagcgataaaagcatgattagaagcagaatctgtgacatcaagttttagcccgacaatattttgatcggtcggaatcttttcgacacgtcgagcaccagcgaatactttccaacctttacttgcaaagactttggctgctttatagcccattccattagaggctcctgtgatgataactgttttcataatatttttccttttttagttaaacgaacgttcatttatttttaagatatagaaaggtggtagtacattgaaaatcattacatttacagccattaaaggcggagttggtaaaacaacactaacactaaattatagcgattggttggtaaaaaaaggaaagaaagttttattaattgatttagatcatcaatgcaatttaacaacaatttttcaaccaacacgaagaaataatactattgcagaagcatttaaagatagtgaggaagcacaagaagttatcattgataacattaaagagaatttagacttagtagctggttttattgatttagatgaactaggaagcaaattagaaaacaacagcaataaagaaatgttattatttctttggttaaaaaataattttgaaaaattagatattggaagctatgactatattttaattgatacacaccctgatttttctacaataacaaaaaatgcagtagcaataagtaattatttagttagtccaattacacctagtgaacatggatattcagcaaaatttgatttagaagctcgtttagaaaaattcagaaaatctttgtttgattataaaactggagaaacttatgttgacgcacaattattttttgtagctaatatgattaaacataacaccagcacatcacatgaattgttaagccacataaaagatgatgaaactgttatttctactatttctgaaagagaaatttttaataaagcaactactaaacacttatctatttttgattttgctaaaacccaagataaaaaagacgataaagttttaaataatattaatgatagtttttcaaaaatatataatcatacaaaataaaggagtttaaattatgagttttgatacatttaacaaagataaagatgaaattgttaaacagaatttaaaagaaacaattgatcctgaaccaaaaaaggaagatgaaattcacagcgtaattagttctattttgaagtctaatgatatgaaaagtgaaaaaagaaaatcagtcactttttcattgactgaaagtcaaataaagaaaattgaagaacaagcacaaaaacacggttttaaaacaaaatcaaaactgttagcttatcataaaagttcaaggagaaagcaatggcagatacacctttagggaaaatgataattgaaatgggctttgatgattccagctttgcaaagggtgttactggagttaataagcaattagcagccttaaaaaatgatttaaaaacttctcaaacatcattttcaacatttgggaaaggtgttgacggagttagaagtccgatggaagttctaactaaatccattgagacgcaaaaaagacaattagatttactcaaaaaatcttatgacggttcacttgttgatgggaaagcaagctctagtactcaaaaatatgcggctgacatttcaagagcaagcgctcagatggctcaatttaaatcccagttaaagttagcagcagaggaacagtataaacaaacatctctgttacctaagctatcgacaggatttcaaaaagtaagtggtggattaaattcgattgcttctgtttctactcctgcttcagtagcagtcactgcagtgttcgcaaaaggaattcaagcagcaaccaatttcaatggtaagatgactgaaatccaagctttattatcagatggcacaccagcaaatgtcctttctaagcaaatggatactttatcagataaatctaaacaatgggctagacaatacggtatcgatacctcatctatcaatgatggtatggaagaaatgattaagcgtggttatgattttaatcaaaccgttggggccatgcctgcggtattagatgcctcaagagcctcgggggaagatttcggaacagtaatgtctgcatcaactgctattcttgaacagtttggcttgaagactgaagatacagcatccatgatgaaaaatacccaacgtgtaacggatagtttgactttcgtagctaacaaaacttcagcaggttttgaagacatgggtgtggcaatggaatatattggtcctgttgctcattctttaggtatgaatgtggaagaaacttcagcagctgttggtttactttctaataacggaattgaagctgataaagcaggtacatcacttcgtggtgctctatctcgattgttacgcaaattgcaagtccaagttagccagccaagctcatctcatatgaactcttatagttgaacatttttcttggataatggttcatccaatactcgatagcggcgacttcttcaggggtcgtctttgttgtgccttttggcagatgcctacgaatcattcggttatggttttcattcgtccctcgctcaaagctcgcgtaggcgtgtgcatagtaaactggacagcttacgacctcagagagccttgcaaattcatggccattgtcaggggtaatggatttgaagtcataacttttttgaagttccaccagctcatcattgaccgcctgtgctgttttcccatcaatcaagcgaatgatctccgtgcggtattttcgctctgtgagcgtcaaaagcaccttgttcttagctctcgtaagaatgaccgtgtcaatctcgtaatgccccacttctaagcgattgttaatgaactcaggccgttcttcaatagacttgccaaaaggatgctttggtgcacgaggtttgattttctttgccgccttatactgcggatagaaaagatgatgacgcttggcttctaaccagccccagttgacccaattgtagaggctgctcagagaaactccttttagagcctgatgaatgacttccaaagagtccttgtcttctttaagacgtgtactcacataacaatcaatctcagtcgtgagtttactcggacgaacactgtgagccctcaatccttcataattttcttgagcctttttagcagagtattttaccttccgcttgagctggatttcccctcgcttcatctctctgtcaatcgtcccatgagctttattcaataagcgcgcaatctcacggttgctcagtccttctttattgtgccaacgttcaatgtttaaacggtcttgattggtcaggtgtttccctttgctctggcttgtgatagaatagtcttgcatctgaatttcctttttatactatttggtcgaacttctagtataagagattcagatgttttttgcttgactcaaggtggctaacttcattttacaatttgcgaaataaaaaagtcatttgtgctacactcaagatagttcccgcaaaagaattataaggagtgaagacaaatgacctatacccatcttacatcaaatgaacttgcaatgatagaggcgtattataataatcatcaatctgtagccaaaaccgcagtactattgaatagatctagacaaacgattcataaagtttaccaatttttcaaaacagggcacaatgctctagattatttcaatcaatacaagaagaataaaactcgctgtggcagacgtcctattgtcttatcagatgaacaaacagaatatattcaaaagagggttgttcaaggttggacacctgatgtgattgttggccgtgcagagttttctatttcttgttctatgcgtacactttatcgtatgtttaaacaaggcgtatttgaagtgactcacctacctatgaaaggaaaacgtaaagccaacggacacaaagagactcggggaaaacaatcttttcgtcgatcacttcgtgacagaggaaatgattattctaaattcaatcaagaatttggccaccttgaaggggatactattgtgggtaaaaagcacaaaagtgctgttattaccctcgttgagcgattatctaaagtaatcatcactcttcagccagaaggcagacgagctatagatattgaaaatcgtttgaaccaatggatgcaatctgtacctaagcatctattcaaatcaatgacttttgattgtggaaaggaattttcaaattggaaatcaatcagtaatatcaatgatattgatatctattttgcagatcctggtacaccatcacaaagagggttaaatgaaaactctaatggtttattacgtaaagatggtttaccaaagcaaatggatttcaacgaagttgatgaatcttttatccaatctattgcatcgaaaagaaataatatccctcgaaaatcattaaactataaaacaccaatagaagtattcttgagtcacatatgcaaagaggaattgtctaacttaatttgacaattaatattgtatctccatctgctggtaagatataacctacaatggctaaagcatgcccctcatttccttcggaacctttaggtaaagtttcattttggtcataagcatccatttgaatcatttgaccagcatccaactcttttttaacttcgtcaaagcttaatgttcgattttccacatccgcagtcacttgatatttactttgaatagcttttaaatattcatcaatattaactccagacatcgttttaagctgatcaagacctacatttggatagaaagcttgcatcactccttgggctgtaacacgagattcttgaggtgtcgcagcggtaatttgattcactgtattaattgctgaagcggaaatgtactctgaacaccaaggctcttgaccttgcgttcctgagggaataaaatgggctaacggatgataagctgcattaatcgcattcacaggagttgctggacttgaaggtgaatcaataggtgtgttgacatctactgtatctgtcgactctttcgctcgaatgttatagagggtgacttcttcttcatattctgaggcttgttttccttgctcatcattcgtgtaaatatgatcataatcataagtcttcatacgatcattagcttggctagaggtttcttttgctctgagcgaccaatacatggaaggcgcaaaatcttcattgagaaaagattgttgaggcgagtaactaaaggaattatcgttataacccattccgatcattccccagttttgaatattatcaggggcggtcttagcttttaagaaagtatagtagagacgaccagatttattaacggacattgatttagcttttgaaaatcttccgttttgagtatcaaagacaagtccaaggtaatggtaccaatccatcacttgtttggaagtaatggctgcagtcggagaaacccctgcaaaagtttctaaatctgccactgttttttggtgagccgcatcttcataaagattaactaaggctacagcggaagtttgaaagtttatcattttttagttcagtttcttgtggttttttttcagataactttgttttttccttataaattctttctttcattgtcattgattttttaggaacaggagcaacatatttttctaattcaatatcaattttttgtcctttgtctaaattatacaatagtgactctaagatttaaggataacatcactatgccttgccctattattttgtggcatgttattggttaatcagcgtacaattttatacattatcatggcgctaaaaaataaaaaataagacatttggaatgaaattctcataaaaatagacaggagatatatctcgataccattcgagatacacctcctgtctatttttatgctacttttgggttagctcaactcaaccgccttttaatctcccaacaacaataatacccaatcaaacaacccaaaaaattcaagataatatcactaatggcaaatgtgcccaaataaaagataaattgaatggtttcaattcctaaaagtgtgaccaaactgacaatgacaaactgtttgaaatcagtattgatacagtaaaggccacctaaaggaatgaagtagataatatttagcactgcctcttgaatcgttctggtatccgcttttataaagtcaaaaggattcagtgatatcgcctgaaaatccgttgttttagtaaaaagcaccatgaataacagtaataaatacacactgaaagcaagatagagataaataactgaaaaatgtttgaggtgatactggatgccaaacaaccagataatcagcgttaataagagtattaaagttaatgcggtatagtcaaagtggttaatcaacctagccaggctttgatagcgagtgagaacgggcataatcagccaagtaatcgtcgcataactcaggataaatgtgaccaataaactgctgaggtagatcatatattttcgcaactgtttctaactccttttcttgatgagattaaccctatttccttacgattaatggggaacaagcggtcaattggcttcatcatgtagggtatacagcgaccctggttaatcgtcctttaactacggatgaaattaaaaaagaacttgatgcttctgatccgattattccgattttaaccaatcagaataaagacaattggttagatgatagtcttgcgggagtcctttatgcccacgacgatgtggaagcagggacagaaaaacttcataaatcctttattgaaactattggattgggtgaggcgatggttgaagatggacaagaagcacaacccattactttccctgatcaaagtggagccattgatccgattcaatcgaatgataaatatttgtgggcacaaacgatcatgaatgttaaacaagatccgtccgcaactaatgttcaaacgcttaacacgaatactaaaaatggagtctttgcttcaaaagtaacgaacgcaggcacttcgtctacggtcgaatttacagacccacttttaaatggtttgaaaaataaagtgccagatagtccagccattactttttcagcaagtgcacaaaacaaaggctggcttccagagtctaaatatggggctcccgtggacccaggaagtggcttgcgaattgaagcgatgaaagcaagcctttatcatcttccacaaggagaaagtggaggagtcagttacactgcatttgttcaaaataccggatggcaagctgaacaaagtaacggtggtgtcgctggtacaacggggaaagctttgcgaatggaagccataaagatgcgacttaccggatctttagcgcaaaaatattcgattacctatgctgtttatgtcgaaggtaagggttggacggcatactccaaagataatgcgatggcaggaaccacaggacaaagtagaaaaattacagcgctaagtgtttatctccagaagaagaaacttcctaaagcgccttctgatgaaaccaaacggcttactattaatggggaacaagcggtcaattggcttcatcatgtagggtacacagcaacccttgttaatcgtcccttaaccacggatgaaattaaaaaggaactggatgcttctgatccgattattccaattttaaccaatcagaataaagacaattggttagatgatagtcttgcgggagtcctttatgcccatgatgatgtggaatcaggaacagaaaaactgcacaaatcctttatcaaaagcatgggattgggtgaggcgatggttgaagatggacaagaagcacagcccatcactttccctgatcaaagtggagccattgatcctattcaatcgaatgataaatatttgtgggcacaaacgatcatgaatgtgaaacaagatccgtccgcaactaatgttcaaacgcttaacacgaatactaaaaatggagtctttgcttcaaaagtaacgaacgcaggcacttcgtctacggtcgaatttacagacccccttttaaatggtttgaaaaataaagtgccagatagtccagccattactttttcagcaagtgcacaaaacaaaggctggcttccggagtctaaatatggggcccctatagacccaggaagtgggttgagaattgaagcgatgaaagcaagcctttatcatcttccacaaggagaaagtggtggagtgagctataccgcctttgttcagggaactgggtggcaagctgaacaaagcaatggtggtgtcgctgggacaacagggaaagctttgagaatggaagctatcaaaatgcgattgacgggatctttagcgcaaaagtattcgattacctatgctgtttatgtcgaaggtaagggttggacggcttactccaaagataatgcgatggcaggaaccacaggacaaagtagaaaaattacagcactaagtatttatctccagaagaagaaatttcctaaagcgccttctgatgaaaccaagcataataaattgaaagaaatagaaagagaaattcttatgattaaacttgttgctattgaccttgacggaactttacttgaccctaatcgccaaattacagccgaagtaaaaacggctgttaaaaaagctaaagcggctggcgttaaaattgtcattacaactggccgacctttacctggtgttgttgatattctaaaagcacttgaattaactgaccaaagtgattatgttattacttataatggtgggttggttcagcaagcaactggggaagaatttatcaaagaaactttgagttctgaagattggcttgacttagatgctgctgctcgtaaaattggattaccgattcatgcaattactcgtgagggaatctatactccgaatcacgatgtcggaagatatactgtgcaagaagcccaaatggttaaaatgccactttatattcgccaacccgaagatattgctgctttagaaattgctaaagtaatgatggttgatgagcctgcggctcttgatgacggaattgcataccttccctttgaattctttgaacgatataatgtagtgaaatcaacaccgttttatttagaattcatgaataaaaaagcaagtaaagggtcagcagttcaacatttggctgagaaactttcttttgacttggatgaagtaatggctattggagatgaagaaaacgaccgctcaatgcttgaagttgcaggttgccctgtagtaatggaaaacggaaaatcgaaattgaaaaaaattgctaaatatgtaactaaatcaaatgctaaatcaggcgttgcttatgcgattaatgaatgggttttaaaagattaccaagattaattaaaaatttatgagcattattgttccctactgaactttttagcgttataatataagtataaaaagataacaaatagatgaatttacaagtcatctcttgatatatagtgaaggggtaagtcttcaatcttcagcacagcaaaattttgatgggactgctgatgtaactaatattggagtttcaggagtgcttcctatcgcaaatggaggtacgtcaacaagtgacggagttataaacacaatcgcctatgccaacagcgcagacggtatggacggcttcacgactgtttatccgaattttaatctaggagataatactaaaacgtttatcggtgcaaaaggcggaaacgatttaaagggttctatcagaatagatccagcaactcaaataacacaagatggagattttaattatttaactgctatatcacccggagataattatgattggtttagattctttttaataccaaataaaaaaacgcctaatatgacgaaagttgcgattaaaccgaatactaaatacacgtttagtgctcggttaaaaggtactggacaacatacgatttatgcttataataattggacttcctcaccacaaggcagtaatcaaataattaacttaacaccaaaatggaagttatatacatttacagtaacctcatcaaatagtattccaactgaagatgttcaattctttataagaagtaacaatgggacagaaattagtcttaaatatcctaaagtagaagaagatgacaatggcactccatacatgccatcatctagcgaagctacagtaaatgattatccaaagtatgtaggttttagcaatatcattaaacctaataagacaagctctgattataaatggttaccaatggggttagtatcaattgataacgctactggcttacttaaacctgcggtaataggcatagattatgctcaagcacacccagttggttcagtagtaacaaatagctcaaattcatcgtctggctacacgactgggacatggcagaatattggttcatcagtaattggttcaacaacaatatattattggaaacgcaagcttgttcaagttcttcaaatgaattgaaaacatgaccatagtagatttcttgtttaagcaagccaaagaagttctccatgactgaattatcatgacagttacctttgcgactcatagattggattattttttgtgatttgagcttaaagacatagtttttcatctgatatgcccacccttggtcagagtggaaagtacgacgatagagacaatcagaagtcaattctaaagcctcctgaagtgctgtcgcaatagcttgataggttggttgtttagagatttcatagctaatcacttcgttgttgaaaaggtcaagataggggttgagataaagcttcttttgaacccctttatcgtaatatttgaactcagtggtgtctgtcgttatcttctgatgttgtatagaagtgttaaatcgtctgtggagcttgttcttagccacagtcccaactttacctttgtaagagttatatttacgagatttatgccaaaaagtagtcacacgaagcccaagttttttcatcaagcgctgaactttcttgtgattaacataaattccacgttgttttaatagctcaaccattggacgataccctgcattagtgtgttcttgacgtatttcaagcatgacttgctcaatcatttcgtctttattaggacgttcaaaacgattgacccagtagtaataagttgctttagaaagttcagaaatggctaagagttgcttaagtgggaacttgaattctcgtcggagttcacagaccactcgggattttccctcttgtgttgttcctgccgtaatctcctcagcccttttaaatattcaacttccattcttaaattaagattgtcgttttgaagcctagcaagttcttgctctgtttcattcaccacatctttcgctttcttaatacttacttcttttcttattaaaattctcaaaaacatttacatttattgttcattaacccgtaatttattctatgttcatttatacatatctttctaagttatgatacaataaattaaaatgaaggagaaaaaaatgaatataggatacgcacgagtttcaactggacttcaaaatttagatttacaaaaagatagtctcaaaaaatataactgtgaaaaaatatttactgaccatatgtcaggaagtaaaagagaaagacctggattaaaatccgccatcgaattttctcgtcctggggatacgattgttgtttggcgattggatcgactaggtagaaatatggaagatctcattaatattgttaattctcttaataataaaggggtaagttttcatagtctacaagaaaatattacaatggataaatcaagttcgactggacaattgatgtttcatttgtttgcggcttttgcggaatttgagcgaaatcttattttggagcgttctgccgctggtagagaagccgcacgtgcaagaggacgacttggaggaagacctgagaaattttcggaacaagacgtaaagcttcttaaaaccttggtagaaagtggtacgccgattaagtcgattgcggattcttggggagtttcaagaaccacaatttatagatatattaataagttttagaataaaataaaagaccagctcacaacgattaagttatgagctaaccgttaatttcaaaactgcttttttacaaagattaaggaaaacaatttccaaaagacgtgatgattgtagctgtaggttattatttgcgttacaatttgagctatcgtgaagtacaagagatgctttttataaccgaggaattaatgtatgccatacaacgatttatcgtttggtataagaaagtaaatctccaagcctcagcgtttcaaaactttgacgggactgctgacgcaactaatattggagtttcaggtgtgcttcctattgcaaatggaggtacttcaacaagtgacggagttataaatacaatagcttattccaacagcgcagacggaactgacggtttcacgactgtttatcctaatttgaacttgttagatgggactaaagattttagcggtaattgggttaatgcaggtagttgggtaactgacggaacatataaaggcttaactgttaagaaaagaaccgctcaatgggtcggtatatataaaacatttaaagcaccacaaagcggagtttatactttctcagcttatgttaaaagttcaggaaataatgcaaatgtattcagacttatctttataaatgaaaaaaatgctttattgcctaacaagatgctaggaaataattttgattggttgagagacagtttcactgtaactttgaacactggtgatgttgtttatgccaaatatgaaatatcaggcgcaagtgctttatggactgctggtcataagtgggaagaaggctcaaccgccaccccttggatgccatcagctagcgaagtcacaataaatgattatccaaagtatgtagggtttagtaatatcattaaacctaataagaaaagttctgattacaaatggctaccaatgggattagtatcaatcgatagtgctacaggctcacttaagcctgcgtttataggtatagattgcgctcaagcacacccagttggttcagtagtcacaaataactcaaatttgtcatcagggtattctacaggtacatgggaaaatatcggttcagcagtaatcggttcaacaacaatatattattggcaacggaccaatatcaattgattgataagaggggtgtttagagatatgataactaatcacctcgctattaaataaatcaatgtaaggattgagataacactttttctgaattccatcttcataatatttgaattctgtcgtatctgttgtgattttttgatgaggaatggaagttctgaatcgtctgtgcaatttatttttagctaccgtccctacttttcctttatatgaattatatttacgtgatttgtgccaataagacgtcacacgaagccctagcttcttcattaagcgctgtaccttcttgtggttgacgtgatagccacgttgcttaagtaattcactcattggacgataacctgcattggcatgttcttgacgtattttaagcatttctttttcgataagctcatctttgtttacccgttcaaaacagttaacccaataataataagtggctttagggaatcctgtaactttcaagatttctttgagtttgaaggttttacggagactgtagatgagtcttgatttttgttcattagagcatttttctccaatctccgaagtccttttaaataagctacctcaatttgcgcataacgtaattcttgttcaagttctttaattcgttgagaatcatttgggttctgagtcatagacgatgcaatgctttctagttttttacgccgtcctctctttttgcttattgggacttctccataaattttgaaatgattaacccagcttgcaagtaaggtaaaattagtaatttcgaattttcttgccacagcttcatacgttaaatcagttgttaaataacattgtaccgcattttctttcaactccatagaataatttttattgactttggagtgagctgtaaagtgcttgttctgataaagttattacattggctttagctggtaaagttactccttttgtgacaagcatattttcaattaaagagatttctccttcaatatcaaagtatacattgttaaaattatcacttattggataatccaaaggatgtttttttatatatcctcttatttcttgtaacattctcaaaagaaaaattgggttgcccacattagaaagtcgtcctaatattttgtttatactgttatccattcattttctccaattattttatattattttctaactacatttttcatcaattaagatttattccgatagtagcttttctattctctctattttttgatcttgatagtcattgtaaatgacccaaaactcataatctcttaagtcaatttctaaaggaatattaatcttataatctgtcaaagacatttgggtaaccataagtttactccgctcaaaaggtcgcaatttatttctaatttcaaaataattaaatattccgtttgtataaatttgaatcactacctggttttccatcctcttaattgcaatggctttcatatttatttcaatttttggaattttcgagtttaaaactggataataatattgatttttttctcttcgaacaattccaagattttttttagcaaatgtctcaatgaatgccatctattgaatcttataattcctctataatcttctaaaagtaaatatctccaaacagtttttcgtgcccctgtccgaaaataaattgtgggatcaaattttagctttcctaaatatctgtccatactcactttaaaatctataattctttttaaactaaatttatatccgacatctcttcgtagtccaaaatttaatatacctgatatcaagattagatcaatcatagaaactgctgatttcatcaaaaaaaataaatcatctttagttcgttttggagatggggaaatagacataattaaccatagcagtatcccttatcaaccttacagcccagagcttgctaaacaactcaaaaatatcttagaaacacaaagtgacgaaaagtgcctggtagctttacccgatgtttttcaaaatttggagagatacaataattctgctcagaatttttggaagggccattttgaaagataccacaatttttatcaagaacttcacaaatctgattggtatgctagtacttttatttctcgcccatatattgatcttgaagataaaagtagcgctgctgaatcttttgaggctgttagaagcttatgggaagcaaaagatatactaatcgttgaagagacctcttctcgttctggagttggaaatacattatttcaaaacgctaagtctatttctcgaattatctgcccatcccacaatgcctatcaaaaatacaatgatattttagaaagtattaaaacttttggaatggaaaagcttatattacttatgctaggacctaccgcaaaagtattaggattccaattatcccgagaaggttatcaagcaatcgatattggacatattgattctgaatatgagtggtatcaaatgggggcctcatacaaagtaaaattacaacataaacataccgctgaacataattatgacacagatatcatttttcttcaggacaatgactatgaaaatagtatcattggacgtatcgaataaaaagataaatctatatgatgtataccaaaaagctagacttttgaaatctcctcttaattcctttaactcgtcatacaacggatatacgttcttttgcaaacctgccataagtgccgtgtccgtcatttcaagaggggataagagaaagttttcaatcaataatcgtgtgtacttactttccattgcctgctttaataagtcagcttcatttcttgatttttcctctttgtcggattgataatctttatcttctaacttatagctgttatcatctgctcgacgtttttccgtgatatgaaagacaatagaatcgatgcttcgtcctttttttatcttgtcataagacacgttaaaggaggtgtgttcgttgatttcttccaacggttcttttaaaactcgtgtttcaaaatgagtaaaacgtttataatcattgatggtgtccgtcatttctcgtaattctcgaattgaaattgacgggttgcggtaggcttccacttgttcttctcgacgcccgcccttgacactgtaatgctcgtactggttataattcatagataaccagcgatacaagatgatggaatacttgctattgagttctgcaagatcggataaagcatgttgcgtgaaattctttttgagattgattaaataaggaataatttcaggactaaatcggatagtgacttcatcatgataatccgtccactttacatagggaatcggcacaatattttcaaactcaaaaccatgttcttttttttctttgattttaaaaaaggcttgtttctgcatgttctcgactgcctgtttaaagcgactgtgtttatcattatcagataccttaaaaaaagcaaagagttcgttcttcgataaataaaccgtatgatcttttggtgcttaatgcaactgaccctttaactttaaataaatttcatcaaaataaaaatgatttggaacgattgaaagaaatttctgataacatttctaaagaatatggctgtaaaattattgtccgccctgaacaaaaactagggaattctcacaaaaattatttggtctatctttctaaaaattcatatcgaaaagaaattaaaaataaacttgaatttttaatgaaccattctcatacgtgggaagattttaaaacaaaagcaagacccttaaatttaaaagtggacgacacaaaaaaatataccacttatcttttagagggaagcgaacaaaccaaaaaaattagagatagaagtttaaaaaatgataaatttttaaaggaaaatctcaaaggacggatagaaagaaacaccattggttattccgttgaggaagtcgtgaaactttggaaagacaaagaaagcattcaagaaaaaggacaagaaaaagaaattgaaattttacttgaacattggcaagtaacaaaagaaactgaaaaagatttagttgtaaccattgatactgcatttgataatgaagcaacgattaagatacctgcacgctgtgttgataaattagaaaacggacactataaaatatttattaaaaagggcgaccgcttttcgtatcttgataaaaaaagtccggcaaacaataaaatcatggttggggcaaccgttgctaaaaatttacaaagacaaagtggaaatgtccctctttattctgacaatgtcaatatcaaactcaaacaagtctttcatgagttcgatttcttaatcagtcaagggcttggttttgatagaccacaagaaactgaactaaaaaatgataaactttcaaacaataaaagcaaaggagaaaatgaattatgattaactatcaaggcgaagattttacagaaactgaattttatggacgtgaaattttagaagccattcaactgacaaataaattccctatatctaaaaaaaagctaacaagtagtttagaaaaaatgatacatgaacaattcgatttaattgataaagaagaactagaggactatataaaagcaaaaaaatatgttgaaactttgaccgaagatgaagttaaaaatttgtgttttgaagtcaaagatttatacgaagatgtcttaaaagaatttgaaattaattttccaaaaaatataaatcatgataattaatttttttcaaaaagggggattgggggacaccaccaaaaataaaaatagtcatctgaaacgaacaaaaataaaattggaaattttagcttttgtgagtgaaagatgaattatttttactgtacttgggtacccaagtactaagttcactaaagacactaaccctctattttgagcttttagagttgacagatatttgtgaggttgacaagatgaaaataattgaaaatcgtgagagaagtatacagaaaaaatttcgtgtaaatgaaaaagaagacgaaagaattaaattgatgatgaaagaaactggcataaataatttttctatttttgctagacgagcctgttgcaataaagagatttttactcttgatttttcagaatataaaaatattatttctgaaatttctgtaaatgaaaaagttaattaaaaaagctgccattggaatggtagctttctttgttgttgcagcaagtggacctgtatttgcggcagttggtgaccaaggggttgactggtcaaaatataacggaacttacggtaattttggttatgctcatgataaatttgcttttagtcaaatcggaggaacttatggcggttcattcgtggaccaagccacctatgaaacgcaagtagcttcagcaattgctcaaggtaaacgagcgcacacttatatttggtatcaagtcggaggttcacaagaagtagcaaaagcagcacttgaccgctatttaccaaaaattcaaacgccaaagaattctattgtagctttggactatgaaggtggagcaagtggaaataaacaggccaatactgatgcgattctttacggaatgcgtcgagtaaaagcggctggatatactccaatgtattattcatataagccttatactttggaaaatgtcaactataagcaaatcatcaaagagtttcctaactcattatggattgcggcatatccaaattatgaagtaacaccagttccaaactatagcttcttcccaagtatggacggaatttcagtattccagttcacatcaacttatgttgctggcggacttgatggaaatgttgatttaacaggaatcacagataatggatacggaaaacagcaaggccaagaagttaaacccgtgggtttaacttcttggcctttctgttttccatatccattacctgtgattcctgttaaatcaacatttccatcaagtccgccagcaacataagttgatgtgaactggaatactgaaattccgtccatacttgggaaaaagctatagtttggaactggtgttacttcataatttggataagccgcaatccataatgagttaggaaactctttgatgatttgcttatagttgacattagctaaagtgtacggcttgtcagaataatacattggagtatatccagccgcttttacacgtcgcattccgtaaagaatagcatcagtatttgcttgcttatctccacttgctccaccttcataatccaaggcaacaatagagtttttaggcgtttgaatttttggcaagtagcggtcaagtgctgcttttgctacttcttgcgaacctccgacttgataccaaatgtaagtgtgcgctcgtttaccttgagcaattgccgatgcaacttgtgttgaataagtcgcttggtccacgaatgaaccaccgtaagtccctccgatttggctaaatgcaaacttatcatggccataaccaaaattaccgtaagttccgttatatactgaccagtccacaccttggtcaccggctgccgcaaatacaggtccacttgctgcaacaacaaagaaagcgaacattccaatggcagcctttttaattaatcttttcatttggttacgagggcgaggatttttagttttatgggtcatatccattgcttctagctgcacagaaacaataagtaccttacaacaaagcggcggaagtgcaatattcacatttttgacatacgcgatagggatactgttctttattttgacagtgttaccaactaatgcagttactacaaaatcggataatggctttatactctttttcttacgagcaaaagaataataataatctatatttgaatttacaaagaataaaaaaggttctggtataaaaatttccagtaccctaaatttaatttattaatgaaagttggaaaataattttgaattatattaagaaattttttattgtattggggcttgcaatactcagtcaaatagggatggctgtttatggtggagcaaaaggtttttctttagaaaccggtgcacacaagttatccttactagctgtactcattctaattatatttattgtggggaacatctacttattaatgtatttaggtaaaaagttaggttttttaacgccaagcaaagatttcctcactaagaaaaacattatatacatcttagtgggtaccctaattgctcggactgtcggaattggtggtacattattgcttaatgccacaggagtcacacagacggcaaatgatgaagcgataggacaactttttacaggtgaaaacccattattaattatcttacttattggtcccaataagtaagataattaataatgggttttcacctgtaaaaagttgtcctatcgtttcatcatttgccgtctgtgtgactcctgtggcattaagcaataatgtaccaccaattccggcagtccgagcaattagggtacccactaagatgtatataatgtttttcttagtgaggaaatctttgcttggcgttaaaaagcctaactttttacctaaatacattaataagtagatattccccacaataaatataattagaatgagtacagctagtaaggataacttgtgtgcaccggtttctaaagaaaaaccttttgctcctccataaacagccatccctatttgactgagtattgcaagacccaatacaataaaaaatttcttaatataattcaaaattcttttccaactttcattaatagattaaatttagggtactggaaatttttataacagaaccctttttattctttttgaattcaaatatagattattattattcttttgctcgtaagaaaaagagtataaagccattatccgattttgtagtaactgcattagttggtaacactgtcaaaataaagaacagtaaccctatcgcgtatgtcaaaaatgtgaatattgcacttccgccgctttgttgtaaggtacttattgtttctgtgcagctagaagcaatggatatgacccataaaactaaaaatcctcgccctcgtaaatatacctttttcttcttaaggttataataaacataagtaactggattattctccaaaacgttcacttgaagtttttcaagtttatctactacttctccatttttcaacgttaaattcataactctataactcgacattttcttcactccatcaattagtttaaaaacttcattactttttcttttgttttattatctttaaaccaaatatatattccttttcttgctcgtgtcattaatactcgatacgtatttaaaataagttcttttacttcttctggatttccaaatttagcaataaaagtatttaatttatattctctaccatttcgattaaccacccaatacttattatttttatcaaaatattttaattgacctccatatttttaaactatttctctaataaaaatgatatcctgacttttattcaaattaacaatccattcatttttttctagcgaccaagataaatcttcccaaaaaatatacccaacctaatcaaaatcaagtccttgggctgtgtagatacaaccaattctatctttatgatgtttccttatctcagaataccattcaaattgttcgtcctttgggttccaaggtttagtaaaattttcttctagaatttgaacatcattgtctcttatattccttgtccattcccaacaaaatggagcaaaccactgagctttttcctgtgagtcaatgaagcatccgtttggttatgaagttgtcgaatgacatcaaattgttctttggcgataaagggatcaatcccgttggttccacccacggcaactgcccgacaatttgtcagctccacaggacgttccaattgatggtcttgtagccactgttcagttttttcatgcatgggtctgtcttgacctaaagcataattaagggcgctcgctgcacttgcgccattgcttatttttgcaattgttgccataactcttgataccccttttgagcttgagcgagtactccgtatgtatagcgtaaagcctcgatcagctctttatcttggttgtccatccgatcgaattgattgagtttcttggcgatttgatttaaattggttccttgttttgagagttctaataataaagatttcgcttggtcatgttcgagataaggtttttttaaatgagatttttgtgctaattttttcgcataaagattcggagagagtccatatgtttctcctgaaattttcagcttattgtattgttcttcagataatctaaattgaatgtactttgtttgattttgtgatacttctttctgatccataaatagcctcctcaaagataaaatgccccagcgctcattcctcaatcgccctttgtcattgattttgtaataagcattgcgccctattcggttacaatcctcacaacaaaatagacatgctttacgtgctttatcttcttggtagactttatcttccaacttgtagctgttatcgtctgctcgacgttttttcgtaatatgaaagacgatagaatcaatcgagcgcccctttttgactttgtcatacgtcacggtaaaagaagtatgatcattgatttcttccaaaggtttttttaatatccatttttctaaatctgcaaaaagtttatattcattgactatatccgtcatttctcgtaattctcggattgaaattgaaggattgcggtaggcttccacttgttcttctctccgtccacccttaacactataatgctcgtattggttataattcatggataaccaacgatacaagatgatagaatgtttactattgagttctgaaatatcggacaaggcatgttgtgtgaaattctttttaagattgattagataaggcatgatttcaggactaaatcgaatagtaacttcatcatgataatcggtccactttacatagggaatagggacgatattttcaaactcaaacccatgttcttttttttctttaattttgaaaaaagcttgtttctgcatattctcaactgcctgcttgaaacgactatgtttgtcattatcagaaactttaaaaaacgcaaaaagttcttcttttgagagatagactgtatgatctttaggcattcactcccatggtaatctgacgctttaaagtatttaatgctgctttttggtactgttctgctgttgacacttgaatttcattcgtcattttaatagtcctttaatttttttgataagctttaaaacagattctccagtatattctgtgcttggatcaattaagttttcaagttttgttagtcgggttagaacttcttgagttttttcagcctgtgatttttggatattatcaacggcttgagcttttgcgtttgccctattacgctcttgttccaactctttttgaatagcttgtgtatcgttggcttcctggcgagctaagtcctgctcacgttggcgtagctcttgttcttttttagcaagctcttgttgcttgtctcgttcagcaattcgagctgcttctaaaagtcgttcttgttccaaattagcctgtgcttgcaaacctgcactatctattttgtcctggatagatttctttaaatctccttttgtagttagtgcatcaacacttgtaaatctgcctgttgttaaaacaaatctactaccagaaagcccataaactacattggcttcatttactgctaagtcaactgcttcaaatcctgctttccgtctgcgttcatcataatcactattgagttgagtaatttttttaacgatacccggttcactcccatggtaatctgacgctttaaagtatttaatgctgctttttggtactgttctgcatttgtcacttgaatttcatttgtcattttaatagtcctttaatttttttgataagccctaaaacagattttccagtatatactgcgtttggatcaattaagttttcaagttttcttagtcgagttagaacttcttgggttttttcagcatgtgatttttgtatattatcaacggcttgggcttttgcgtttgccctattacgctctagttccaactctttttgaatagcttgtgtatcgttggcttcctggcgagctaagtcctgctcacgttggcgcagctcttgttcttttttagcaagctcttgttgcttatctcgttcagcaattcgagctgcttctaaaagtcgttcttgttccaaattagcctgagcttgcaaacctgcactatctattttgtcttggatagatttctttaaatctccttttgtagttagtgcatcaacacttgtaaatctacctgttgttaaagcaaatctactaccagaaagcccataaactacattagcttcatttactgctaagtcaactgcttcaaatcctgctttccgtctgcgttcatcataatcactattgagttgagtaatttttttaacgatacccatatgaattcaagttaatattaatctcatatgttaagtacgttatcccattaattgttatcgcagcttttactgaaacttatgttgctgattggattagtcatatattaagttaaaggaggagtactaatatggttcaacagattgttttacctatcaaagattcaaatatcttaaaaatggtgcaggatacactacttgatagttttcgtgctggtcgtcgcaactatacaattttccaagttggcaaagccaccctgctgcgggtgagtgacgtcatgaaattaaaaaaaacagatgtctttaatcttgatggaacagtcaaacaaactgcatttattcatgatcaaaaaacaggtaaggaaaatacgttatatttaaaaccagtacaacaagatttattaatttatcatgattggctggtccaacaaaatcttaattctgagtggttatttccctcaacgactcacccagaccgtcacatcaccgagaagcaattttataaggtcatggcacgtgttggtgatcttttaggaatcaactatctagggacgcataccatgcgtaaaacaggcgcttatcgtgtttatacgcagtcgaattataatattggtttagtcatgcatttattaaaccattcaagcgaagccatgactttaacatttttttcagataactttgtttttgccttatcaattctttctttcattgtcattgattttttcggtacaggagcaacatatttttctaattcaatatcaattttttcaattaattcttttgcggttgcttgaacatttttcatcacattttctaattgttcatcagaaattttatcaaagccccaagaatttaaatagccgattgaataatcttttgtgtcaatatttaaatgattagcaacgacaaaagcggtagattctgcttccaattcttgtaaagcatatttttcagaaccgaaaacttcttgactctctttgtgcaattttgaatgagtgatttcatgcaataaagttttaattctttgataaccttttaagtccggacttaaacaaatttctttcgttgtaggggagtaaaaatcatttgccccagaacacatatctgctgtttctaaaaccttaattggtacatcacttgcctttgtgattgagaaaaataatttgcgattatcatcagggttgtccggcacataagcaactggttttggtaaattttcatactcaacagccgaaagtgcccaaagcaaagaaagtcaaaattatttaaaaggaaaaaagagacatctccctctaaaatcggcgctaaaagatttcagtgtttgaattctgtttcctctgagggcatttggagagattttaagctgtcattttctgctttgtattcttctaacaactttttatcttgtaaggctagtcgttgttgttgatctaaaagattacttaaagtttctatctgcttatctttgttggtcaattgtttatcttgactctttctaagatataagatttcttctttcaaaaaatcgacttcaaaatcaacttcagtatgctttttagttgtcgatttagtgtgtgattttgttgttgattcagacgacctaagtctatcttttatagatttctcttgttttttagaaatcacatacttattacctactttatctaatttagtatgcaattccagtatgcgtattattttatcaatatatgatttacttacatctaactcatctgcaagctcttttatcgtttttaaattctcactcatggcttgcacctttacctcgaacctttgcacgttctggttgttcaaggtcttgtaatttcacagttggcaaatactgttcaatggcttttttaaggtacttggctacattgcgttttgaataagcttcttgtttgctggctacatagcttaaatggtctttgaccccattcaaccttaatctcagtagataccgaaaatccgaagagcgttccatttcttcggttctttttgtatattcctcgaattgtttccatgcccttaatcgtggttgaggcagttcgtagacttcgataaaatttattgcgtcgtttgattggtcgatggtcttgctcaatgaggttattgagatacttcacggttcgatgctctgtcttagtatataaaccgttactctgtaactttctaaatgcagaaccaatagagggcgctttatccgtgacaattactcttggttgaccaaactgtttatgtagtcgtttcaagaacgcataagcagcttgagtatcccgtttcttgcgtagccagatgtctaaagtcaatccatccgcatcaattgcacgatagagataatgccaacgacctttgattttgatataagtttcatccattttccacgaatagaaggactgtctatttttctttttccagagatgatagaggactttactgtattcttgtacccaacgataaatagttgtgtgacaaacgttaatcccacgatcataaaggagttcttgaatttcacgatagcttagattgtaacgtagataataaccaacaaatataatcctttagactattatataaaaccgaagtgtcttttgatagtctggaacttatagcctctctttgaaaagaggcgaccattctatttacgactgaaagagagtagactttattttctaattccttacgtcccaattgaacaatttttctttccctatctttaatattaggatttaaagcataattataaaggatttctaaaaactcttgatcattagatatagcaaatttttccatagagtcacaactttcctgaaggtcctcctgtttgaggaccaaaaccagctcctgccgagccccatccattagcaagtactccagcaaccgcacttactggatccttagtgacatgatacatgtatttcttattccaattgtcataggcaagatatccatttgcactattcattatttttgtaaattgaggctcttttttcggtgctgactttttgttagtagttaccattttttatcctccattaataagagatttttttgtttttgttagctcttttatcagacgattaaaaatctcagaagaggtaagttctggttcaaacattgttaatgattcaatattcttttctataacccgaatccttttaaatggttttgagtagaattatgccacttgaataataaaaagccctaaaatcatttttaagggcttttatttattctttcaaacttagatattttattttttgtagaaatggtatttttcttctgaaataaaaccagtcgtgcaattcctccataattcttgtcttggggcaactagccgatataaactatcgctatatttaaacgttcctctgtctgtttgaaagattgtcaaacgttttgaaacgacttcataagctctgatttctcttacaccattatcttgtaaggctcttaaaatttttctatcaaaggtttgtgccataaattacctcacttccaaaattgataccattttttagaaacttgattatttaattgttcttgtccttttattttatcatttaaggcttccatttgctttttaatggtttggacttcttcctgcgattgattctcttttttatcctcctgaggcattttaagagatttcaattcattgatttctgatttatactcttctagtaattttttatcctgcaaggctaggcgttgttgttggtctaagagattttgcatttgaattgcctatgctaacagcgcagacggaactgacggcttcacgacagtttaccctaacttgaacttgttaaataatacaataatcactcaagaaaatttaacaccgaaaaattggactccaggagtcggaagttcattatcagttggttctaataatggaattaaagtagttaataatggcggagctattggtagtcaaggcggattttcttacggacctacaataaatgtaaaagctggtgaccaaatcacagttagttgttgtataagaaatattggaacggtagatattaaagacttcgcactatcaatggcattttatggaacatctaattcatatcctgctaaaggtaaacttgaaattccacatgacggtaaaaaacacttctttagtttcacgacgattgttccaagtggcgccactacagctagaccacgttggtttgatgtagcgactgttgttaatgaaaagcacatttttgaagtagagggaatgaaagttgaaccaggctcaattgcaactccacacatgcgctcagctagcgaagtcacaactgctgattatccgaaatatgtagggacctacatacttcggatagtcagcagttgtgacttcgctagctgagcgcatgtgtggagttgcgattgagcctagttctagtttcattccttctacttcaaaaatgtgctgttcgttaaccgcagttgctacatcaaaccaacgtggtactgttatagtggcgccacttggaacaatcgtcgtgaaactaaagaagtgttttttaccgtcatgtggaatttcaagtttacctttagcaggatatgaattagatgttccgtagaatgctattgacagtgaaaagtttttaatcggtactgttccggtgttttttatataacaactaactgtgatagcgtcgccagcttttacatttgttgtaggtacgtaagcaaaaccgcctggactgccaatagttcctccggtattaattactttaattccattattagaaccaactgacagcgaacttccgactcctggagtccaatttttcggtgttaaattttcttgagtgattattgtattatttaacaagttcaagttagggtaaactgttgtgaatctatctttaccgtctgtgctattggcataggcaatagaacaagaaggattataaaccttgtatttgatttttaaactttgcaacagaaccggctagacgttgttgttggtctaatagcttatgaaggtcttttttttctgattggagttcggacactagattccttaaaaataaaatctcttcattcccctcaggattgccatcaactgaattattcacgttgtcgtcaacaaaaactttttgttgacgttttttagttgacgttttgttaaaaaaagcattcttaataactttttgaccatcaacgtaaacgtaaacggtatttcctttttttgacgtaaattgacgtaaatctattgacgattctttttttattttttgccatacagcttgctttgaaacacctatttcatccgcaagctctttgattgtctttaacttttcactcatcataagccctgccttttaaccgtgggtaggtattgctcgattgcttttttgagatacttagtgatatttttctttgagtagtcttctcgcttggctctcacataagacaagtggtctttgaccccattcaaactttatatcttaggggctatttttttgttataatgatataataactctaaaaggagtaagcaaatgaataatgtttttaaacccattaagtatttaagtatcattatgcttgttgttattatctcggctgtaataacttatattgtcaatcctaatttctcagatacattaaattctgtatcaagtaatatttccaaatcggtctcacagaaatcaggattaaatttagttgttgcttatatttttaacaatggatttaaagtcccaatggggatgttatttttttcaattatacctattcgatttttatattggattcagccacttttcacagccatattacctggaattttatttgggatagcatttagatactcggttgcaaaagcttttattatattaatttcttcgctacctcatatgttattagagatattcgcattttgcttatggatggtcgctcttgatcgttttaacaaatggattagatacaaaatatctaggaaaaaacaaacaaatactaagttatttggctcgtctagcaaaaatagaaaaattagtgataccagtttttctcatcatcaatttaattctttcgtcttctttttcatttacgaagaacctttttaaaatatttctctcacgatttttgatttttttcatcttgtcaacctcacaaatatctgtaaactctaaaagcccaaaatagggggttagtgtctttagtgaacttagcaagtgtgtacacacttacagtaaaaagtattcatctttcactcacaaaacctaaaatttccaattttatttttgttcgtttcagacgaatatttttatttttggtggtgtcccccaatccccctttttgaaaaaaattagagcttaatttcaaattcttttaagacattttcgtatcaatttttgacttcaaaacacaaatttttaacttcatcttcggtcaaagtttgaacctatttttttgcgtgaatgtaattatttaattcttctttatcaattaaatctaattgttcatgtatcatttcttctaacctacatcgaagccttttataattcaaaacgaatccatcaaagtttagggtatcttacacctaataaatttgaaaagataagtgcttaaaataaatagattaaaattctacgtttgttactctaaaaacttgacttaacgtcaaattaatacttaaaagtttattactgagtgccttttctcttttagaaggttatttaaaagatattattgaagataaggttttaaaaataaaagaagagacgaaagaagataaaagaacaattgtggagctaggctatgaccaattagagaaaaaaaagaaaaatgctcgaggttgggacagcaaaataaatctatttaaacaattatttgaagcagtcattaaaaataataaatatatagataaaattaaccaaagaagagagcttagaaataccttagcacatgatataacctcggtaacaatatcggaagattataatttcattgatattggtgaaaataacaatatatatataagaggtaagtttttcaagtctgtttgattggcttttgctgaaatggttgccgaatggtcgttaacagtatgctgtaaactttctaaatctgtttgattagctttaggagagtaatctccattactcatcagagaaatattacttgttaaaacctttactgaatttattagttcaactacttctgattcactggcgttacttgcgattgcgtctaatagcgactttatagtcactaaattttcatgactaataccaaacgattccacttcattttttaggtctgtcattgcactttgtaagctcgtcatatcagctaaatttgctttaagttcaatattgctcttgtttgaatcagtttgagcatgcaaatcattcaactcactacgcataacctgtggcatattttccaataataattttgtgaaatcatcaatcttattatttacttcttgagttaaacttgtaactgtagaattatctgatataaacgttaaataaaccatgattaacataattaaaacaaattttgacactttgagaaagctgcatggattggcaagaaagaataatttcaacgttaaccacaaagaattgtctgtgaaaatcagcggtcgaactaaacacaatcacgaactttctcagctttacttagatatttgcaataaatataaccattcaaagcaaatgaaatggaaagatttatacaaaatacttgaagaattgaccaaagataaacaaatagaactgtaatagctctaattcatgaaaattacggttacattgagcgcttaaaccatttcatggataatttatcacgaacaagctaaaagcgcttagaagctaaaatatgaggtgttaaatatgggatattacgacacaagaaatgaagctaggcgaatcagtaaacttgctagtcaaaatatatcgagtgagcaaatcaaaaaagaatttgaattagatagacaaagcaagtttaaccaagtaaaccatgattaaaacaaattttgacactttgaaaaagctgtatggattggcaagaaataataatttcaacgttaaccacaaagaattatctgtgaaaatcagtggtcgaactaagtacaatcacgaactttctcagctttacttggatatttgcaataaatacaaccattcaaagcaaatgaaatggaaagatttatacaaaatacttgaagaattgaccaaatataaacaaatagaactgtaatagctctaattcatgaaaattacggttacattgagcgcttaaaccatttcatggataatttatcacgaacaatctaaaagcgcttaaaagctaaaatatgaggtgttaaatatgggatattacgacacaagaaatgaagctaggcgaatcagtaaacttgctagtcaaaatatatcgagtgagcaaaacaaaaaagaatttgaattagatagacaaagcaagtttaatcagctatttctttggtccaatcattggattctactcattgtttgcctctttcctttttcaaccgttgctcacgcagaacatccaaattctttaaccgcaagcatcgcttacgtttcgacttatttaattccttggattagtttaattatctttagccaggtaatttataaacagtataatgaaagcagcacactaaaaaaaaggaatcaggagagaattaaaatctttttagtctttctacttcccggtgccctcttgtcattagtttggttatatgctttaccaatagtaaccattttgatggctataaattggggcagacatagtaattttgattaggcgcataaaggcgctttttttatcagtaattttataatataattttagttttaaagtagactgtcagtttattaactttcaaaaaactgaccttacataaaagtaagttaaatgttcacttttctatattagaaaacgttgaagtaaatggaagcttaacacttccaaccaaatcatggtctggacaactcggaggtgggatcactcttagcttacggaagaaagggactacagttgaatattcaattggtggggaaatatcctctaatattcttgcaaattccaatttagtaaatctcagtgttccaaatgaattttgtcccagaaataggtgttcccttgtaggtcacatggttggtggttggaatgcatttcatattgacattccatcaagtggagcatgtcagtggtttggtccaactgtgaacaggggtactcctcgtgggactggtacatatccaatagattaagaaagtaggggtcatggaggaacaagcatggcgagaagtcctcgaacgattagctcgaattgaaacaaagttggataactatgaaacagtccgggataaagcagaacgagcacttttaatagcccaatcaaatattcctaaaaatttcgatgcggaaggggcgctagggtacacagctttagcaatagtcaacagtgggtttacagtctcaaaagaagtaattgttgacacattgataaaagtagcaagcaaaggtcttgaccctcgaaaagaccaactctatgttattcctaataaaaaagggcaagtgatgcttatggaatcgtacttcggttacgaaaagcttgcttacgacattccagaaattgaaagaggcagcattttcgctgaagttgttcgccaaggagagacggtcgcttttagaggacgaacattggaacacgaaaaatcttttgaagctattgataacgacattattggagcttatgcgaaagtgaaaattggggatgaggaaattgctcactatatgtccgtttatcaaataagtaaatcttggtctaaaacgaatagtttggataaaaactttaatcagagataccattaaaagcttaacaaaagaacgtgatgatttgcgagatactttatataaagtcgataaaaacattcaatactatcaaaaatcagaacagcgattagaagcctatcaaaaaaatcaaagtccaaaacacaaagcacgtgatgatgactttgaaatttagacgattaaataatcaagctgctagatcttaaattttggtttttaaattttagacctagcgacttgattgagttttaaaaaaactctattttttactttgtaaaaaataatgctcctgtcgttgagcaaaccaacgaaaaagcactaaagaaattgaaaaatgaatttttcactccctttaatgcttggaatagtcctataagcttatattttgccttttaagcccttttaaatggttttgagtagaattatgccacttgaataataaaaagcctacgtccctctttattctgacaatgccaatatcaaactcaaacaagtctttcatgagttcgatttcttgattagtcaaggacttggttttgatagaagttttgaaaccataggaaaggacttaaaagccacctatcaagaaacagaaaagcaattagataaattagatacaaagattatagagtatgtcgaacaaaacaaaagtttagattatgtagataccactatcagagatacaataaaaaatctaaaacttgaacgtgatgatttaagagatactttatataaagtcgataaaaacattcaatactatcaaaaatcagaacagcgattagaagcctatcaaaaaaatcaaagtccaaaacataaagcacgtgatgatgattttgaaatttagtccgttgaaaattctgataagtgtacaataaaacaagtcggatctaagcgaacgacgagattcgaactcgcgaccccaaccatggcaaggttgtgttctacccctgaactacgttcgcacttaaactttgtgtcttacgacaatgccgactacatgattcgaacacgcgaccctctgattacaaatcagatgctctaccaactgagctaagtcggctaataacctagtatgcggatgaagggacttgaacccccacgccgttaagcgctagatcctaaatctagtgcgtctgccaattccgccacatccgctaggaattatgacccgtgctgggctcgaaccagcgaccctttgattaaaagtcaaatgctctaccaactgagctaacgagtcattagtattactactaacggttctgacgggaatcgaacccgcgatcttcgccgtgacagggcgacgtgataaccgctacactacagaacgcaaaacttatagaaaaaatggaagccaataataagtgggcttggggctttatgcttactattgccgtaactgttattggatatctaattactaaaatactttaaaaggagttcccaatgagtttagataatttcaaaaagcaaactattacatgggatatgattaaccaggcatttgaacagcccattcaaattatggagggagatgtcaatgcaagaacgctacttcttaagataactgataatggttctgtacttgacttaacaggttattcagtaaaattaacctatcaatatatgtataaatctcaatcaggttttattatgttaactcctaatgatatatccaagggagaattcacgcttataattcctactgagatgacagtatcaggattaataaaatcaaatttaatacttctcaatgaagataaagatgtagtgacccccaaaagatagacttttcaaaaatatgaaaggtcttttattatgacaaaatattcatttgaactaaaactaaaagtggttcaggattatgataacggtgtaggggggtgtgattatttagccaaaaagtaccatgtcacgaacgaagcgattgtcaggcgttgggtcaaagcttataaagaattaggggcggttggaattcagcggaaaagacaaaatacagtttattcaacacaattcaaacttaatgcggtaaacttatatctaacaagtgaaaagtcatatagagaactagctcatgaattgggaatgaataatccgccacttcttacacgatgggtgtcaaattatcgcaaaaaaggggaatttgccttttctaatgttcaggggcgacctagaaaagagtctgaattgcttgaaaattctggtatattttttaaaccttcctcattccatttttctggttctaaggcaaatatagaactaagcataatgaaacgtgaaatgttgttcattttagctacttccatgacttttacggccccgtaagcgtcagtttgaagtaaatctttaccgcgagaacccgcagtaaaataaataacatctactgtgccaataatccgagctaaatcattaacatctttgtgaaggtctagcataacagatttaacctgactgttttctgataccttttctgggtgtctagaacctgctatgatttgatgaccatcaattactaaattttcaatcaaacttgtagccactctacctgtggcacctactataaatattttcataacactctttctgtaatttttaaaagttaatacaataaactggagttaatgtgtatttccaaaaaaataagtcataagaagtaattggtctaaaaacatcaaatacatgagagacaattccatcaccaataatattttcaacaaatctaccgtaggaataacttttactcttattactttcgaaagctatatcaccaacacgcataagattatatgttttcatataatctattttagacttggtggagtctctcattggtttataatacatattcgcaacagaaattattttatctggcccaaaagacagatcgttcttttcattaatttttttataaatctcgttgaatctacattcttcccatttacctgtaaactctccaaagcgaactttaggttcctttgcttttacttccattgttgccccttattctctttgatcggactcttgcctaatctttcttttttattataagagccatgcatgataaagcattaaatcttgttggacaggttttaagtataacgtattcgcttttcctgtttttttatcatgaataaaagccgtgcttttggcagaaccatctgggttaaagacatcggatttttttaatgtcatgacatcactcacacggagtagtgtggccttaccgacttggaagatcgtatagttacgacggccagcccgaaaactatcaagtaacgtatcttgcaccatttttagaacgttcgaatctttgatgggaagaacggtttgttgaaccatattatcactcctcttttaacttaatatatgactaatccaatccgcaacataagtttcagtaaaagctgctataactattaatgggataacgtacttaacataagagattaatattaacttgaattcatcaaactttctaaatctgtttgattagctttaggggagtaatctccgttactcataagagaaatattacttgttaaaatctttactgaatttattagttcaacaacttccgattcacttgcattgcttgcaattgcgtctaatagcgactttatagtcactaaattttcatgactaataccaaacgattccacttcattttttaggtctgtcattgcactttgtaagctagtcatatcagctaaatttgctttaagttcaatattgctcttgtttgattcagtttgagcatgtaaatcattcaactcactacgcattacttgtggcatattttccaataataattttgtaaaatcatcaatcttattatttacttcttgagttaaacttgtaactgtagaatcatctgatataaatgtaaggacaattaaaaaaatccaagtatttctacttggataaaaagtctaacttttggggtgcacatcaaacctaccaaagtcagacggttcttatttttttgtgattttttcaatcaacaaaacgataaatgtaagcaaactaattagaaaaccgtaagctgcgatgactaacatggctacatccaccaataaggaggctcctttccgttggattttgaacttacatacataagcctcacctcactttcaaagccaccgtctatttaaacttctactcgactattataacaaaaaaagcttctacaagccattagacttgtagaagcttttttcataaatagtttcctaaacctattatcataataacagaaaaaactgagaggcaaacaagagaaaatagcgatatcaaaatataaatcatgcttaaaagacaaaatatgagcttataggactattccaagcattaaagggagtgaaatatctatttttcactttctttagtgctttttcgttggtttgctcaacgacaggaacattattttttacaaagtaaaaaatagagttttttcaaaactcaaataaaaaagtccggtcttaaattttaaagcccaaaaatttcagatccgactttttttattgtttactcatcagaattttcaacggactaaatttcaaaatcatcatcacgtgctttgtgttttggactttgatttttttgataggcttctaaacgttgttctgatttttgataatattgaatgtttttatcgactttatataaagtatctcgcaaatcatcacgttcttttgttaagtttttaatggtatctctgatacaaatcgacacaatccaaaggggataaaaggggaaagtgaaacttcccccttttcaagcaacattgtaatacaagaacgaagtgatttgtattacaatgtgatagcttgcagtatttatggttttatatggtctattttgttatgaggattgtaaccgaatagggcgcaatacttattacaaaatcaatgacaaagggcgattgaggaatgagcgctgaggcattttatctttgagtaagttcttgatggatcagaaaaatgtatcacaaattgaaacaaagactcactcatttaagagaagctactatcatgaaattttgttgttgcgataagcaacttctgatacaggtttttaggggttagcacgacatcaatttatttgatgtgtaagtgcgcattgcactcaaaatatgccacaagttatgcgtagtgagttgaatgatttgcatgctcaaaccgaatcaaacaagagcaatattgaactaaaagcaaatttagctgatatgactagcttacaaagtgcaatgacagacctaaaaaatgaagtggaatcgtttggtattagtcctgaaaatttagttactataaaatcgctattagaagcaattgcaagaaatgcaagtgaatcggaagttgttgaactaataaattcagtaaaggttttaacaagtaacatttctctgatgagtaatggagattactctcctaaagctaatcaaacagatttagaaagtttacagcatactgttaacgaccattcggcaaccatttcagcaaaagccaatcaaacggatttagacaacttaccggttttgatcttttcttttagcgagtgaacgaagtgaacgctgcaagtaaaatgtgagcgtggttttcgctcactccttttttgatgactttgacctttggttttacatttttgaaaaaaataaaaaaaaggcgaagcctatatctatttatcatatatattttaatcttttattcttttgcgtcaaaaaaaagtgagtgttttcaagggtttaaagaataatacagccacaaaaaactgtgtatacagccacaaaaaactgtgtatacagccacaaaaaactgtgtatacagccacaaaaaactttttgaagtggctgtattatggtataataaaagcatgaagaacaattctttggacagactttcttcatgcttacatactgctacaccggccattgaaaatggtaaagaagccaatgaagttaaaggaaacgatgtagaagttgaaatgacggttaaagtaaactttggcgctaagaattatgccacaggagaaacaattcctcaatgggtaaaaggtcaaccacataaaatcatccagaagaatggagatactgtcttgcttgatggtattatgagctggttatccgttcatgatgtggaaactattgatgcttctacaagccagccaacgacacccgcaaaaagttatattgtaaaacaaggtgatacacttagtggcattgcttcaaacttggggacaaactggcaagaattagcacgtcagaacagtttatctaatccgaacatgatttattaagtatttcaaaacttttaaaaagaaccgagtgagtttagctttttccaagtgtacaaagtcctgaatctattttttacttaagaatcaggtagcgacaccaatcataagtattttatatactccaactcaactaatcgaagtcgtgttttttatcaaaaacatgtataaaaaataggtgtaaatattttagaaaaatagaatagctcaaccgtgggaatctcacaacattttttttacgttcgtctaaaaaatcagcaaaattaaaagccgtatatcgtggatatacagccccttgcctgacaaaaatttgttcatttttttaacgctttttactacgttcgtgttttttttacgttttttactacgtttaaaaagcttaatggcgtgaaagaccacttgtcttatgtgggagccaagcgagaagactactcaaagaaaaatatcactaagtatctcaaaaaagcaattgaacagtatctaccaacggttaaaaggcaggacatagacaatgagtgaaaactacaaaaccataaaggagttagcggacgagttaggcgttagtaagacatatatagaaaaaatcatacgagtagtcaatattcattcagaactacttaaaaaaaagaatagattttttttaaatattaaacaacaggaaataataaaaaactatttagataaagaaccgccaacacaagcaccaacagcagataaagaaccaccaacacaagcaccaacagcagataaagaaccaatttaaatcaaatcgccaagaaactcaatcaattcgatcggatggacaaccaagataaagaactgatcgaggctttacgctatacatacggagtactcgctcaagctcaaaagggatataaagagttatggcaacaattgcaaaaataagcaatggcgcaagtgcagcgagcgcccttaattatgctttaggtcaagacagacccatgcatgaaaaaactgagcagtggctacaagatcatcaattggaacgtcctgtggagctgacaaattgtcgggcagttgccgtgggtggaaccaacgggattgatccctttattgccaaagaacaattcgatgtcgttcgacaacttcataaccaaacctttttttacgaaacaagccgaccagcgtttgaaactttttagtttttcatcattctattttaaaacgttctaaaactcgatttaagcgactttaattcgaaactgtctatttgttcaaagggagcattaagaatgcttaaacgagcttttaagtgggtttaaattgattttgagttgaatagcttgttgtaagttgtaaaaaaacaagttaaacaaagtatcggttttccatttaagggttgttagggcttgccctgaccgtctgtaagacgcttgattgcatgatatgagtatttagctagtcaaacagttaaaacagcttatatgagcaattagagggaatccaataaattcctaaaaggaaatgcaagctgagtttcacgaaaaaattaaaaaattaggagaaaaaaatggtagttaaagtctttgatgcttatattgaaggcgaaaaaaaagcaaccggaacaattgacgagatagccgattactttgatatttcccgcaactctatctcattatggataaagaatgggaaagaccctaaaaaagctaaccctaaatataagcacgctattttaaataaagaaaaaactaaagagcttatggaacaaaagaaaaaagaagagcgcaaacttcccgcttctgtttatgattattatgacaaaggggaattcataatgacaggaactgctcgagaaatttctcaatttttaaagtatttataactccgtcacttgttgaagtacctccatttgcaataggaagcactcctgaaactccgatattagttacatcagaagaaccgtcaaaattttgctgtgctgaagattgaagatttactccgagttttctagctgtttccagtttacttgcactaacagcatttccattaagtggtaaactgttcgcttgtgcttcggtagcctttgccattgcatttttggcttcactttcagcttgttttgctgtttcttgagcagttgttacatttttatttgttgttgataactctgattgttcagcttttgttgaaattgcaacaccttgtttatcaacagtagcttccaaaatagggggttagtgtctttagtgaacttcgtacttgggtacccaagtacagtaaaaataagtcatctttcactcacaaaagctaaaatttccaattttatttttgttcgtttcagatgactatttttatttttggtggtgtcccccaatccccctttttgaaaaaaattagagcttaatttcaaattcttttaagacatcttcgtatcaatttttgacttcaacacacaaatttttaacttcatcttcggtcaaagtttgaacctatttttttgctttaatgtaattatttaattcttctttatcaattaaatctaattgttcatgtatcatttcttctaacaccaccaacacaagcaccaacagcagataaagaaccgccaacacaagcaccaacagcagataaagaaccgccaacacaagcaccaacagtagataaagaaccaccaacagcagatgtagtttttttacaaaacgaattggtaaaaagaggagtagaaattgacaaattacatgaattgttagaccaacaacagcgactagccttacaagataaaaagttgttagaagaatacaaagcagaaaacgacagattaaaagcccttaaaatgcccacagaggacacaaaagaggaacaggtgaatagtcaaccaaaagaagaagttaaagctcttaaatttgaaatacgagcataatcatattgttcttaatgcgactgaccctttaactttaaataaatttcatcaaaataaaaatgatttggaacgattgaaagaaatttctgatagaatttctaaagaatatggttgtaaaattattgtccgtcctgaacaaaaactagggaattctcacaaaaattatttggtctatcttgcgaaaaattcttaccggaaagagattaaaaacaaacttgaatttttaatgaaccattctcacacttgggcagattttaaagaaaaagcaagcgccttaaatttaaaagtggacgacacaaaaaaatataccacttatcttttagagggaagcgagcttaactagcaattcgggttataactaattccattttatattcccctatctggactttcccattttcctttgttagtccgattacttaagacaacaatttcagccgagattgcgctgacaagattcaaaatccaataagcaacaagatagactggtaaaatcattttgtcagataaagataatttgctctcacctctatcgttgttcaaccccaaaaagaaaacagcaaacgaaatcaaaacaaaaattactataatctgtcccgatactttaaattcttgatttaatagcatctgtaaaaagtattggtaagactctataagaaagaaccaactccaataatctattggatatgtaccagtcccacgaggagtaccactgctcgcagttggaccaaaccactgacatactccacttgatggaatgtcaatatgaaatgcattccaaccaccaaccatatgacctacaagggaatacctatttctgggacgaaattcatttggaacactgagatttactaaattggaatttgcaagaatactagaggatatttccccaccaattgaatattcaactgtagtccctttcttccgtaagctaagaatgatcccacctccgagttctccagaccatgatttggttggaagtgttaatcttccatttacttcaacgtcgaactttctaaatctgtttgattagctttaggggagtaatctccgttactcatcagagaaatgttacttgttaaaacctttactgaatttattagttcaacaacttccgattcacttgcattgcttgcgattgcatccaatagcgattttatggtaactaaattttcaggactaataccaaatgcttctacttcttttttaagctctgtcattgcactttgtaagctcgtcatatcagctaaatttgctttaagttcaatattgctcttatttgaatcagtttgagcatgtaagtcattcaactcactacgcaacacttgtggcattttccaggaagtcgtgaaactttggaatgacaaagagagtattcaagaaaaaaatcaagaaaaagaaatttcaattttggtagaagattggcaaattgagaaagaaactgaaaattttttatacgtaacgattgatactgctttagataaagaagcgacaataaagatacctgcacgctgtgtcgataaattagaaaatggcgattatcaagtctttatcaaaaataaagaccgattttcttatcttgataagaaaagtccggcaaacaataaaatcatgtatggaacaactgttgctaaaaatctacaacgacaaagtggaaatcgcaaaagatttaaaacaactcattgattatgtgatgaactccgaaaaaacaaatgactttgaatatgtttccggtcaaaatattttagatattcattcaacctgtgatgaaatgttagcgacacgaacaatggcaaatgctttaaaaaacaagccacaaaaaaatgaaaggttcggttatcattttgtccaatctttttctcctgatgaccatttaacccctgaacaagttcatgaaattggttgtaaaaccatgaaagaatatctcggaagttctgcggaatttattattgctactcacaccgataagccacacctgcgttctgccatatctttaaaaaatgttttcatgttttttctcctattttttatatttttatgcagtacgtttccaataatatattgtcgttgaaccgattactgctgaaccgatattttcccattttcctgtagaataccctgatgacaaatttgagttatttgtgactactgaaccaactgggtgagcttgagcatagtcaatgcctataaccgcaggcttgagtgatccagtagccttatcaattgatactaaccccattggtaaccatttgtaatcagaacttttcttattgggtttaatgatattactaaactctaaatcaagccttagctgtgacatctgattgtccttatcgacgtactttccactcagatcaaggatggggataccaaatgagagactatgtttctaaattaaaatctcatagaatttttcagtctatgagccgtaaaggaaactgtcatgataattcagttatggagaatttctttgggctacttaaacaagaaatttactacggacatatcttctcgtctttcgaagaacttgaacaggttattgtaatctggattaggtactataatacaaaacgaatcaaacaaaaattgaactggatgagtccgaatgaaccgttccgttcgattgttttggcattttaatgactgtcatttttactccccctccgaaatataatgaaccactttttgaattttatcttccaaattttctaattgcttttgataattagacatcaattcttttgtctgattatttttattttcgtttaaatgtttagcaatttgattgatattatttccgatacgttttagttcagattttgtcgaagaaatttcagaaataatatttttatattctgaaaaatcaatagaaaaaatctctttattgcaacaagctcgccttgcaaaaatctagattatatcacgtttcaacaaaaataagaaacggagaacattaaatgacagtaccagtagtttttgaggggggaattttacaaaatgatgaattattctctttccttgaagaagtaaaaagtaaagttccggatatcgtaaacagcaaagatgataaaacttttttaattaattataaaaaggaaatatcagcaactattaatgaaattgatttgtctgaaaagaagcagattgatgaaatgattcaaatctttagagatagaaatccaagagtttgggaagcacggtcagaattagtgcataaaaacataaaaaataggagagtaaaatgaatcaaatcaattggaaattacgtttaaaaagcaaagctttttggttagctttactacctgctctattcttgctaatacaagctataggagcgtcattcggctataagtgggactttgttattttaaatcaacaacttgctgcagtggttaatgctgcttttgcgctattagcaattgttggagttgttgctgacccaacgaccagtggtctaggagatagtgatagagtcttaaataaagataaatcagaggaaaaaacttaacgttatttactatgatataccgaaagcaagtaccaatgcaggtaaaatgttgtttaaaaagtgtatagctatactaacttctaatcgtcttgtcttaaagtaagctatagcacaggtcaatccaattaaaccataaataagaaaactgatgatgtttgttggggagtgcatcaacccaaaaagcacactacttacaataattccaacaactggaaggtctttaaataaatagccgacaattcctcctctaaatacgatttcttccattattggagctgcaatctctcacaaaaattatttggtctatcttgctcaaatttcttaccgaaaagagattaaaaacaaacttgaatttttaatgaaccattctcacacttgggaagattttaaaacaaaagcaagagccttaaatttaaaagtggacgacaccaaaaaatataccacttatcttttagagggaagcgaacaaaccaaaaaaattagagatagaagtttaaaaaatgataaatttttaaaagaaaatctaaaagaacggatagaaaaaaataccattggttattcagttactggtctgcgagctttttagtataaccagtcgcattttgtgtttctttggttaagttgcgtaatgcatctccgccttggttaatcagcacgttcatacctgtttgagcttctacaccaaacgctttagcaactaatgaacttttttcagcatctgtcataccttcagtatgctttttgatggtatcgagcatatcaggtaaaccgatatttccttttttccactcatcgatattaatgccaagttcttcaaaagctgccgaagattgtttagtaggtttttggtctgcaagttttttagtataaccagtcgcattttgtgtttctttggttaagttgcgtaatgcatctccgccttggttaatcagcacgttcatacctgtttgagcttctacaccaaaagctttagcaactaatgaacttttttcagcatctgtcataccttcggtatgctttttgatggtatcgagcatatcaggtaaaccgatatttccttttttccactcatcgatattaatgccaagttcttcaaaagctgccgaagattgtttagtaggttgggtctattttgttgtgaggattgtaaccgaatagggcgcaatacttattacaaaataaatgacaaagggcgattgaggaatgagcgctgaggcattttatctttgagtaagttattgatggatcagaaaaatgtatcacaaatttaaacaaagactcactcatttaagagaagctactatcatgaaattttgttgttgtgataagcaacttctaatacacgatttttagccattacatcactcgtttttagagtgatgtgtaagtgcgcattgcactctaaatgatgaatttcgtcaaaagttggcggtgatgaaatgaaaaatcaagaaaaaacaattaatcatcgtggacaagtagtttatcaagagtcagtcgaattttataaagaaaaactctcagttcactcaaaagattttcttaaaaatgcgctcatccctcagctttatgaatggtcaaatgcttataaagcagcggttgaactgacaaaataaaaaagcccgcacgggcatgcagactaagacgtggtgtgtcttcttaaatttatacgaatgatgaatttcgtcaaaagttggcggtgatgaaatgaaaaatcaagaaaaaacaattaatcatcttggacaaatagtttatcaagagtcagtcgaattttataaagaaaaactctcagtttactcaaaagattttcttcattcgctcatccctcagctttatgaatggtcaaatgcttataaagcagcggttgaactgacaaaataaaaaagcccgcactaggaatgcggactaagacgtgatacgtctacaaaattttatataaaatttttgttttttaaaatttaagaccggacttttttatttgagttttgaaaaaactctattttttacaaagtaaaaaataatgctcctgtcgttgagcaaaccaacgaaaaagcactaaagaaagtgaaaaatagatatttcactccctttaatgcttgaatcgtcctataagctcatattttgtcttttaagcccttttaaatggttttgagtagaatttatgccacttgaataataaaaagccctaattctgatagttctgttaaacaactctctttatttgaaagtgttcaagaaaatcaaactaataaaaagcaagaatcactccaaaaagctattgatgagattagagaaacattcgattttctttcaatacaaaaggcaagtagtttatccgagggttcacgtgtcatttatcggaacaaactcattggaggtcatgcagcaagtcaagacaaggaggaaaaagatgtcagttgaccgttcgtcacaattgctttcggctcaccaaactgtttatggagtcgttttaagaaagcataggctgcttgcgtctcccgtttctttcgtaaccagatatctaaggttaagccgtccgcatcaattgcacgataaagataatgcccacgtcccttaattttgatataggtttcgtccattttccatgaatagaaggattgtctatttttcttcttccaaagatcatagaggactttgctgtactttacgcaaacgccacctacccattttataaaaataaaatgggcaaaagatctttctttttgtcatacaaaaagaagaaaaaaagagacgattttcttcttccgaaatcgtccctcttttttctaaaaccatggattaacgaacaaaaaatctcttgtattttgtttgttaatccactaaaaacatgcgaacagtatggcttcattcaatcctgttcttacaagtcaaaagcataattcttatttttatagaatgctttgctgtagataaaattatgaataaataaagtaaaaaacacatcctgacttataatacagttcattagggtgtgtttttgctaagcgtttaataaaaaattaggagccattgatgaaaaaaactataatctttatattacatattccatttatacttctcctctggctctgtataacgtctcccttttttataaaaaatagtcccaagttttctagctgtttccagtttgcttgcactgaccgcattgccattaagtggtaaactgttcgcttgtgcttcggtagcctttgccattgcatttttggcttcactttcagcttgttttgctgtttcttgagcagttgttacatttttatttgtgattgataactctgattgttcagcttttgttgaaattgcaacaccttgtttatcaacagtagcttcgacaaaatctgaactaaaacgtatcggaaataatatcaatcaaattgctaaacatttaaacgaaaataaaaataatcagactgaaagtttgatgtctgattatcaaaatcagttagaaagtttggaagaaaaaattcaaaaagtggttcattatatttcggagggctagaaaaaatgacagtgatttatatgccaaaacaatcgaacggaacggttcattctctaaaaacactcaaaggagcgtatttctatgtctagtataccaaaaaatgaacaaaatcagaagcaggtgcaaatcttgaacgaattatcaaaacgaaaagtagtggagcataattctttaattaccagcattgccaaaatggataaaaccccactcaaaatgtttgagttagccgtatcgtgcattgataccgaagaacctaaatttttgttttttaaaatttaagaccggacttttttatttgagttttgaaaaaactctattttttacaaagtaaaaaataatgctcctgtcgttgagcaaaccaacgaaaaagcactaaagaaattgaaaaatgaatttttaactccctttaatgtttgaatcgtcctataagctcatattttgtcttttaagatattcttcattctgaccaaggaagccagtatacgagtctagagtatgaagagttgcttaagtattatgggatgactcactctttcagtcgaaggggatacccttatcataatgccagtcttgaatcttggcatggacatttaaaaagagagtgggtgtatcaatttaaatataagaactttgaagaagcttctcacaaaaattatttggtctatcttgctcaaatttcttaccggaaagagattaaaaacaaacttgaatttttgatgaaccattctcatacgtgggaagattttaaagaaaaagcaagtgccttaaatttaaaagtggacgatactaaaaaatataccacttatcttttagagggaagcgaaaaggtttggtcaaccgacattacttatattcctactcaacaaggatgggcttatctctcaaccattatggatcgttatactaaaaaagtcattgcttgggatttgggcaagcgaatgactgtagaattagtgcaaagaactttaaataaggccattaaatcacaagactatccagaagctgtacaatatgattatgcaggtgtggcttatcggtgtgagtagcaataataaattccgcagaacttccgagatattctttcatggtttttaaaccaatttcatgaacttgttcaggggttaaatggtcatcaggagaaaaagattggacaaaatgataaccgaaaatttcatttttttacgacaataatcacatctttttgaaattgtttacctttaaaatagttcattgatatatcctcgctgtcatttttattcattttacactaaaatagacttatcagaaaactttgcaacagaaccaatttaaatataagaactttgaagaagcctatcagagtattttctggatccaacaaaacatgaattcagagtggttatttccttcaacttctcgtcctgatcgtcctattaccgagaaacagttttataagattatggcacgagttggtgatcttttaggaattaactatctaggaacgcataccatgcgtaaaacaggcgcttatcgggtctatacacctctgtaatttcaatttctattctgtttttctcgtcattaacctttttagcttcaagccatacaatctggctgtcgtcactgtaataacgcaacttagtcatataatcttgtaagttcttcataagattgtctaagtcaggtctgcttgttttccattgccaccaaattctggaactttctttttaactgaatcatctattttcgccatagtccccaccattttcttggtttttcttgttcttctatccttttttgatctttgatttgttcctgcaaattttccaacttctctttaagagcgttcacttcatctttatattgattgtctaagaaaccgaagacatgctgacggtacaagccctaaaaagtccgtataccaagttgcttatggaacatttcttattgtcttatctagacttgacggatactaaaattctttcaggcttacaagcacacgtgtaccctctctatgacgaacttaaagacttacgaggagtgtatccattattgacagcttccccattcctttgtgtcagccgattcgtaatttcaaaagcaaagttcttggagattatgcaaatgttggctacaatgctacaaagggacagtacttctatggatgtaaatgtcatgctttagtcagtgaatcaggttacggaggtgtggtttatcggtatgagtggcaataataaattccgcagaacttcctagatattctttcatggtttttaaaccaatttcatgaacttgttcaggggttaaatggtcatcaggagaaaaagattggacaaaatgataaccgtaaatttcattttttcgtggcttgttttttaaagcatttgccattgttcgtgtcgctaacatttcatcacaggttgaatgaatatctaaaatgttttgaccggaaacatattcaaagtcatttgttttttcagggttcatcacataatcaatgagttggtttaaatcttttgaaatattttcttccgctctggtttttcttaaaagcaaggtataagcacgaaatgagtgaaagtaaaggtatgacgaacaacaacaaaactgttgctagaggtccactatgagaaatattttctactcctttaaaaatgtgaccaaaggatgaattaagcattcattggaaaataaataagtcgtgctatcctaatcttaaaccactaagcattagaaagcgcacgacttatatgacttataatagcacacttcgaaaagtttttgtttatttactgacaaccattgagacgctttatcaaacgagggttccccttgatgatgtgaaccccaaaagctagactttttagacaagaataatttcttgtcttttttttgttattttgaataagttaaacgatattggattggactcatccagttcaattttttcttaattcgtttcgtgttgtaatagtgaatccatttagtaatcaacggattaaccgacatccatctaaaactcaattaaggagacaatacctgtcactcaaaatttctcaactcttcaatgctaaccgaggaatctatggtgctcctaaaattcatcatcttctacttaaacaaggggaaaaagtcgggttaaaacttggtttaagaatttaaaaaaacaactggatgataatcaagcctcaaatttgcaaaatcaaattgataatctaggtagtgagaaagctaatgatcatgaggttgttcataaaactggtgacgaatcaattgctggtaaaaagacgtttactggttactgacagcttctatttttatgattaaaattaaagaggatacttacagctattaatagcgtaaattttatcagctgtcagctataattattaagctttatcagtaatgatatgttttttgagtaaaaaaattaaggaaatagaggtaaaaagcttttagagttgacagtattttgaaaggttgacaagatgaaaataatcgaaaatcgtgagcgaagtatacagaaaaaattcttcgtaaatgaaaaagagaacgaaagaattaaactgatgatgaaaaaaactggcatcactaatttttctttcattggaaaataaataagtcgtgctatcctaatcttaaaccactaagcattagaaagcgcacgacttatatgacttataatagcacactcccaaaagtttttgtttatttactgacaaccattgagacgctttatcaaacgagggttccctagtttttgttcaggacggacaataattttacaaccatattctttagaaattctatcagaaatttctttcaatcgttctaaatcatttttgttttgttgaaatttatttaaagttaaagggtcagtcgcattaagacacgtgactatcataagcaaagagaaattgaacttgtgattaaagaaatggctgagaacttagcgataagattgagaaagggcggaaaactagcaagcaatctttcactttatgcaggtgctgcttctacttctgaatacttatctatcaatactttttttggagttggaaatttatttgtcagttgaatggcttctaaaatttcacgtccataaaattcagtttctgtaaaatcttcgccttgatagttaatcatcattcattttctcctttgattttattttacctccactatatatcaagagataacttgtaaattcatctatttgttatctttttatacttatattataacgctaaaaagttcagtagggaacaataatgctcataaatttttaattaatcttggtaatcttttcttctgttaaggtttctcgcaatattgaagcaacgcaaaacacaaaagaattgcaagacctcgcaatctccttatttcgtgaaaagtaccaggggggagcaataagacaaataggaataagcggaaatcaactccgtcgtttaataggtcgatggtcttgttctattaaattgttaagatacttcacagttcggtgctctgtcttagtatataaacccacactctgtaactttctaaaggcagagccaagagaaggtgctttatcaccgtcgtttaataggtcgatggtcttgttctattaaattgttaagatacttcacagttcggtgatctgtcttagtatataaacccacactctgtaactttctaaaggcggagccaagagaaggtgctttatcgtgatggcattgattgaccaaatgtcaactacaatcgcaacacaagctcaaatgattggtacaagagatcaattgctcgatgaagcatatttaaaacttgaatcagccgaaacagaattaattattcgtcgcaattttttcaaaaattttccagcgctaccgctcggcaaaattgcaagcaattttaaaaccatgagggaatttcattccctcaaactcccttgagcctcctccgaccgaaataaggggcgctacgcttattatttccactggaaccagagattttaagatattctatcgggtatcaagtcatggctaaataatcaactagcaattcgggtttaataatactatttttaaattatccagtgattatttagataaacaaatgaagaaagattgaatcgtccttggacgattcaacaaaaaaagtagtcgtttttggacgactactaagttctaaacattcattacccaaaatcaatttggtctaacatcgtttctcgactagcttgatctaatccaagataccttacaggaggaattaaacaaacaaaagatacattcacaagaggaacgagaaaaattaaaagcagaattgacaactcctaaaaaatggtatcaattttggaaatgacaaaaagcctataaaatgagattgaggtatcttcataaggtaacgtttttgttgtttccacgtattctaaaatctttgtgtctagcttgtctaattgatgttgtgtttcttgataggtggcttttaactcttcccctatggtttcaaaacttcaaatcgacacaatccaaaggggataaaaggggaaagtgaaacttcccccttttcaagccacattgtaatacaagaacgaagtgctttgtattacaatgtgatagcttgcagtatttatggttttatataagtattgaccatattcgccgagaaaaagaagtgagtgctgcggatatggctcaaaccatacaacctttagcactcaatgtcagactaagctgtcaactccttgatgttcctgaatcaagttattatgtgaactatcagccattgaagcaggagtaattgtgtagtctatgacatagcctgattcactgactgaagcatgacatttacatccatagaagtactgtccctttgtagcattgtagccaacatttgcatcataataacttgattcaggaacatcaaggagttgacagcttagtctgacattgagtgctaaagtttgtatggtttgagccatatccgcagcactcacttctttttctcggcgaatatggtcaatacttgctacaatgctacaaagggacagtacttctatggatgtaaatgtcatgctttagtcagtgaatcgggctatgtcatagactacacaattactcctgcttcaatggctgatagttcaatgaccgaggaaaatggggaagctgtcaataatggatacactcattccttcaacctctttaaagacgagtgcttgtcgaatgacttggatactcggtaagagggcattacaacggcggacaaagcgagaatattctaggacctgccaaattatctatttctttaacaactggaatgattgaaggtaggagcttttgacctaaatcaattgataaaacttccaaagtcgctttagctttattaaaagcattcttatcagaattgttcatcggattgaccagaatgatagaaggcgataagggtttctttaaattcttttgagtagcctttttgcatgtttttgtcctttgtctaaattatacaatagtgactctaagatttaaggataacatcatttttaagatgtctcgttcttccttaactttagccagttgtctttttaattctagaaaatcggctttagagacggagctttcattagatttagagtagaggtctatccatttataaattgttgcatacagaagctaatgaagcaacttcaactcaagtctgtagtcattaagaaatttaagcctggatactcactaagtgatcacatcaatcgaaaaaatctcatacagactgaacctacaaagaagaatgataactaagcaatctgatgttgcgagatggacgttctttcggttttgaacctcaaggggaacactcgtttgataaagcgtctcaatggttgtcagtaaataaacaaaaacttttggaagtgtgcacacttccaaaagtttttgtttatttactgacaaccattgagacgctttatcaaacgagtgtttcccttgaggttcaaaaccgaaagaacgtccatctcgcaacatcagattgcttagttatcgctcaaagtttatttcctaatttcctagaatattctcgctttgtccgccgttgtaatgcgctcttaccgattatccaagtcattcgccaagcactcgtctttaaagaggttgaaggaatgagtgtatccattattgacagcttccccattcctttgtgtcagcctattcgtaatttcaaaagcaaagttcttggagattatgcaaatgttggctacaatgctacaaagggacagtacttctacccttgaggttcaaaaccgaaagaacgtccatctcgcaacatcagattgcttagttatcccttgttacctatggggcgtactgcattttagtgaaacgcttaaagctaagcaccaacctgaacttcacgatagcttagattgtaacgcaggtagtaaccaacagcgacaataatgacgtcttttttgaattgtttgcctttaaaatgattcattactctgtcctctctgttacctatggggcgtactgcattttagtgaaacgcttaaagctaagcatcaacttgctcaaagtttatttcctaatttcctagaatattctcgctttgtccgccgttgtaccaataataattttgtaaaatcatcaatcttattatttacttcttgagctaaatctgtaactgtagaatcatctgatataaatgttaaattcttactgacaataacttgtcgttctgctttatcccggactgtttcatagttatccaactttgtttcaattcgagctaatcgttcgagcacttctcgccatgcttgttcctccataacccctgctttctgacgtctgataaaaaaggaaaaacgattagaacgcttttcttttttatgtctatttatttgataatagtccagcaggggccacgtcgtattctttagacagctgggtgagcttcggcttttcggtgtctactgaaatcaagggattaatgggaataacagcctaagatatttggagttcagagagagcgcgtttgattttcaaacttcgcaacagaacctttgtagcattgtagccaacatttgcataatctccaagacctttgcttctgaaattacgaatcggctgacacaaaggaatggggaagctgtcaataatggatacactagaacccaaaatggaatacatcttcttaggtcaatgttcttttatatttgagtgtccataaaatggtcattttctggacactcttcttttgttataaaaactctcaaacacctgtcaggaagaacatgaagcaaaagaaaatccttttccctaatttttcaaaacgtagaaaagtgattgagcgagttttctcttttttgacaaatctaggagcttgggagtttagctcagctgggagagcatctgccttacaagcagagggtcagcggttcgatcccgttaactcccattggttgtttcagccattaattgaataaagggttcaaaaccgaaagaacgtccatctcgcaacatcaggttgcttagttatcgcttgttacctctggggcgtactgcattttagtgaaacgcttaaagctaagcgccccagaggtaacaagcgataactaagcaatctgatgttgcgagatggacgttctttcggtattgaacctcaaggggaaccctcgtttgataaagcgtctcttgcgaatccagcgtctaacctgactagatgaacctacgttgtgcagtttagcaagataggtagagcctcccttgccagataaataatcttgaataacgcgttgatactgtcaataattatgtgtaaacactcaagtagagttgaagaatattaatcaaataagctttcaagtgtgtcagcacattggccaaaccctttatggatgatactgtcaataattatgtgtaaacactcaagtagagttgaagaatattaatcaaataagctttcaagtgtgtcagcacattggccaaaccctttatggaacaactgaataaccaatggtatttttttctatccgttctttgagattttcctttaaaaatttatcattttttaaacttctatctctaatttttttggtttg
